United States Patent 8,343,764 (GENES ENCODING GLUTAMINE SYNTHETASE AND USES FOR PLANT IMPROVEMENT) - sequence listing, part 5

SEQ ID NO: 19397 - protein, 446 aa, Enterococcus faecalis V583
MKVVVVGCTHAGTSAVKSILANHPEAEVTVYERNDNISFLSCGIALYVGGVVKNAADLFYSNPEELASLGATVKMEHNVEEINVDDKTVTAKNLQTGATETVSYDKLVMTTGSWPIIPPIPGIDAENILLCKNYSQANVIIEKAKDAKRVVVVGGGYIGIELVEAFVESGKQVTLVDGLDRILNKYLDKPFTDVLEKELVDRGVNLALGENVQQFVADEQGKVAKVITPSQEFEADMVIMCVGFRPNTELLKDKVDMLPNGAIEVNEYMQTSNPDIFAAGDSAVVHYNPSQTKNYIPLATNAVRQGMLVGRNLTEQKLAYRGTQGTSGLYLFGWKIGSTGVTKESAKLNGLDVEATVFEDNYRPEFMPTTEKVLMELVYEKGTQRIVGGQLMSKYDITQSANTLSLAVQNKMTVEDLAISDFFFQPHFDRPWNYLNLLAQAALENM

SEQ ID NO: 19398 - protein, 469 aa, Enterococcus faecalis V583
MVKQFKNDFLWGASSSAFQIEGAWNEDGKGLTVADYNSFKKSAVQADTKVASDFYHRFKEDIALMKELGLKTYRFSLSWARIIPTGDGEINQAGIDFYNAVIDTLLENDILPFVTLYHFDLPFALVEKYNGWADRRCVSAFQRYAQVCYQAFGDRVKNWQVTNEQNLMIRVDERMNMYDVAPENVEKIRAQMDYHMFVAHALATNDCHQLVAGGKVGPSVSSTMTYPSSNKPEDVWAARMNDNFKTNYALEMYCFGEYPGYYQEYLTKCGIYPETQPEDQAILKAAKPDFIALNYYRTLVASYLPTDEQHPLGTKEKDIDFDLYGYFKIEKNQHLKTSKYGAQIDPTGLRLVLNDYYRQYRLPLIITENGLGTPDHLTEDGKIHDDYRIAYLHDHIAACHAAISDGVELFGYCPWSVMDILSSHQGFKKRYGFIYVNREDHELKDLRRIKKDSFYWYQSVIKNNGLSEE

SEQ ID NO: 19399 - protein, 469 aa, Enterococcus faecalis V583
MAEQTDLLILGGGTGGYVAAIRAAQKGLNVTIVEKYKLGGTCLHKGCIPTKALLRSAEVFDTLKQAASFGIETEAASIDFSKIQQRKEGIIEQLHKGVEGLCKKNKIKILAGEGAILGPSIFSPVSGAVAVTFNDPTREEEIIVPKNVIIATGSSSKTLPNLPLDEEFILSSDGMLELEELPESIAIIGGGVIGVEWASLLNSLGVNVTIIEFLDRLLINESATISKELKKRLEQRGINILLGSKVQEAKVTGQKVQVEVAGQETLTVDKVMVAIGRQPNINKLGLQNTSVKYTDKGIEVNEFYQTTEGHIYAIGDCIDTLQLAHVAMKEGELAVQHLLGETVEPLNYTNVPRGVYTNPEIASVGYTRETLPAEKEVVIGTFNFNGNGKSLVYGETDGFIEVIRDKKTDDLLGVSMIGPHVTDLIAEASTAMYLDAAPIEIGEAIHAHPTMTEVLQEAALDTYGLAIHK

SEQ ID NO: 19400 - protein, 513 aa, Enterococcus faecalis V583
MTKRALISVSDKTGVTTFAAGLVANGFEIISTGGTRTVLEEAGVPTLAIDDITGFPEMLDGRVKTLHPNIHGGLLAKRGNQAHQKALTEQGIHFIDLVVVNLYPFKETILKPAISEAEAIEMIDIGGPSMLRSAAKNYQDVTAVVDPSDYEQVLSEISSTGTSQLATRKRLAAKVFRHTAAYDALIADYLTTQVGETEPEKQTLTYERKQTLRYGENSHQQATFYQSVVPVSLSIASARQLHGKELSYNNIRDADAALRIASEFTEPTVVAVKHMNPCGIGTGKTILAAYRQAFEADPVSIFGGIVVLNRPVDQATAAEMHQIFLEIIIAPSFEEEALALLSQKKNLRLLTLDFHAQEKKAVELVSVMGGLLIQEQDTVVENDQAWQVVTERQPTPAERDALNFAWKAVKHVKSNAIVLANESQTVGIGAGQMNRIGSVKIAVDQAQAAGKLQGAVLASDAFFPMADSVEYAAQHGIQAIIQPGGSIKDQASIDLANHYGIAMIFTGTRHFKH

SEQ ID NO: 19401 - protein, 291 aa, Enterococcus faecalis V583
MRYLSKDILEEVITQRPSDSYKSNFGRVVLIGGNRQYGGAIIMSTEACINSGAGLTTVITDVKNHGPLHARCPEAMVVGFEETVLLTNVVEQADVILIGPGLGLDATAQQILKMVLAQHQKQQWLIIDGSAITLFSQGNFSLTYPEKVVFTPHQMEWQRLSHLPIEQQTLANNQRQQAKLGSTIVLKSHRTTIFHAGEPFQNTGGNPGMATGGTGDTLAGIIAGFLAQFKPTIETIAGAVYLHSLIGDDLAKTDYVVLPTKISQALPTYMKKYAQPHTAPDSELLEQKRSR

SEQ ID NO: 19402 - protein, 338 aa, Enterococcus faecalis V583
MYKAIVAAKGKTTKIVEKESRPLKDNEARLKMEVCGVCHTDLHVKNADFGDVSGCTLGHEGIGIVTEVGKDVTSLKIGDRASVAWFYEGCGHCEYCTSGRETLCRSVKNAGYTVDGAMAEECIVTDGYAVKVPENLASEPASSITCAGVTTYKAIKESGIRPGQWLMISGLGGLGNLALQYAKHVFNAKVVAVDVNDNQLAFAKEMGADLLINPVKDPDFAAQLQKEIGGVHAAVVTAVAKSAFNGAVDAVRAGGTVVAVGLPVETMDLSIPRLVLDGIHVVGSLVGTRQDLREAFQFGAEGKVVPVCQTRQPEEINAIFEEMEQGKIRGRMVIDFRS

SEQ ID NO: 19403 - protein, 234 aa, Enterococcus faecalis V583
MTQLFGEFFGTMILVLLGDGVCAAVNLKKSKAFASGWVVIALGWGAAVTLAVYMSGYMSPAHLNPAVTVAMAITGNFEWGMVLPYIVAQVLGGFIGGLVVWLAYLPHWNITEDKGAILGTFATGPAVRNYPANVLTEIIGTFVLVFGLLAFSQNDLAAGINPMLVGILVLGLGLSLGGPTGYAINPARDLGPRLAHQIIPVKTKGDSDWAYSWVPIVGPILGASLAAVIYLFTI

SEQ ID NO: 19404 - protein, 432 aa, Enterococcus faecalis V583 [sequence omitted]

SEQ ID NO: 19405 - protein, 251 aa, Enterococcus faecalis V583
MRKPIIAGNWKMNKTLSEAQSFAEAVKNAVPSNDVVDAVIGSPALFLAPLAWNLKDSEVKLAAQNCYWENAGAFTGENSPAAIADLGVDYVIIGHSERREYFHETDEDINKKAKAIFANGMTPIFCCGETLETYEAGKTAEWIEGQITKGLVGLSNEQVASMVIAYEPIWAIGTGKSADANIADEICGVVRSTVEKLYGKEVSEAVRIQYGGSVKPENIAEYMAKENVDGALVGGASLEADSFLALLDAVK

SEQ ID NO: 19406 - protein, 397 aa, Enterococcus faecalis V583
MAKKTIKDVDLKDKKVLVRVDFNVPLKDGVITNDNRIVAALPTIKYVIENGGKAILFSHLGRVKTEEDKAGKSLKPVAERLSELLGQPVTFVPETRGKELEDAVNNMKDGDVLVFENTRFEDVDGKKESGNDAELGKYWASLGDVFVNDAFGTAHRAHASNVGIASTGIPTVAGFLMEKEIKFIGEAVENPKRPFVAILGGAKVSDKIAVIENLIEKADKILIGGGMAYTFMKAQGYSVGLSLLEEDKVDLAKSLMEKAGDKLVLPVDTVVSKEFSNDAPFHTVPSTEIPDDEEGLDIGEKTIELFANELQGAKTVVWNGPMGVFEMSNFAKGTIGVCEAIANLEDATTIIGGGDSAAAAIQLGYENKFSHISTGGGASLELLEGKTLPGLASINDK

SEQ ID NO: 19407 - protein, 446 aa, Enterococcus faecalis V583
MTRKAKTAEEIKHIAEEENVRFLRLMFTDIMGTIKNVEVPVSQLDKVLDNKMMFDGSSIEGFVRIEESDMYLYPDLSTWMIFPWESDHGKVARLICDIYNPDGTPFAGDPRGNLKRALADMKELGFTSFNLGPEPEFFLFKLDENGEITTDLNDKGGYFDFAPTDLGENCRRDIVLELESLGFEVEASHHEVAPGQHEIDFKYADVVDACDNIQTFKLVVKTIARKHGLHATFMPKPLFGINGSGMHCNMSLFNEEGNVFYDESGEMGLSQTAYHFLGGLLKHARAYTAVCNPTVNSYKRLVPGYEAPVYVAWSGRNRSPLIRVPESRGLSTRLELRSVDPSANPYLTMAVLLQAGLDGIRNELTPPPAVDRNIYVMNEEERQHAQIEDLPSTLHNAIKELRKDQVMIDALGRHIFANFVEAKRMEWAAFRQTVSEWEREQYLELY

SEQ ID NO: 19408 - protein, 325 aa, Enterococcus faecalis V583
MKVFDYEDVQLIPNKCIVNSRSECDTTVTLGKHSFKMPVVPANMQTIIDETIAETLAENGYFYIMHRFDEEARVPFIKKMQQKGLITSISVGVKEGEYAFVETLAREGLVPDYVTIDIAHGHSNAVINMIQHLKKSLPETFVIAGNVGTPEAVRELENAGADATKVGIGPGKVCITKIKTGFGTGGWQLAALRWCAKAARKPIIADGGIRTHGDIAKSVRFGATMVMIGSLFAGHEESPGETKVEDGVVYKEYFGSASEFQKGEKKNVEGKKIWLRHKGKLADTLVEMQQDLQSSISYAGGRDLEAIRKVDYVIVKNSIFNGDTI

SEQ ID NO: 19409 - protein, 472 aa, Enterococcus faecalis V583
MARKSRIKTPIAEQAPTIRKNNFEEVCLGYTLAEGQEEAIRCLQCKNAPCIAKCPVMIDIPGFILAIREGNMEQAADILSKYTNLPAICGRVCPQEKQCEQVCKLGKAKNFEPVAIGKLERLVADWALENHKFPKKTAEPTKGKIAVVGSGPSGLTVAGDLSKLGYEVIIFEALHEAGGVLTYGIPEFRLPKKIVKQEIASIEALGVTIETNVVVGKTITMEEIMSEFDACYLSVGAGAPNFMGIPGTSLNGVYSSSEFLTRINLMHSYEFPEYDTPIKRAKNVVVIGGGNVAMDAARSAKRLGAENVNIVYRRSLEELPARIEEYHHSLEEGINYYWLTNPIAYLDDQQGNLAGVECVKMVLGEPDASGRRRPEPIPNSTFTIPADAVIEAIGQGANRVLLSTYPEIELNQWGYIQADPKTGATSIPGVFAGGDIVTGAATVILAMGAGKIAANAIDQYVKTQKTTVTSNV

SEQ ID NO: 19410 - protein, 1001 aa, Enterococcus faecalis V583
MSDIMHPISIEALLNWIFSEYQQDGTIFGIRKFYHADPTKTISLFGEKMETPCGPAAGPHTQLAQNIIAAYLTGSRFFEVKTVQILDGEDLPVSKPCIAAADECYNVEWSTELRVPQAYDEYVKAWFVLKLLSKEFELGDPNGFIFNMSVGYDLAGIQSPKIDRYINEMQNAEGTPIWAECQAAAKKYLSYFKKVDDLYIEAISPKVCHSITLSTLHGCPSDEIERIAAYLLSEKGLHSFIKCNPTMLGYEYARQTMDELGFDYMVFDDHHFKEDLQFEEAVPMLQRLQLLANSKNLSFGVKITNTFPVTIAANELPGDEMYMSGRSLFPLSISLAQKLSEAFDGKLQISYSGGADIFNSKEIFDAGIWPITMATTLLKPGGYQRMNQVANVLSAAEYPQMVHVNLDKLAQVVEKAKTQARYQKSIKLPESTKLRKTVPLTDCYIAPCRSDGGCPINQDIPAYLRYVSEGNYLKALQVIVDKNPLPFITGTICAHPCMTKCTRQFYEESIHIREVKLEAAEHAYDELLTTLEKPQPKENAPKTAVVGGGPAGISAGYLLAREGMPVTVFEKSETIGGVCSQIVPEFRISMESVQKDVQLAEFMGAEFRTGQEAPSLAELKNQGYTNVIYAIGAWKHGVLRLESGRALNSLEFLKANRENPTINPYGEQIVVVGGGNTAMDCARAATTLPGVKKVSVVYRRNKRNMPADEEELYLALEDGVDFLELLSPIKHENQQLTCEKMVLGERDASGRRRPIGTGEMIDIPADTVIAAVGEKVDTEFYQALGIHTDNYGKVVSNQETLETNIPGVYVIGDANLGPATIVEAIADATKAANNICLVHNHHYEKDNLNSDVAFVRNKRGILVTDEMSCSQASRCLECSTICESCMDVCPNRANIVVYVEGKPQIVHVDRMCNECGNCETFCPYASAPYKDKFTLFNSEADFYDSTNSGFYVQNPVDKICLLRLWGTVSTIQLTDQGLDVPEDLIALMVTMIEEYAYCMQA

SEQ ID NO: 19411 - protein, 481 aa, Enterococcus faecalis V583
MTTTTKFPKGFLWGGATAANQLEGAYLADGKGLSVADAMPGGKQRFAILGDEAFDWTIDETKYRYPNHTGIDHYDRFKEDIALFAKMGFKCYRFSIAWSRIFPQGDETQPNEAGLKFYDAVIDECLSYNIEPVITISHYEMPLHLAKEYGGWKNRQLVDFYERFAETVLTRYHQKVNYWMTFNEINSAFHFPALSQGLVKSNGANDYQNIFQAWHNQFVASSKAVKIGHELNPELQIGCMIIYATTYGIDSNPVNQVATMIENQEFNYYCTDVQVRGEYPAYAERMYQKYAVKDLVIEEGDLELLKEYPVDYIGFSYYMSTAVDVTGTTNDTANGNLLGGVKNPFLEASEWGWQIDPEGLRIALNELYNRYQKPLFIVENGLGAIDKVDENFYVADDYRIDYLRRHIEAMAEAVADGVDLMGYTPWGCIDLVSASTGEMSKRYGFIYVDLDDEGNGTKNRYEKKSFNWYKQVIETNGQNLD

SEQ ID NO: 19412 - protein, 494 aa, Enterococcus faecalis V583
MDYTYADDSLTLHTDMYQINMMQTYWELGRADLHAVFECYFREMPFNHGYAIFAGLERLVNYLENLTFTESDIAYLREVEEYPEDFLTYLANFEFKCTVRSALEGDLVFNNEPLIQIEGPLAQCQLVETALLNMVNFQTLIATKAARIKSVIGDDPLLEFGTRRAQELDAAIWGTRAAYIGGADATSNVRAGKIFGIPVSGTHAHSLVQSYGNDYEAFMAYAKTHRDCVFLVDTYDTLKAGVPSAIRVAREMGDKINFLGVRIDSGDMAYISKRVREQLDEAGFTEAKIYASNDLDENTILNLKMQKSKIDVWGVGTKLITAYDQPALGAVFKLVSIEGEDGQMKDTIKLSSNAEKVTTPGKKQVWRITRKSDKKSEGDYVTLWNEDPRQEEEIYMFHPVHTFINKYVRDFEARPVLQDIFVEGKRVYELPTLDEIKQYAKENLDSLWEEYKRDLNPQKYPVDLSTDCWNHKMNLLEKVRKDVKHLTETVNKEA

SEQ ID NO: 19413 - protein, 361 aa, Enterococcus faecalis V583
MRNHVISFENVVKQFDDEPVLKNVSFEIEEGKFYTLLGPSGCGKTTILRIIAGFNDVTSGDVYFDGKRINDVPANKRQVNTVFQDYALFPHMNVFDNVAFGLKIKKLSKAEIEKKVKEALRLVQLPGYETREISEMSGGQRQRVAIARAIVNEPKVLLLDEPLSALDLKLRTAMQYELRDLQQRLGITFIFVTHDQEEALAMSDEIFVMNKGHIVQSGTPVDIYDEPINHFVADFVGESNIVDGVMLEDNLVSFVGKKFECVDGGMRKNEPVEVVLRPEDLTITTLEKGKLTVTVDTQLFRGVHYEIICFDEQGNEWMVHSTRKAKEGAQVGLSFEPEDIHVMRFNESEEDFDARLESYDE

SEQ ID NO: 19414 - protein, 296 aa, Enterococcus faecalis V583
MSKIGFIGTGVMGKSIIRNMMKNNLSVNVYNRTKSKTDDLVAEGAVWYDTPKAIAEASDIIFTMVGFPSDVEGVYFNETGIFQADLTGKIVVDLTTSTPTLAEKIAKKAAEVGAHALDAPVSGGDLGAKNGTLTIMVGGDQESYDTVLPIFKTFGKTFMLHGSAGKGQHTKMANQLMIAGTMTGLTEMLVYANATGLTLEKVLETVGGGSAANWSLSNYGPRILKEDYTPGFFVKHFIKDLKIALDEAKKLDLPLPATQKATELYESLADKGFENDGTQALIKLWWTDGKQPTNKN

SEQ ID NO: 19415 - protein, 437 aa, Enterococcus faecalis V583
MKEKISSYFELEQLNTNMKREMLAGFTTFISMAYILFVNPTVLGASGMDEGAVFTATALASALGCILMGVLAKYPIATAPALGINAFFAYSVSVGMGIPWQTTLAGVFVASLIFILITIFKLRELIIDAIPADLKFAISGGIGLFIAFLGLSQGGLIVANDATLVGLGPLNVGSTWVTIVGLVVTAILLVRRVPGGIFIGMAISTIVGLATGVIPMPDKIISSAPSLEPTFLVALGHVKDINTIQMWVVVLTFLLVTFFDTAGTLVGLANQAGFMKDNKMPRVGKALAADSTAMLAGSLLGTSPVGAYVESSAGIAVGGRSGITAITTGILFIFSLLFSPLLAVVTSQVTAPALIIVGVLMAQSLSKIKWNEMEIAIPSFLILLGMPLTYSISDGIALGFIFYPITMIAAKRGKEVSPIMYGLFFVFVGFMWILNAQ

SEQ ID NO: 19416 - protein, 217 aa, Enterococcus faecalis V583
MKLAPSILSADFANLERDIRLVEELGADYIHVDVMDGQFVPNITLGPNIVSAIRPVTKLPLDVHLMIVQPENYINAFAEAGADIITVHQEATPHIHRALQMIKNAGVKAGVTINPGTPLSMIENVLDLADQVLVMTVNPGFGGQSFIENSLEKIAQLKEWKETKGYTYEIEVDGGIVPETAARCKEAGAEVFVAGSYIYNAENPQERIDALRAVLDK

SEQ ID NO: 19417 - protein, 333 aa, Enterococcus faecalis V583
MLKKQKIAIVNSSSFGQIFPEHLTRLEKIGTVKHFTVDSEIGGKELAERLQGYTIIIASVTPFFTKEFFEHKDELLLISRHGIGYNNIDLDAAKQHDTIVSIIPALVERDAVAENNVTNLLAVLRQTVAADASVKADQWEKRANFIGRTLFNKTVGVIGVGNTGSCVVETLRNGFRCDVLAYDPYKSATYLQSYGAKKVDLDTLLASADIICLCANLTEESYHMIGSAEIAKMKDGVYLSNSARGALIDEEAMIAGLQSGKIAGLGTDVLEEEPGRKNHPYLAFENVVMTPHTSAYTMECLQAMGEKCVQDVEDVVQGILPQRAVQEVSRYVS

SEQ ID NO: 19418 - protein, 299 aa, Enterococcus faecalis V583
MDIGFIGLGKMGLNMALNVHEQGWPIIGFDVTKEARATAREQGLSVVDSLSELLKALNKRKVIFLSTPAGQITNQLVAELVEQLAPEDIIVDSGNSNFHDSVANAQLAKEKGIYFIDCGTSGGIKGAREGACLMVGGAPEAVKVLTPFFEDLACEQGYLYAGKSGAGHYLKMVHNGIEYVMMQAMGEGFNLLEAAEYDFALEKVADVWNHGSIIEARLMGLAKEVFAENPTLANLEGKVAANGEAKWMIEEALRLEMPVPTTALSLFTRNESMLANHFSNKVVASLRQGFGGHEVVKSQ

SEQ ID NO: 19419 - protein, 449 aa, Enterococcus faecalis V583
MKTYDYIVIGGGSGGIASANRAGMHGANVLLIEGNEIGGTCVNVGCVPKKVMWQASSMMEMMERDTAGYGFDVEIKNFSFKQLVENREKYIDFLHGAYNRGLDSNNIERIHGYATFTGEQTIEVNGTEYTAPHILIATGGRPKKLGIPGEEYALDSNGFFALEEMPKRVVFVGAGYIAAELAGTLHGLGAETHWAFRHERPLRSFDDMLSEKVVERYQEMGMQIHPNATPAKIEKTAQNEYVITFENGESITTDAVIFGTGRQPNTDQLGLENTKVALDEKGYVKVDKFQNTTQNGIYAVGDVIGKIDLTPVAIAAGRRLSERLFNGQTDLYLDYNLVPTVVFTHPPVATIGLTEKAALEEYGEDQVKIYRSSFTPMYFALGEYRQKCDMKLICVGKEEKIVGLHGIGIGVDEMLQGFAVAIKMGATKADFDNTVAIHPTGSEEFVTMR

SEQ ID NO: 19420 - protein, 493 aa, Enterococcus faecalis V583
MSNWETKFAKKGLTFDDVLLIPAESHVLPNDVDMSVQLAKNIKLNIPLMSASMDTVTDSNMAIAMARQGGLGVVHKNMTVAQQADEVRKVKRSESGVIIDPFFLTPTNLVADAEELMSRYRISGVPIVETMENRKLVGIITNRDMRFVTDYQIKIEEVMTKDHLVTAPVGTSLKDAEKILQKHKIEKLPIVDEAGRLSGLITIKDIEKVIEFPNAAKDEHGRLLVAAAVGVTSDTFERAEALLEAGADAIVIDTAHGHSAGVIRKIKEIRETFPEATLIAGNVATAEATKALYDVGVDVVKVGIGPGSICTTRVVAGVGVPQLTAIYDAASVAREYGKAIIADGGIKYSGDIVKALAAGGHAVMLGSMLAGTDESPGEFEIYQGRRFKTYRGMGSLGAMEKGSSDRYFQGSVNEANKLVPEGIEGRVAYKGSVSDIVFQLIGGLKSGMGYVGAADLKALREEAQFVQMSGNGLKESHPHDVQITKEAPNYSVQ

SEQ ID NO: 19421 - protein, 491 aa, Aspergillus niger
MADQAVADFGLIGLAVMGQNLILNAADHGFTVCAYNRTTSKVDRFLENEAKGKPIVGAHSVEEFCAKLKRPRRIMLLVMAGKPVDQFIESLLPHLEKGDIIIDGGNSHFPDSNRRTKYLAEKGIRFVGSGVSGGEEGARYGPSLMPGGNEEAWPYIKDVFQSISAKSDGEACCDWVGDEGAGHFVKMVHNGIEYGDMQLICEAYDILKRGLGLPAKEIADVFAKWNKGVLDSFLIEITRDVLYFNDNDGTPLVEKILDKAGQKGTGKWTAINALDLGMPVTLIGEAVFSRCLSALKDERIRASSLLDGPTPEFTGDKQAFIDDLEQALYASKIISYAQGFMLIQEAAREYGWKLNKPSIALMWRGGCIIRSVFLKDITNAYRKNPDLENLLFDEFFNTAIKKAQSGWRNVVSKGALWGIPTPAFSTALSFYDGYRTRDLPANLLQAQRDYFGAHTFRIKPEHANETYPEGKDIHVNWTGRGGNVSASTYIA

SEQ ID NO: 19422 - protein, 475 aa, Pennisetum glaucum
MSPQTETKASVGFKAGVKDYKLTYYTPEYETKDTDILAAFRVTPQPGVPPEEAGAAVAAESSTGTWTTVWTDGLTSLDRYKGRCYHIEPVPGEADQYICYIAYPLDLFEEGSVTNMFTSIVGNVFGFKALRALRLEDLRIPPSYSKTFQGPPHGIQVERDKLNKYGRPLLGCTIKPKLGLSAKNYGRACYECLRGGLDFTKDDENVNSQPFMRWRDRFVFCAEAIYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIFFTQDWVSMPGVIPVASGGIHVWHMPALTEIFGDDSVLQFGGGTLGHPWGNAPGAAANRVALEACVQARNEGRDLAREGNEIIKAACKWSPELAAACEVWKEIKFEFEAMDTL

SEQ ID NO: 19423 - protein, 205 aa, Schizosaccharomyces pombe
MSSCFGSKKKPIYRKIVILGDGAAGKTSLLNVFTKGYFPQVYEPTIFENYIHDIFVDGNSIELSLWDTAGQEEYDQLRSLSYSDTHVIMICFAVDSRDSLENVITKWLPEVSSNCPGVKLVLVALKCDLRGADEEQVDHSKIIDYEEGLAAAKKINAVRYLECSAKLNRGVNEAFTEAARVALAAQPRGTKDGADESHGTGCIIA

SEQ ID NO: 19424 - protein, 358 aa, Brassica oleracea var. capitata
MVAVERVESLAKSGINSIPKEYIRPKEELESINDVFQEEKKEDGPQVPTIDLQDIESEDETIREKCIEELKKAAMDWGVMHLINHGVPVELMERVKKSGEEFFGLPVEEKEKYANDQAKGKIQGYGSKLANNASGQLEWEDYFFHLVYPEDKRDLSLWPKTPTDYIEATSEYAKCLRLLATKVFKALSIALGLEPDRLENEVGGIEELLLQMKINYYPKCPQPELALGVEAHTDVSALTFILHNMVPGLQLFYEGKWVIAKCVPDSIVMHIGDTLEILSNGKFKSILHRGLVNKEKVRISWAVFCEPPKEKIVLKPLPEMVSVESPAKFPPRTFAQHIEHKLFRNEQEELVTEKKDEV

SEQ ID NO: 19425 - protein, 385 aa, Brassica oleracea var. capitata
MVAHKETVCVTGASGFIGSWLVMRLLERGYFVRATVRDPGNLKKVQHLLDLPNAKTQLTLWKADLSDEGSYDDAINGCDGVFHIATPMDFESKDPENEVIKPTVNGVLGITKACDKAKTVRRIVFTSSAGTVNVEEHQKNVYDENDWSDLDFIMSKKMTGWMYFMSKTLAEKAAWDYAKEKGIDFISIIPTLVIGPFITTSMPPSLITALSPITRNEAHYSIIRQGQYVHLDDLCHAHIFLYEQAAAKGRYICSSHDATILTISEFLRQKYPEYNVPSTFEGVDENLKSIMFSSKKLIDMGFNFKYSLENMLVESIETCRPKGFLPVTLPEHLKSEDRVPGSDDNKEIKNGSAGLTDGMVACKKTEPGMVGEKADSHMSAQQICA

SEQ ID NO: 19426 - protein, 475 aa, Paeonia tenuifolia
  misc_feature (1)..(10): Xaa can be any naturally occurring amino acid
XXXXXXXXXXVGFKAGVKDYKLTYYTPDYKTKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFAQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 19427 - protein, 214 aa, Escherichia coli O6
MRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKPVAEVRAALEKILG

SEQ ID NO: 19428 - protein, 348 aa, Deinococcus radiodurans
MRALSKQQPGEGIWMIETEVPTPGPNDLLIRIRKGSICGTDVHIYKWDDWASQTVPVPMVVGHEYVGVVAGMGSEVRGFEIGDRVSGEGHVTCGHCRNCRAGRRHLCRNTQGVGVNRPGSFAEYLVLPAFNAFKLPDDIPDDVAAIFDPFGNAVHTALSFDLVGEDVLITGAGPIGCMAAAVARHVGARNVVITDVNDYRLDLARQMGVTRAVNVAREDLWTVATQELDMHEGFDVGMEMSGSGPAFAQMVSVMNNGGKVALLGIPSGEVQIDWNAVIFKMLTIKGIYGREMFETWYKMAALIQSGLDLTPVITHHYGIGDFQQGFDAMLSGQSGKVILDWETEEQSA

SEQ ID NO: 19429 - protein, 1021 aa, Daucus carota
MGVLRVYVILILVGFCVQIVVVNSQNLTCNSNDLKALEGFMRGLESSIDGWKWNESSSFSSNCCDWVGISCKSSVSLGLDDVNESGRVVELELGRRKLSGKLSESVAKLDQLKVLNLTHNSLSGSIAASLLNLSNLEVLDLSSNDFSGLFPSLINLPSLRVLNVYENSFHGLIPASLCNNLPRIREIDLAMNYFDGSIPVGIGNCSSVEYLGLASNNLSGSIPQELFQLSNLSVLALQNNRLSGALSSKLGKLSNLGRLDISSNKFSGKIPDVFLELNKLWYFSAQSNLFNGEMPRSLSNSRSISLLSLRNNTLSGQIYLNCSAMTNLTSLDLASNSFSGSIPSNLPNCLRLKTINFAKIKFIAQIPESFKNFQSLTSLSFSNSSIQNISSALEILQHCQNLKTLVLTLNFQKEELPSVPSLQFKNLKVLIIASCQLRGTVPQWLSNSPSLQLLDLSWNQLSGTIPPWLGSLNSLFYLDLSNNTFIGEIPHSLTSLQSLVSKENAVEEPSPDFPFFKKKNTNAGGLQYNQPSSFPPMIDLSYNSLNGSIWPEFGDLRQLHVLNLKNNNLSGNIPANLSGMTSLEVLDLSHNNLSGNIPPSLVKLSFLSTFSVAYNKLSGPIPTGVQFQTFPNSSFEGNQGLCGEHASPCHITDQSPHGSAVKSKKNIRKIVAVAVGTGLGTVFLLTVTLLIILRTTSRGEVDPEKKADADEIELGSRSVVLFHNKDSNNELSLDDILKSTSSFNQANIIGCGGFGLVYKATLPDGTKVAIKRLSGDTGQMDREFQAEVETLSRAQHPNLVHLLGYCNYKNDKLLIYSYMDNGSLDYWLHEKVDGPPSLDWKTRLRIARGAAEGLAYLHQSCEPHILHRDIKSSNILLSDTFVAHLADFGLARLILPYDTHVTTDLVGTLGYIPPEYGQASVATYKGDVYSFGVVLLELLTGRRPMDVCKPRGSRDLISWVLQMKTEKRESEIFDPFIYDKDHAEEMLLVLEIACRCLGENPKTRPTTQQLVSWLENIDVSS

SEQ ID NO: 19430 - protein, 476 aa, Piptocarpha axillaris
MSPQTETKASVGFKAGVKDYKLTYYTPDYETKDTDILAAFRVTPQPGVPPEEAGAAVAAESSTGTWTTVWTDGLTSLDRYKGRCYGIEPVPGEESQFIAYVAYPLDLFEEGSVTNMFTSIVGNVFGFKALRALRLEDLRIPIAYVKTFQGPRHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIFFTQDWVSLPGVIPVASGGIHVWHMPALTEIFGDDSVLQFGGGTLGHPWGNAPGAVANRVALEACVQARNEGRDLAREGNEIIREAAKWSPELAAACEVWKEIKFEFAPVDTID

SEQ ID NO: 19431 - protein, 439 aa, Pyrococcus furiosus DSM 3638
MNISVSMNKFDSKIKFVQLVFVDINGMPKGMEIPASRLEEAVTDGISFDGSSVPGFQGIEDSDLVFKADPDTYVEVPWDNVARVYGFIYKDNKPYGADPRGILKRALEELEKEGYKAYIGPEPEFYLFKKNGTWELEIPDVGGYFDILTLDKARDIRREIAEYMPSFGLIPEVLHHEVGKAQHEIDFRYDEALKTADNIVSFGYITKAVAEMHGLYATFMPKPLFGFPGNGLHLHISLWKDGENVFMGEEGLSEIALHFIGGILKHAKALTAVTNPTVNSYKRLVPSYEAPVYISWGYRNRSALIRVPAFWGKGARIEYRCPDPSANPYFAFAAVLKAGLDGIKHKIDPFSYVEENVYEMSEEKRKELGLETLPGNLGEALGELEKDKVVKEALGDSYKNFINYKWKEWESYLEYLEEKHIPPDTEKVTEWELERYFFL

SEQ ID NO: 19432 - protein, 255 aa, Physcomitrella patens
MGSICSMKFPILMVAFLALGLPSVLGAPYGWKDAHITYYGSPNGGGTQGGACGYQNTYALGYGSFTAALSAPLFQGGAACGGCYQLKCAPVRETRTVHNWCWSYSRSIVVTATNLCPPGSHGGWCAWRPHFDLPMPAFTSLAKQVGGVAPVFYRRVRCAKRGGVRFTIGGNPYFLMVLIHNVGGAGDIRSVRIKGQYSGWVTMFRNWGSLWTCRTKLSGPLSFMITTSDGRTLVSNRAVGSWWKFGQTWEGSQFR

SEQ ID NO: 19433 - protein, 255 aa, Physcomitrella patens
MAMATHVALLLVSALALVTSVQSGYAGSDWISGVAHATFYGGVDAQGTQGGACGYGNLYSTGYGTSTTALSSALFNAGLSCGACFELKCDSANSKYCLPGDKSITVTATNYCPQGSDGGWCDSPKQHFDLSHPMFTSLAQEVGGVIPVTYRRAPCAKKGGMRFTINGNPWFVMILVTNCGGAGDVQQLQIRGSDTPWYPCVRNWGQMWQMTSDPNLPGKALSFRATLSDGSVAESLNAAPSNWGWGQTFEGVATY

SEQ ID NO: 19434 - protein, 254 aa, Physcomitrella patens
GTRKLAVCIAAVAILALNSLPSVLGAPYGWKEAHITYYGTANGGGTQGGACGYPNTFAMGYGVMTAALSYPLFQGGKSCGACYQLKCKWLAPTRTVHNWCWSYSRTITITATNSCPPGSHGGWCDWKPHFDLPMPAFMTLARREGGVAPVYYRKVRCAKRGGIRFTLGGNPYFMMILIHNVGGAGDLRAVKIKGRNGYWVPMWQNWGALWTCKTKLSGALSFQITTGDGRTVTVNRAVGDYWKFGQTWEGSQFR

SEQ ID NO: 19435 - protein, 318 aa, Striga hermonthica
MATFPVINMAKLNGEGRPATMAQIEDACQNWGFFEVVNHGISAEFMDRVERLTKEHYKKCMEQRFKEMVAAKGLEAVQSEINDLDWESTFFLRHLPSSNISEIPDLHPEYREVMKEFAAHLEKLAEHLLDLLCENLGLEMGYLKKVFYGSKGPTFGTKVSNYPPCPKPDLIKGLRAHTDAGGIILLFQDDKVSGLQLLKDGQWVDVPPMRHSIVVNIGDQLEVITNGKYKSVMHRVIAQTDGTGRMSLASFYNPGSDAVIYPAPALVEKAENNELYPKFVFEDYMKLYAGLKFQAKEPRFEAFKNMDKAANLGPIATA

SEQ ID NO: 19436 - protein, 263 aa, Hymenophyllum paniense
MSVRNRFEDKRKLGGLIGAFLEKATKGYVSSEREKDRHITIDTNKGLWTRCDNCGNMLYVRFLKQNKSVCEECGYHPPMTSTERIELLIDRDTRIPMDEDMTAQDVLSFSDEDSHQNRIITSQKRTGLTDAVQTGIGYLNGTPLALGVMDFQFMGGSMGSVVGEKITRLIEYATDKSLPIIIVCASGGARMQEGTLSLMQMAKISSVLQIHQIQRSLLYISVLTYPTTGGVTASFGMLGDIIIAESKAYIAFAGKRVIEQTLR

SEQ ID NO: 19437 - protein, 475 aa, Hymenophyllum polyanthos
MSPQTETKTGIGFKAGVKDYRLTYYTPDYETKDTDILAAFRMTPQPGVPAEEAGAAVAAESSTGTWTTVWTDGLTSLDRYKGRCYDIEPVAGEENQYIAYVAYPLDLFEEGSVTNMLTSIVGNVFGFKALRALRLEDLRIPPAYSKTFLGPPHGIQVERDKLNKYGRPLLGCTIKPKLGLSAKNYGRAVYECLRGGLDFTKDDENVNSQPFMRWRDRFVFVAEALFKAQAETGEIKGHYLNATAATCEEMLKRAIFARELGVPIVMHDYLTGGFTANTSLAFYCRDNGLLLHIHRAMHAVIDRQKNHGMHFRVLAKALRMSGGDHIHGGTVVGKLEGEREVTLGFVDLLRDDYIEKDRSRGIYFTQDWVSMPGVFPVASGGIHVWHMPALTEIFGDDSVLQFGGGTLGHPWGNAPGAVANRVALEACVQARNEGRDLAREGNQIIREASKWSPELAAACEVWKEIKFEFETIDTV

SEQ ID NO: 19438 - protein, 475 aa, Hymenophyllum wrightii
MSPQTETKTGIGFKAGVKDYRLTYYTPDYETKDTDILAAFRMTPQPGVPAEEAGAAVAAESSTGTWTTVWTDGLTSLDRYKGRCYDIEPVAGEENQYIAYVAYPLDLFEEGSVTNMLTSIVGNVFGFKALRALRLEDLRIPPAYSKTFLGPPHGIQVERDKLNKYGRPLLGCTIKPKLGLSAKNYGRAVYECLRGGLDFTKDYENVNSQPFMRWRDRFVFVAEALFKAQAETGEIKGHYLNATAATCEEMLKRARFARELGVPIVMHDYLTGGFTANTSLAFYCRDNGLLLHIHRAMHAVIDRQKNHGMHFRVLAKALRMSGGDHVHAGTVVGKLEGEREVTLGFVDLLRDDYIEKDRSRGIYFTQDWVSMPGVFPVASGGIHVWHMPALTEIFGDDSVLQFGGGTLGHPWGNAPGAVANRVALEACVQARNEGRDLAREGNQIVREACKWSPELAAACEVWKAIKFEFETIDTL

SEQ ID NO: 19439 - protein, 475 aa, Hymenophyllum scabrum
MSPQTETKTGIGFKAGVKDYRLTYYTPDYETKDTDILAAFRMTPQPGVPAEEAGAAVAAESSTGTWTTVWTDGLTSLDRYKGRCYDIEPVAGEENQYIAYVAYPLDLFEEGSVTNLFTSIVGNVFGFKALRALRLEDLRIPPAYSKTFLGPPHGIQVERDKLNKYGRPLLGCTIKPKLGLSAKNYGRAVYECLRGGLDFTKDDENVNSQPFMRWRDRFLFVAEALFKAQAETGEIKGHYLNATAGTCEEMLKRAIFARELGAPIVMHDYLTGGFTANTSLAFYCRDNGLLLHIHRAMHAVIDRQKNHGMHFRVLAKALRMSGGDHIHAGTVVGKLEGEREVTLGFVDLLRDDYIEKDRSRGIYFTQDWVSMPGVFPVASGGIHVWHMPALTEIFGDDSVLQFGGGTLGHPWGNAPGAVANRVASEACVQARNEGRDLAREGNEIIREACKWSPELAAACEVWKAIKFEFETIDTL

SEQ ID NO: 19440 - protein, 475 aa, Hymenophyllum flabellatum
MSPQTETKTGIGFKAGVKDYRLTYYTPDYETKDTDILAAFRMTPQPGVPAEEAGAAVAAESSTGTWTTVWTDGLTSLDRYKGRCYDIEPVAGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEALFKAQAETGEIKGHYLNATAGTCEEMLKRAIFARELGAPIVMHDYLTGGFTANTSLAFYCRDNGLLLHIHRAMHAVIDRQKNHGMHFRVLAKALRMSGGDHVHAGTVVGKLEGEREVTLGFVDLLRDDYIEKDRSRGIYFTQDWVSMPGVFPVASGGIHVWHMPALTEIFGDDSVLQFGGGTLGHPWGNAPGAVANRVALEACVQGRNEGRDLAREGNEIIREACKWSPELAAACEVWKAIKFEFETIDTL

SEQ ID NO: 19441 - protein, 263 aa, Hymenophyllum flabellatum
MSVRNRFEDKRKLGGLIGAFLEKATKGYVSSEREKDRHITIDTNKGLWTRCDNCGNMLYVRFLKQNKSVCEECGYHPPMTSTERIELLIDRDTWIPMDEDMTAQDVLSFSDEDSHQNRIITSQKRTGLTDAVQTGIGYLNGTPLALGVMDFQFMGGSMGSVVGEKITRLIEYATDKSLPIIIVCASGGARMQEGTLSLMQMAKISSVLQIHQVQKSLLYISVLTYPTTGGVTASFGMLGDIIIAESKAYIAFAGKRVIEQTLR

SEQ ID NO: 19442 - protein, 263 aa, Hymenophyllum deplanchei
MSVRNRFEDKRKLGGLIGAFLEKATKGYVSSEREKDRHITIDTNKGLWTRCDNCGNMLYVRFLKQNKSVCEECGYHPPMTSTERIELLIDRDTWIPMDEDMTAQDVLSFSDEDSHQNRIITYQKRTGLTDAVQTGIGYLNGTPLALGVMDFQFMGGSMGSVVGEKITRLIEYATDKSLPIIIVCASGGARMQEGTLSLMQMAKISSVLQIHQVQRSLLYISVLTYPTTGGVTASFGMLGDIIIAESKAYIAFAGKRVIEQTLR

SEQ ID NO: 19443 - protein, 263 aa, Hymenophyllum fuscum
MSVRNWFEDKRKLGGLIGAFLEKATKGYVSSEREKDRHITIDTNKGLWTRCDNCGNMLYVRFLKQNKSVCEECGYHPPMTSTERIELLIDRDTRIPMDEDMTAQDVLSFSDEDSHQNRIITSQKRTGLTDAVQTGIGYLNGTPLALGVMDFQFMGGSMGSVVGEKITRLIEYATDKSLPIIIVCASGGARMQEGTLSLMQMAKISSVLQIHQVQRSLLYISVLTYPTTGGVTASFGMLGDIIIAESKAYIAFAGKRVIEQTLR

SEQ ID NO: 19444 - protein, 263 aa, Hymenophyllum rolandi-principis
MSVRNRFEDKRKLGGLIGAFLEKATKGYVSSEREKDRHITIDTNKGLWTRCDNCGNMLYVRFLKQNKSVCEECGYHPPMTSTERIELLIDRDTRIPMDEDMTAQDVLSFSDEDSHQNRIITSQKRTGLTDAVQTGIGYLNGTPLALGVMDFQFMGGSMGSVVGEKITRLIEYATDKSLPIIIVCASGGARMQEGTLSLMQMAKISSVLQIHQVQRSLLYISVLTYPTTGGVTASFGMLGDIIIAESKAYIAFAGKRVIEQTLR

SEQ ID NO: 19445 - protein, 475 aa, Sphaerocionium pilosissimum
MSPQTETKTGIGFKAGVKDYRLTYYTPDYETKDTDILAAFRMTPQPGVPAEEAGAAVAAESSTGTWTTVWTDGLTSLDRYKGRCYDIEPVAGEENQYIAYVAYPLDLFEEGSVTNLFTSIVGNVFGFKALRALRLEDLRIPPSYSKTFLGPPHGIQVERDKLNKYGRPLLGCTIKPKLGLSAKNYGRAVYECLRGGLDFTKDDENVNSQPFMRWRDRFVFVAEALFKAQAETGEIKGHYLNATAGTCEEMLKRAVFARELGAPIVMHDYLTGGFTANTSLAFYCRDNGLLLHIHRAMHAVIDRQKNHGMHFRVLAKALRMSGGDHVHAGTVVGKLEGEREVTLGFVDLLRDDYIEKDRSRGIYFTQDWVSMPGVFPVASGGIHVWHMPALTEIFGDDSVLQFGGGTLGHPWGNAPGAVANRVALEACVQARNEGRDLAREGNQIIREAAKWSPELAAACEVWKAIKFEFETIDTL

SEQ ID NO: 19446 - protein, 263 aa, Sphaerocionium pilosissimum
MSVRNRFEDKRKLGGLIGAFLEKATKGYVSSEREKDRHITIDTNKGLWTRCDNCGNMLYVRFLKQNKSVCEECGYHPPMTSTERIELLIDRDTRIPMDEDMTAQDVLSFSDEDSHQNRIITSQKRTGLTDAVQTGIGYLNGTPLALGVMDFQFMGGSMGSVVGEKITRLIEYATDKSLPIIIVCASGGARMQEGTLSLMQMAKISSVLQIHQVQRNLLYISVLTYPTTGGVTASFGMLGDIIIAESKAYIAFAGKRVIEQTLR

SEQ ID NO: 19447 - protein, 475 aa, Hymenophyllum subobtusum
MSPQTETKTGIGFKAGVKDYRLTYYTPDYETKDTDILAAFRMTPQPGVPAEEAGAAVAAESSTGTWTTVWTDGLTSLDRYKGRCYDIEPVAGEENQYIAYVAYPLDLFEEGSVTNLFTSIVGNVFGFKALRALRLEDLRIPPAYSKTFLGPPHGIQVERDKLNKYGRPLLGCTIKPKLGLSAKNYGRAVYECLRGGLDFTKDDENVNSQPFMRWRDRFVFVAEALFKAQAETGEIKGHYLNATAGTCEEMLKRAIFARELGVPIVMHDYLTGGFTANTSLAFYCRDNGLLLHIHRAMHAVIDRQKNHGMHFRVLAKALRMSGGDHVHAGTVVGKLEGEREVTLGFVDLLRDDYIEKDRSRGIYFTQDWVSMPGVFPVASGGIHVWHMPALTEIFGDDSVLQFGGGTLGHPWGNAPGAVANRVALEACVQARNEGRDLAREGNQIIRESCKWSPELAAACEVWKAIKFEFETIDTL

SEQ ID NO: 19448 - protein, 263 aa, Hymenophyllum microcarpum
MSVRNRFEDKRKLGGLIGAFLEKATKGYVSSEREKDRHITIDTNKGLWTRCDNCGNMLYVRFLKQNKSVCEECGYHPPMTSTERIELLIDRDTWIPMDEDMTAQDVLSFSDEDSHQNRIITSQKRTGLTDAVQTGIGYLNGTLLALGVMDFQFMGGSMGSVVGEKITRLIEYATDKSLPIIIVCASGGARMQEGTLSLMQMAKISSVLQIHQVQRSLLYISVLTYPTTGGVTASFGMLGDIIIAESKAYIAFAGKRVIEQTLR

SEQ ID NO: 19449 - protein, 475 aa, Cardiomanes reniforme
MSPQTETKTGIGFKAGVKDYRLTYYTPDYETKDTDILAAFRMTPQPGVPAEEAGAAVAAESSTGTWTTVWTDGLTSLDRYKGRCYDIEPVAGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFVAEALFKAQAETGEIKGHYLNATAGTCEEMLKRAVFARELGVPIVMHDYLTGGFTANTSLAFYCRDNGLLLHIHRAMHAVIDRQKNHGMHFRVLAKALRMSGGDHVHAGTVVGKLEGEREVTLGFVDLLRDDYIEKDRSRGIYFTQDWVSMPGVLPVASGGIHVWHMPALTEIFGDDSVLQFGGGTLGHPWGNAPGAVANRVASEACVQARNEGRDLAREGNEIIREACKWSPELAAACEVWKAIKFEFETIDTL

SEQ ID NO: 19450 - protein, 263 aa, Cardiomanes reniforme
MSVRNRFEDKRKLGGLIGAFLEKATKGYVSSEREKDRHITIDTNKGLWTRCDNCGNMLYVRFLKQNKSVCEECGYHPPMTSTERIELLIDRDTWIPMDEDMTAQDVLSFSDEDSHQNRIITSQKRTGLTDAVQTGIGYLNGTPLALGVMDFQFMGGSMGSVVGEKITRLIEYATDKSLPIIIVCASGGARMQEGTLSLMQMAKISSVLQIHQVQRSLLYISVLTYPTTGGVTASFGMLGDIIIAESKAYIAFAGKRVIEQTLR

SEQ ID NO: 19451 - protein, 263 aa, Crepidomanes latealatum
MSVRNRFEDKRKLGGLIEAFLEKATKGYVSSEREKDRHIAIDINKGLWTRCDNCGNMLYVRFLKQNKSVCEECGYHLPMTSTERIELLIDRDTRIPMDEDMTAQDVLSFSDEDSHQNRIITSQRRTGLTDAIQTGIGYLNGTPIALGVMDFQFMGGSMGSVVGEKITRLIEHATDKSLPIIIVCASGGARMQEGTLSLMQMAKISSVLQIHQVQRNLLYISVLTYPTTGGVTASFGMLGDIIIAESKAYIAFAGKRVIEQTLR

SEQ ID NO: 19452 - protein, 263 aa, Trichomanes diaphanum
MSVRNRFEDKRKLGGLIEAFLEKATKGYVSSEREKDRHITIDINKGLWTRCDNCGNMLYIRFLKQNKSVCEECGYHLPMTSTERIELLIDRETRIPMDEDMTAQDVPSFSDEDSHQNRIMTSQKRTGLTDAVQTGTGYINGTPIALGVMDFQFMGGSMGSVVGEKITRLIEHATNKSLPIILVCASGGARMQEGTLSLMQMAKISSVLQIHQVQRSLLYISVLTYPTTGGVTASFGMLGDIIIAESKAYIAFAGKRVIEQTLR

SEQ ID NO: 19453 - protein, 263 aa, Crepidomanes birmanicum
MSVRNRFEDKRKLGGLIEAFLEKATKGYISSEREKDRHIAIDINKGLWTRCDNCGNMLYVRFLKQNKSVCEECGYHLPMTSTERIELLIDRDTWIPMDEDMTAQDVLSFSDEDSYQNRIITSQKRTGLTDAVQTGIGYLNGTPIALGVMDFQFMGGSMGSVVGEKITRLIEHATDKSLPIIIVCASGGARMQEGTLSLMQMAKISSVLQIHQVQRSLLYISVLTYPTTGGVTASFGMLGDIIIAESKAYIAFAGKRVIEQTLR

SEQ ID NO: 19454 - protein, 263 aa, Cephalomanes thysanostomum
MSVRNWFEDKRKLGGLIEAFLEKATKGYVSSEREKDRHITIDINKGLWTRCDNCGNMLYVRFLKQNKSVCEECGYHLPMTSTERIELLIDRDTRIPMDEDMTAQDVSSFSDEDSHQNRIITSQRRTGLTDAVQTGIGYLNGTLIALGVMDFQFMGGSMGSVVGEKITRLIEYATDKSLPIIIVCASGGARMQEGTLSLMQMAKISSVLQIHQVQRNLLYISILTYPTTGGVTASFGMLGDIIIAESKAYIAFAGKRVIEQTLR

SEQ ID NO: 19455 - protein, 478 aa, Trichomanes elegans
MSPQTETKTGIGFKAGVKDYRLTYYTPDYRTKDTDILAAFRMTPQPGVPPEEAGAAVAAESSTGTWTTVWTDGLTTLDRYKGRCYDLEPVRGEDNQYIAYVAYPLDLFEEGSVTNLFTSIVGNVFGFKALRALRLEDIRVPPAYSKTFIGPPHGIQVERDKLNKYGRPFLGCTIKPKLGLSAKNYGRAVYECLRGGLDFTKDDENVNSQPFMRWRDRFVFVAEALNKAQSETGEIKGHYLNATAGTCEEMLKRARFARELGAPIVMHDYLTGGFTANTSLAYYCRDNGLLLHIHRAMHAVIDRQKNHGMHFRVLAKALRMSGGDHVHSGTVVGKLEGERDITEGFVDLLRDDFIEKDRSRGIYFTQDWVSMPGVLPVASGGIHVWHMPALTDIFGDDSVLQFGGGTLGHPWGNAPGAVANRVASEACVQARNEGRDLAREGNDIIREASKWSPELAAACEVWKEIKFEFQAVDTIDPL

SEQ ID NO: 19456 - protein, 1484 aa, Magnaporthe grisea
MDQKANDVASLEEGNKAPSTANTAVGSLPRSADPSINLEELRVAAHQKNPNGTSNVGSGISVARAEADFAELQRELTGMSRASRRKSHASQRDAEKANGEDLGETSSSESEPFDLESWIRGGIQAEREAGIRPKHIGVYWDELTVKGMSAFTNYVETFPDAVIRFFDYYTPIKNKLGLGGKAPEATLLDSFRGVCKPGEMVLVLGKPGSGCTTFLKNITNQRYGYTGVEGDVLYGPFTAKEFEKYRGEAVYNQEDDIHHATLTVEQTLGFALDCKVPGKLPAGITKAQFKKDVITMLLKMFNIEHTRNTVVGGSLVRGVSGGERKRVSVAEMMITSGSILAWDNSTRGLDASTALDFIKSLRIQTNLYKTATFVSLYQASENIYKLFDKVLVIDAGRQVYFGPATEARGYFEGLGFLPRPRQTTPDYVTGCTDEYERAYSEGYSPDNAPHSPETLAEAFKKSDFAKRLDNEMVEYRESLKEDQQKYEDFKIAVKEGKRTGAKKSVYTVGFHRQVWALMKRQTVLKLQDRMALFLAWMRTILIAIVVGTLYINLGQTSATSFSKGGLMFISLLFNAFEAFAELGSTMLGRGIVNKHKAYAFHRPSALWIGQIFVDQAFGVPRVLAFSIIVYFMTNLFRSAGAFFMFFLFIMLGNIAMTLFFRIIGCISIDFDYAVKFAVVTITLLITTSGYIIQYQSQQVWLRWIFWINPLGLMFSSMMGNEFSRIDMTCTAESLIPSGPGYNNPENQVCTLPGSKPGSLEVSGSDYIRTGFAYDPNDIWRNFGIVMGLVAFFLIMNVVLGEVIEFGMGGNSALVYQKPNKERKELNEKLVAKREAQRSSKSEAQGSDLKIESKRVLTWENLTYDVPVPGGNRRLLNNVFGYVKPGQLTALMGASGAGKTTLLDVLASRKNIGVIGGDILVDGKKPGKEFQRSTSYAEQLDVHEPTQTVREALRFSADLRQPFDTPQEEKYAFVEEMITLLELEDLADSIIGWPEFGLTVEQRKRVTIGVELAAKPELLLFLDEPTSGLDSQSAFNIVRFLKKLANAGQAILCTIHQPNSALFENFDRLLLLQRGGRCVYFGDIGKDANVLRDYLKRHGAEASPTDNVAEYMLEAVGAGSAPRVGDRDWADIWEESPEHANVKDTISQLKEERKAEVANDSNSALEKEYASPISHQLKVTSHRTNLALWRSPNYLFTRLFNHVVIAIVTGLTYLQLDNSRSSLQYKVFIMFQVTVLPALILSQVEAMYHVKRGIFFRESSSKMYNTSAFAASMLLAELPYVVLCAVAFFLPLYYMPGFTYDSSRAGYQFLMILITEFFSITLAQALSSITPSTFISSQLDPFLMITFSLFCGVTIPFPQMPDGYKWLYQLDPFTRLIGGMVTTALHDLDVKCASIELNKFTPANGSTCEEYMRPFFNAGGNGYIVDPSSTAQCDYCAYSSGDQFYTPLGMTFDNRWRDLGIYLAFCASNIVIIFVANRFLNFNKR

SEQ ID NO: 19457 - protein, 368 aa, Galactomyces geotrichum
MLFSKSAIFAMAAIAVAAPTEGDLQARGGACVFRDAHSAIAGKKSCSSITLENIAVPAGQTLDLTGLAKGTVVTFAGTTTFGYKEWEGPLISVSGDSITVNQASGGKIDCGGSRWWDGKGSNSGGKTKPKFFAAHKLQNSNIQGLQVYNTPVQAFSILSDHLTLSNILIDNRAGDKPNGGHNTDAFDVGSSTFITIDHATVYNQDDCLAINSGDHIIFQNGFCSGGHGLSIGSVGGRSDNSVTNVQIINNQVVNSDNGVRIKSVSGTTGNISGVKFQDITLSNIAKYGIDVQQDYRNGGPTGNPTNGVKITGIEFINVHGTVKSSGTNAYILCGSGSCSNWTWSQINVKGGKDSGACKNVPAGATCRL

SEQ ID NO: 19458 - protein, 368 aa, Galactomyces geotrichum
MLFSNSAILAMATMVMAAPTEGDLHARGGACVFKDAQSAIAGKASCSSITLENIAVPAGQTLDLTGLAKGTVVTFAGTTTFGYKEWEGPLISVSGDSITVNQASGGKIDCGGSRWWDGKGSNPGGKTKPKFFAAHKLQNSNIQGLQVYNTPVQAFSILSDHLTLSNILVDNRAGDVANGGHNTDAFDIGSSTYITIDHATVYNQDDCLAINSGDHIIFQNGFCSGGHGLSIGSVGGRSDNSVTNVQIINNQVVNSDNGVRIKSVSGTTGTISGVKFQDITLSNIAKYGIDVQQDYRNGGPTGIPTNGVQITGIEFINIHGSVKSSGTNAYILCGSGSCSNWTWSQINVKGGKDSGDCKNVPAGATCNI

SEQ ID NO: 19459 - protein, 322 aa, Fragaria x ananassa
MAAAPSESIPSVNKAWVYSEYGKTSDVLKFDPSVAVPEVKEDQVLIKVVAASLNPVDFKRALGYFKDTDSPLPTVPGYDVAGVVVKVGSQVTKFKVGDEVYGDLNEAALVNPTRFGSLAEYTAADERVLAHKPKDLSFIEAASLPLAIETAYEGLERAELSAGKSILVLGGAGGVGTHIIQLAKHVFGASKVAATASTKKLDFLRTLGVDLAIDYTKENIEDLPEKFDVVYDAVGETDKAVKAVKEGGKVVTIVGPATPPAIHFVLTSKGSVLEKLKPYLESGKVKPVLDPTSPYPFTKLVEAFGYLESSRATGKVVVYPIP

SEQ ID NO: 19460 - protein, 213 aa, Oryza sativa
MGAGALGVVAMVAAAVVVAMAGANSEGDALSALRRSLRDPGGVLQSWDPTLVNPCTWFHVTCDRDNRVTRLDLGNLNLSGHLVPELGKLDHLQYLELYKNNIQGTIPSELGNLKNLISLDLYKNNISGTIPPTLGKLTSLVFLRLNGNRLTGPIPRELAGISSLKVVDVSSNDLCGTIPTSGPFEHIPLSNFEKNPRLEGPELQGLAVYDTNC

SEQ ID NO: 19461 - protein, 261 aa, Persea americana
QVHPNSYALVVSTENMTLNWYSGNNRAMLVTNCLFRMGGAAILLSNRWSDRRRSKYQLVHTVRTHIGADDRAFNCVSQEEDEAGKVGVSLSKDLMVIAGEALKSNITTLGPMVLPMSEQLLFFATLAARKVFKMKIKPYIPDFKLAFEHFCIHAGGRAVLDELQKNLELSDWQMEPSRMTLYRFGNTSSSSLWYELGYSEAKGRVMKGDRMWQIAFGSGFKCNSAVWRALRSVNPAKEKSPWMDDIDSFPVHVPKVTTIQS

SEQ ID NO: 19462 - protein, 262 aa, Streptomyces vinaceus
VVDHRQSPVIQQAIEANGGELDWVRTPDDATTHLQDRLARVRELERDLPHAVWPNQYENDANWRIHETWTAPEFDAQVTHRAQALFAGVSTGGTLAGLSRHFRRTRPGLRIVAVDVRGSTVFGGVPRPRTLTGIGAGRRSAFLTRASTDDVLLVDERQAVACCHTLRADTGTAVGGSSGAVLAGCLEYLYRHPEVRHALCLCPDLGDHYGPTVYHPAWLDRMGLPSEAHRLRHRTGAACPGFEPVDDITPAPSAPSEEDASR

SEQ ID NO: 19463 - protein, 44 aa, Pinus koraiensis
MPRSQRNDNFIDKTFTIIADILLRIIPMAPGEKEAFTYYRDGVI

SEQ ID NO: 19464 - protein, 499 aa, Candida tropicalis
MAISSLLSWDVICVVFICVCVYFGYEYCYTKYLMHKHGAREIENVINDGFFGFRLPLLLMRASNEGRLIEFSVKRFESAPHPQNKTLVNRALSVPVILTKDPVNIKAMLSTQFDDFSLGLRLHQFAPLLGKGIFTLDGPEWKQSRSMLRPQFAKDRVSHISDLEPHFVLLRKHIDGHNGDYFDIQELYFRFSMDVATGFLFGESVGSLKDEDARFSEAFNESQKYLATRATLHELYFLCDGFRFRQYNKVVRKFCSQCVHKALDVAPEDTSEYVFLRELVKHTRDPVVLQDQALNVLLAGRDTTASLLSFATFELARNDHMWRKLREEVISTMGPSSDEITVAGLKSCRYLKAILNETLRLYPSVPRNARFATRNTTLPRGGGPDGSFPILIRKGQPVGYFICATHLNEKVYGNDSHVFRPERWAALEGKSLGWSYLPFNGGPRSCLGQQFAILEASYVLARLTQCYTTIQLRTTEYPPKKLVHLTMSLLNGVYIRTRT

SEQ ID NO: 19465 - protein, 512 aa, Candida tropicalis
MLDQILHYWYIVLPLLAIINQIVAHVRTNYLMKKLGAKPFTHVQRDGWLGFKFGREFLKAKSAGRSVDLIISRFHDNEDTFSSYAFGNHVVFTRDPENIKALLATQFGDFSLGSRVKFFKPLLGYGIFTLDAEGWKHSRAMLRPQFAREQVAHVTSLEPHFQLLKKHILKHKGEYFDIQELFFRFTVDSATEFLFGESVHSLKDEEIGYDTKDMSEERRRFADAFNKSQVYVATRVALQNLYWLVNNKEFKECNDIVHKFTNYYVQKALDATPEELEKQGGYVFLYELVKQTRDPKVLRDQSLNILLAGRDTTAGLLSFAVFELARNPHIWAKLREEIEQQFGLGEDSRVEEITFESLKRCEYLKAVLNETLRLHPSVPRNARFAIKDTTLPRGGGPNGKDPILIRKDEVVQYSISATQTNPAYYGADAADFRPERWFEPSTRNLGWAFLPFNGGPRICLGQQFALTEAGYVLVRLVQEFPNLSQDPETKYPPPRLAHLTMCLFDGAHVKMS

SEQ ID NO: 19466 - protein, 512 aa, Candida tropicalis
MLDQIFHYWYIVLPLLVIIKQIVAHARTNYLMKKLGAKPFTHVQLDGWFGFKFGREFLKAKSAGRQVDLIISRFHDNEDTFSSYAFGNHVVFTRDPENIKALLATQFGDFSLGSRVKFFKPLLGYGIFTLDGEGWKHSRAMLRPQFAREQVAHVTSLEPHFQLLKKHILKHKGEYFDIQELFFRFTVDSATEFLFGESVHSLRDEEIGYDTKDMAEERRKFADAFNKSQVYLSTRVALQTLYWLVNNKEFKECNDIVHKFTNYYVQKALDATPEELEKQGGYVFLYELAKQTKDPNVLRDQSLNILLAGRDTTAGLLSFAVFELARNPHIWAKLREEIESHFGSGEDSRVEEITFESLKRCEYLKAVLNETLRLHPSVPRNARFAIKDTTLPRGGGPNGKDPILIRKNEVVQYSISATQTNPAYYGADAADFRPERWFEPSTRNLGWAYLPFNGGPRICLGQQFALTEAGYVLVRLVQEFPSLSQDPETEYPPPRLAHLTMCLFDGAYVKMQ

SEQ ID NO: 19467 - protein, 379 aa, Petunia x hybrida
MSSTVGQVIRCKAAVAWQPGKPLVIEEVEVAPPQKMEVRLKILYTSLCHTDVYFWEAKGQNPVFPRILGHEAAGIVESVGEGVTELVPGDHVLPVFTGECKDCAHCKSEESNMCSLLRINTDRGVMIHDGQSRFSINGKPIFHFVGTSTFSEYTVVHVGCLAKINPLAPLDKVCVLSCGISTGLGATLVAKPTKGSSVAIFGLGAVGLAAAEGARIAGASRIIDVDLNASRFEEAKKFGVTEFVNPKDYSKPVQEVIAEMTDGGVDRSVECTGHIDAMISAFECVHDGWGVAVLVGVPHKEAVFKTHPMNLLNERTLKGTFFGNYKPRSDLPSVVEKYMNKELELEKFITHKLPFAQINKAFDLMLKGEGLRCIINMED

SEQ ID NO: 19468 - protein, 374 aa, Petunia x hybrida
QVIRCKAAVAWEAGKPLVIEEVEVSLLQKMEVRLKILYTSLCHTDIYFWEAKGQNPVFPRILGHEAAGIVESVGEGVTELVPGDHVLPVFTGECKNCAHCKSEESNMCSLLRINTDRGVMIHDDQSRFSINGKPIYHFVGTSTFSEYTVVHVGCVAKINPLAPLDKVCVLSCGISTGLGATLNVVKPTKGSSVAVFGLGAVGLAAAEGARIAGASRIIGVDLNASRFELAKKFGVTEFVNPKDYNKPVQEVIAEMTDGGVDRSVECTGHIDAMISAFECVHDGWGVAVLVGVPHKEAVFKTHPMNLLNERTLKGTFFGNYKPRSDLPSVVEKYMNKELELEKFITHQLPFSDINKAFDLMLKGEGLRCIIHMEH

SEQ ID NO: 19469 - protein, 498 aa, Mesembryanthemum crystallinum
MTLDSIPGSSGYLDSYPERRITYFGNKFVLALTVTAGIGGLLFGYDTGVISGALLYIKDEFPAVKNSSFLQETIVSMALVGAMIGSATAGWINDVYGRKKATLLADFIFAIGAVVMAAAPDPYILIVGRFLVGLGVGLASVCAPVYIAEASPTEVRGGLVSTNVLMITFGQFVSYCVNLAFTEVPGTWRWMLGVSGVPAVLQFGFMLLLPESPRWLYLKHEKSKAAAVLAKIYDPFRLEDELDLLAAAEEEEKNKPAVHISDVFTKRELRYAFIAGGGLLAFQQLAGINTVMYYSPTIVQMAGFSSNQLALLISLIVAAMNAVGTVLGIYLIDHMGRRKLALTSLSGVFVALVMLTISFMLRSSGPTSALYSWLAVLGLALYIAFFAPGMGPVPWAINSEIYPQAYRGLCGGMGATICWIVNLFVSETFLSIADAIGTGPTFLIIAGIVIVAFVFVVCFVPETKALTFEEVDQMFMDRAYGTEENTQSLLESSNRSGN

SEQ ID NO: 19470 - protein, 485 aa, Senecio mikanioides
MSPQTETKASVGFKAGVKDYKLTYYTPDYETKDTDILAAFRVTPQPGVPPEEAGAAVAAESSTGTWTTVWTDGLTSLDRYKGRCYGIEPVLGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIRELPKWSPELAAACEVWKEIKFEFQAMDTLDDDKDKDKKR

SEQ ID NO: 19471 - protein, 314 aa, Oryza sativa
GTSMSLLDGAERPAAMGLLRDACESWGFFEILNHGISTELMDEVEKMTKDHYKRVREQRFLEFASKTLKEGCDDVNKAEKLDWESTFFVRHLPESNIADIPDLDDDYRRLMKRFAAELETLAERLLDLLCENLGLEKGYLTKAFRGPAGAPTFGTKVSSYPPCPRPDLVKGLRAHTDRGGIILLFQDDRVGGLQLLKDGEWVDVPPMRHSIVVNLGDQLEVITNGRYKSVMHRVVAQIDGNRMSIASFYNPGSDAVISPAPALVKEEEAGETYPKFVFEDYMKLYVRHKFEAKEPRFEAFKAMENETPNRIAIA

SEQ ID NO: 19472 - protein, 321 aa, Oryza sativa
MASVASFPVINMENLETEERGARMEVIRDACENWGFFEMLNHGIAHELMDEVERVSKAHYANCREEKFKEFARRMLEAGEKGADVKGIDWESTFFVRHRPVSNLADLPDVDDHYRQVMKQFASEIEKLSERVLDLLCENLGLEKGYLKKAFAGSNGPTFGTKVSSYPPCPRPDLVDGLRAHTDAGGIILLFQDDQVSGLQLLKDGEWVDVPPMRHAIVANIGDQLEVITNGRYKSVMHRVLTRPDGNRMSIASFYNPGADAVIFPAPALAGADAAAAAYPRFVFEDYMNLYVRHKFEAKEPRFEAMKSAAEVVHAAPIATA

SEQ ID NO: 19473 - protein, 485 aa, Tagetes erecta
MSPQTETKASVGFKAGVKDYKLTYYTPEYETKDTDILAAFRVTPQPGVPPEEAGAAVAAESSTGTWTTVWTDGLTSLDRYKGRCYGIEPVPGEDNQFIAYVAYPLDLFEEGSVTNMFTSIVGNVFGFKALRALRLEDLRIPTAYVKTFEGPPHGIQVERDKLNKYGRPLLGCTIKPKLGLSAKNYGRACYECLRGGLDFTKDDENVNSQPFMRWRDRFLFCAEAIYKAQAETGEIKGHYLNATAGTCEEMLKRAVFARELGVPIVMHDYLTGGFTANTSLSHYCRDNGLLLHIHRAMHAVIDRQKNHGMHFRVLAKALRMSGGDHIHSGTVVGKLEGEREITLGFVDLLRDDFMETDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLDTDKDKDKKR

SEQ ID NO: 19474 - protein, 298 aa, Cyanidioschyzon merolae strain 10D
MFVTLGVPSRAVSSKAESYAQRLRIVRTARTRLFMSAQSARKFFVGGNWKCNGSKQSVQELCEAFNAGKNIDFNRVEVVVAPPSVYAMLTRSILRPDFGVALQNCWVGKPGAFTGEVAVEMIRDIGLSHVILGHSERRHLPEIRESDDVIGRKTKYAIDKGVHVILCIGELLEEREAGRTREVNERQLSAVRAHLSADDWAKVVIAYEPVWAIGTGKVATAAQAQEAHSEIRSWIRRQVSEACASQMRILYGGSVTPENCLELAAQPDVDGFLVGGASLKPTFLDIVRAYQAKETVSV

SEQ ID NO: 19475 - protein, 271 aa, Thermus thermophilus
MTTLEAFAKARSEGRAALIPYLTAGFPSREGFLQAVEEVLPYADLLEIGLPYSDPLGDGPVIQRASELALRKGMSVQGALELVREVRALTEKPLFLMTYLNPVLAWGPERFFGLFKQAGATGVILPDLPPDEDPGLVRLAQEIGLETVFLLAPTSTDARIATVVRHATGFSYAVSVTGVTGMRERLPEEVKDLVRRIKARTALPVAVGFGVSGKATAAQAAVADGVVVGSALVRALEEGRSLAPLLQEIRQGLQRLEANPGLKESSKKPLS

SEQ ID NO: 19476 - protein, 409 aa, Coxiella burnetii RSA 493
MNGFVVSAVLIGAFLGALFSGHLADYIGRKRLLIIDALIFIVGTAISSMTVSISWLVIGRIIVGIAIGIASYSAPLYISEISPPHRRGALVSLNQLAVTIGIFLSYVVDYYFARHDAWRSMFAAGVIPAALLLLGMIVLPYSPRWIFSRGHEEKALWILRKLRGHGPHAEQELEHIRASLQQQKGDWRTLFSKIIRPTLFIAIGLAVFQQVTGINTVLYYAPTILKMTGFQASQTAILATMGIGAVLVIITIISLPLIDSLGRRPLLFIGVGAMTVSLLVLSWSFKVHGHMDYMRWIAFGSLLVFISGFSISLGPIMWLMFSEIFPLRVRGLGASIGACTNWASNWLVTITFLTLIEYLGPSGTFFIYFIISVITLIFIYTSVPETKGVTLEQIEENLYAGKDMRYLGK

SEQ ID NO: 19477 - protein, 231 aa, Coxiella burnetii RSA 493
MPLRIILLGLPGAGKGTQADFIAKHLDIPKISTGDMLRAAVKAKTPLGLEVKKIMESGGLVSDEIMIALVKERVKLPDCHKGYLLDGFPRTLAQADALNAAAIKIDLVIEIDVPEEEIIERMTGRLIHPASGRTYHRRYNPPKVADKDDVTGEPLIQRADDREETVRHRLAVYRKQTSPLSDYYAQWEKSGDPQAPKYFRISGLGSMEEVRERILQVFEAYDPRDSGNLEH

SEQ ID NO: 19478 - protein, 474 aa, Coxiella burnetii RSA 493
MTKEIKTEVVVLGSGPGGYAAAFRAADLGKKVVLVERYETIGGVCLNVGCIPSKALLHVAKVIDDAKDMSSFGIDFGKAALEIEKIRSWKENVVKKLTGGLKMMAKQRKVEIITGYGKFSSSNELAVENKEKSVTKIKFDQAIIAVGSLPVKLPFIPDDPRIMDSTGALELEDVKGHLLVLGGGIIGLEMATVYHALGTKISVVEMMDQLIPGADADVVKPLHQRIQKRYEEILLKTKVTKIEPKKDGLYVTFEGENAPKEPKKYDRILVAVGRSPNGKLIDAEKAGVKVDDKGYIAVDKQMRTNVSHIYAIGDVVGQPMLAHKATYEGRLAAEVIAGIKHYNDARCIPAVAYTDPEVAWVGLTETQAKEKGIKYEKGVFPWAASGRALSLNRSEGSTKLLFDEKGTVIGGGIVGVNAGDLISEVALAIEMGCDAEDVGLTIHPHPTLSETVMMACEMFEGTITDLIPPKKKDK

SEQ ID NO: 19479 - protein, 263 aa, Coxiella burnetii RSA 493
MKNFKYLLFLLPIAVVTVFFIWYGPIPQDPAYHHFADQRVIAGIPNFFNVTSNIFFLLIGSYGLYFVFKQKTDSQTFLNPAEKIFYICFFAGLVFVGFGSAYYHLAPTNKTLVWDRLGISIAFMSLFSAMIAERINLRAGLWLLFPLIFVGISSVGYWIYSESIGQSDLRFYVAVQFLPLLSMPFILILFPRPYNKSTYIWLALISYTTGAFVEHHDHEIYRQLHETISGHTLKHLLDALSSYFILHYLKSREPSIFQSSRIK

SEQ ID NO: 19480 - protein, 1046 aa, Coxiella burnetii RSA 493
MTDTHLLFFEKAIAQNAIRPSLNKTYRMDETTCVNHLLKTIAFTPRLEAAVSRLAKELVTAVREQESEKGGIEGFMMQYDLSTEEGILLMCLAEALLRVPDKETENLLIRDKLTSAEWNKYVGASESSFVNFATWGLALSGKILKKEKDGQFKNVWRNLVRRSGEPVIRKAVREAMKLMSEHFVLGRTIEEAVKRSQSAIKEGFRHSYDMLGEVARTQEDADRYYDSYHRAISVLGKSHPTKSVHEAPGISVKLSALYPRYDFKKRELAVPFLIERVKELALHAKEQKIGMTIDAEEADRLDISLDIFEALFTDEAFENWQGLGLAVQAYQKRAFYLIDWLIDLAQRQKRRIPVRLVKGAYWDTEIKLAQMEGLSGYPVFTRKVNTDISYIACAQKMLNAQDAIYPQFATHNAYSVAAILNLMDHHYDNYEFEFQQLQGMGKALHHYIVTKLKLPCRVYAPVGYHEDLLPYLVRRLLENGANSSFVNRIADKTVPVDQLIESPVKKIEAFGDIPNPKIPLPKGIFKTRTNSSGIDLSNFAELMPLNEEIHHALEKEWEAAPFLQEIKNGKPVFDPTDNRRQIGVIELANESDVEKAIQAGHSAFPNWDQKGISARATILRKMADLLEKHKAELMAVVVREGGRTLQNALSEVREATDFCRYYAEQAEQHLSDKALPGYTGESNTLRMNGRGIILCISPWNFPIAIFTGQIAAALVTGNAVIAKPSGQTPLTGALVTRLFHEAGVPKEILQLMPGSGKTVGQALIEDTKISGVIFTGSDATARHIQKTLAARPGPIVPFVAETSGINAMIADSTALPEQLVNDVIVSAFDSAGQRCSALRILYIQEDIADDVIKMLKGAMAEIKMGDPLLLSTDVGPVIDANAQKTLQKHQALMQKEAKLIYKVDLPRETDFGTFVAPQAYELPNLGLITEEVFGPILHVIRYKRENLNKVIEEINGLGYGLTFGIQSRIDETVDYIQQRINAGNIYVNRNTVGAVVGVQPFGGSWLSGTGPKAGGPHYLPRFCIESTLTINTTAAGGNASLMAMED

SEQ ID NO: 19481 - protein, 230 aa, Coxiella burnetii RSA 493
MKRLILPFLSVGLLLGTTAHAATPLKTEQDKLSYSMGVMTGKAFRKHDIKIDPQTFSMGLSDAYLGKETQMTEAEMRQTLQQFEKQSLQKMQHKMKQTAQQNAEKSRAFLTANKNKPGVKTLANGLQYKVLQAGQGQSPTLNDEVTVNYEGRLINGTVFDSSYKRGQPATFPLKSVIKGWQEALTRMKPGAIWEIYVPPQLAYGEQGAPGVIGPNEALIFKVNLISVKKK

SEQ ID NO: 19482 - protein, 477 aa, Coxiella burnetii RSA 493
MEECIVPVLLAGGVGSRLWPVSRESYPKQFCKLFDEFSLLQKTAERAKYISKDADLIVVTNYSYYFLCKDQLEAIGIYNVHYILEPCSRNTAPAIALAAQYACEYIHPDSVLLVLPSDHQLNDHAYFKSTVRAAMNFVERNKLVVFGIEPQSPKTGYGYIEKGDAVDEGFEVKRFIEKPPLPLAKEFLLQGNFFWNSGLFLFKAKDYLNKLEKLANDIYVQSTKAFQATEPNLEFFRVNKIFDSCRAGSIDYEVMEKTNSAVMLPLRTNWSDLGCWLSVGEVVEGDEAGNVCYGDVMVDKCQNCLISSEGRRVVAIGVKDQVIVSTPDALLVIDKAYSQEVKRAVEQMKLQHDIAATEHPRMYRPWGFYEKLAVGADYQVKYLMVNPGSSLSLQLHRYRSEHWIVVSGEAEVVKGESVFRLHSNQSTFIEKGMKHRLSNPGDEPLLIIEVQSGKYLGEDDIVRFDDAYGRVVESTSL

SEQ ID NO: 19483 - protein, 293 aa, Coxiella burnetii RSA 493
MKCLPPEKAFLGLEPQKAVPYEKAKAVIIPFGLERSVSYGGGTAQGPAAMIEASFEVELFDEALWCEPYCDIGIVTLEEPKIEADMQSALKQLETLVQQVLDDEKFPFVFGGEHSITAGSIRPFVNAYDNLAILHFDAHADLRDGYEGEHYSHASAIRRCLDYPSVEVISVGIRNISAEEIPFFEANRNRIHIYWAKDKKTWDINEIIAPLKNRPIYLTFDLDGFDASLMPATGTPEPGGLFWNDAQEIITAAGQVGTIVGADINELAPIPGFHSCDFLAAKLAYKILSSAFK

SEQ ID NO: 19484 - protein, 268 aa, Coxiella burnetii RSA 493
MTAIEPSEPLIEIHGLCNEFGEQRVHDDLNLTIHRGEIVAIIGPSGCGKTTLLRSILMLRKPTAGTINVFGINILECSRAEALSVQRRWGVMFQSSALFSSLRVLENVLFPLHEYSHLHSEAQTKLALLKIALVGLDREAVPKYPAELSGGMKKRAALARAMALDPELLFLDEPTTGLDAKSARELNELILHLRKTLELTFVMVTHDLDTLWQVPDRVFFLGEGKVLAALPMDGLVHHKHPLIQDYFGSGKRTFRDKLERGVKDGYKS

SEQ ID NO: 19485 - protein, 452 aa, Coxiella burnetii RSA 493
MNTSTPQIIKNVVNLALPMAGSRLIQMLSGFIGMLMLARLGHSILAASMLMTSTQVTIIVIFISLLFSMSVVVGQAYGAKKYDEVGVILQQGCILALILSIPLIILFLVADRILLALGQLPELVIYVKHYFRALIWGTPGFVLLAALQQALYGMSRQRIVILANLFCLGVFVLSAYVLVFGHLGISAQGVTGVPYAFAIQAYLNIIILLFCFYYQKQFKPMGIFKWRSHQRWRYLKQLFQIGWPMCMQFGGELMAFFVISIMIGWLGKNELAAAQVTQQCLFLFVVPMFAVAEATGIMVSHAVGGKQYQSVKRIGEISLIIAMILVSVAALIFLAFPEFLASLYIDVKAPQYTHMIHLIKILFILVAFSITFDTLRNVASGALRGFYDTRFAMWAGLGAMWIISVPGGYLLGVVFHYGVIGFRIASAFAFLIGALLVLWRWRERVKEYSQLP

SEQ ID NO: 19486 - protein, 297 aa, Coxiella burnetii RSA 493
MTTIGFIGLGHMGQPMVNNLIKNNCLVKVYDVIDEAVEKAVKTGATAAASPAEVAEEADVVFTMLQTSDQVRNCCLSAKGIFATINRQAIYIDSSSIDIEGSRELHKEAKKRGISMLDAPVSGGVAAAEAAGLTFMVGGEKEDFERAKRVLGILGKKIIYAGSDGAGAAAKICNNMLLGISMIAVSEAFVLADKLGLDPQKLFEISSNASGECWSLTHYCPWPGILKDVPSSHEYKPGFTAKMMLKDLNLSQAAASDAKANTPLGKRATELYQQFVDSDHGEVDFSAIINLLKDKSQ

SEQ ID NO: 19487 - protein, 498 aa, Coxiella burnetii RSA 493
MKKIYHYINGKFVDAKGETYQEVYNPATGEVSAQVAFGTAEEVEEAVESARNAFASWSSVTPLRRARVIFKFKALLDKNIDKLAELLTSEHGKILEDAKGEVLRAIELTEFSCGTPYLLKGSYSENVGTDVDSYTIRQPLGVCVGITPFNFPVMISAWMFVSAIACGNTFVLKPSEKDPSAALFLAELMQEAGLPAGVLNIINGNGATVDRLITHPKVAAVSAVGSTAAAEHIYQTAIAHGKRAHTFGGAKNHCVITPDADIDEAADAILGAAYGAAGERCMAVSVVVAITDTVGDALVQRLKEKIPQLQIAAGTESRADFGPLVTKEHLEKVKAYIHLGVEEGAELIVDGRDLETLKHKKGFFLGGCLFDHVKPSMRIYQEEIFGPVLCVTRVSNFEEALALINKNEYGNGVAIFTKSGEMARYFASKVSVGMVGINVPIPVPVAYHTFGGWKRSIFGDIHMHGAENVHFYTKQKTVTVRCWPREKTTESAYHMQSH

SEQ ID NO: 19488 - protein, 437 aa, Coxiella burnetii RSA 493
MHSRFQKGKIPNSVLKRDLGLIGATMMGLGSIVGTGIFVSIGVAAGVTGPSVVLAIVLAALVATCNALSSAQLAASHPVSGGTHEYGYRYLHPALGFTAGWMFLCAKIASAATAALGFAGYLLHLLGITSISMIPIAVSIAILLTLLVLSGLKKSNLANLIIVSIILISLITFVLSGLPHLFSMGLPHFKPFFPTAAPSGLRNFLYATALMFVAYTGYARIATLGEEVKNPKRFIPQAIILTLIISAVLYIAVAVVAISIVGADHLSQAAQNRATPLETAARALNRRGLDIILAFGACTAMLGVLLNLMLGLSRMALAMGRKRDLPSMFGTLSKKQRTPSAAILGVGLAIIGLSLIGNVEITWAFSAFTVLIYYFITNLAALQLPKADRLYPRIFPVGGLIACLFLAFWVPLMIWSIGIGLIAVGLAWKYFMARLWI

SEQ ID NO: 19489 - protein, 442 aa, Coxiella burnetii RSA 493
MLENDMQRLDSQHVWHPCSQMKDYEQFKPLIIKKAYGSYIELSNGQKIIDAISSWWCKSLGHNHPKLKEALKQQLEKFEHVIFANTTNEIIVALSQQLAALLPGLNKVFYAGDGSCAVEIAMKMSLHSRIIQGNKKRKKFIALKNSYHGETVGALSVSDVGLYRAPYSTMLFEPYFIESIPYVLNTQAPEWNDCSAHWDTVERLFEPHAETATAILVEPIVQGASGMKIYSQDFLARLFQWAKNNHIHFIADEIMTGIGRTGKMLACEHAGIIPDFVCLSKGLTSGYLPFSAVLTSDEIYQLFYDDYQTGKAFLHSHTYSGNALAAAVALATLKVFSEEKICARAHKLGKFMLEKMTQVAQETGQLENVRGIGALVAADLIPQPGRLRLGYEVYQEAVKQGVLLRPIGNTLYWLPPLNIDFDLIEVLQKVTKNAIKILSLGF

SEQ ID NO: 19490 - protein, 315 aa, Coxiella burnetii RSA 493
MKAIQFDQFGPPKVLKLVDTPTPEYRKNQMLIKVHAASLNPIDYKTRNGSGFVAKKLKNNLPSGLGYDFSGEVIELGSDVNNVNIGDKVMGIAGFPDHPCCYAEYVCASPDTIIQKLEKLSFLQAASLPTAGLTALQALNQAEVKQGDVVLIHAGAGGVGHLAIQLAKQKGTTVITTASKRNHAFLKALGAEQCINYHEEDFLLAISTPVDAVIDLVGGDVGIQSIDCLKETGCIVSVPTITAGRVIEVAKQKHRRAFGLLKQFNIEELHYLGKLVSEDKLRIEISRIFQLSEAVTAHELLETGHVRGKLVFKVR

SEQ ID NO: 19491 - protein, 468 aa, Coxiella burnetii RSA 493
MFHLTGTYTDQYQLAMGQVYFLKGKKNHPAVFDYFFRKLPFGGGYAIFAGLEDLLAILENLRFNEKDIEFLHRQGFHPEFLNYLRDFRFTGTLYASREGDVVFPTRPILSVEAPLIEAQIVETLLLNILNFQTLIATKASRMRQVAEERALVDFGFRRAAGLASYYASRAAVIGGFDATSHVAAGRDYDIPVVGTMAHSFVQSYDDELSAFRDFAEGRPDDCVLLVDTYDTLKSGMPNAIKIAKAMEARGQRLKGVRLDSGDLAYLAKKSRQMLDDAGLSYVKIAASNQLDEYVIKSLLEQKAPIDIFGVGTKLAIGAPDAALDGVYKLAMSNLKPRIKLSESIAKITLPYKKQVYRVIDQKGDFFGADVVALREEEEINIMHHSFELSKSFVIKKNKKEPLLNKVMEKGKRLFEAKKPLEIMKFSQQRLGFLPLEYKRFNNPHIYKIGLSDGLNNKRNQLIEAYKKT

SEQ ID NO: 19492 - protein, 488 aa, Coxiella burnetii RSA 493
MTVLYQNRQIRELERLAVESGISEYELMCRAGEAAFKALLARWPEAQEITVCCGKGNNGGDGLVLARLAYENGLKVTVYLAGQRHQLKGAAAQAANACEASNLPILPFPEPLLFKGEVIVDALLGSGLSGEVKAPYDHLIAAINQAGQYVLALDVPSGINVDSGEVQGTAVKANLTVTFIAPKRGLYTDKAPAYCGELIVDRLGLSESFFRAVFTDTRLLEWKGVFPLLPKRARDAHKGSYGHVLVIGGDYGMGGAVRMAAEAAARVGAGLVTVATRPEHVPIVSGPRPELMCHQVAAADDLKPLLTAATVVVIGPGLGKSDWAKSLLNKVLETDLPKVLDADSLNLLAESPSQREDWILTPHPGEASRLLGISCNEVQRDRFQAINDLQEKYQGVLVLKGVGTLIKDESQAYYVCPAGNPGMATGGMGDILSGIIGGLVAQRLSLASAAQAGVFIHSMAADRAAEEGGERGLLATDLFPHLRVLVNP

SEQ ID NO: 19493 - protein, 313 aa, Coxiella burnetii RSA 493
MEYQDYYKILGVSRDATADEIKKSYRKLARKYHPDVSSEPNAEEKFKQVKEAYEVLKDVEKRKAYDAIGSGWKQGQGFTPPPGWESRPGGEGVRPEFREGFSDFFESLFGGLGQEARWTRQEFKQRGQDQHSRVTVSLEEAFNGSTRLLTLQEPIVDYQTGQVTSKTRQLRIKIPAGVTEGQQIRLQGQGLPGIGGAPNGDLYLEIHLAPHSLFTVEGKDVYLNLPVTPWEAALGAKVSIPTLGGSVDLTLPPGSQTGQKLRLKGRGLPGGTPGDQYVLIKIYIPEPKNDQQKELYQQMAEQMPFDPRKELLG

SEQ ID NO: 19494 - protein, 267 aa, Coxiella burnetii RSA 493
MNRIEQQFKKSPAYVAYLTAGDGGLERSLESLLALAKGGVNILEVGVPFSDPVADGPVIQEASIRALAQGTTLHDVLTLITSFRQHSEIPIILFTYFNPLLAAGDKIYQQMKSAGVDGCLVVDLPVEEAAPHLTACKTAKIAPILLISPSTTQERLKKINEHGEGMLYYVCRPGTTGVRATLPENFPAKMNQIKSMTSLPIVTGFGIANRKMAAQALQYADGFVIGSLFVKAIAEGISKNALTRLAQSLNPHYPNLRLITPFRKKTF

SEQ ID NO: 19495 - protein, 497 aa, Coxiella burnetii RSA 493
MRTSHQNQPSSPFLLPPDVLPLIFYGLTPVDLARLFVVAKGARPWFETFFASDTDYKAYLQLNIPQLFMVIGNNLFFDYSLVWIARAGVWGWGNNYTGQLDFGNIHEMTKPARIPLDSFIPEMAPDDYVVQFASADFLSGKARSLVATRQGQLHEYYWERISNTRSEFIQHRHYELNVTIVQLLSDYRHAFILTEEGGIYGWGFNISGELGLGDRFERSQPTELPQNFFPYLLERGDRIVQLNFADRYLVARTAQGHVYVWGFNYRGRLGLDDEQDRLHPVELSWDFFPEWHPDDYIIQVVVGDRHTLALTQLGYIYAWGKNSYGQLGFRDQQDRNRPALLPWNRFPGLLERNDRIIELIAGGARSLARTEQGFIYIWGARWLLVRGDPEFRHHPMLLTENYFPGLRRRGDHLVELIAGPDHTLARTEQGYIYAWGRNYYGQLGLGDRRIQRQPALLDPNAIPPLSQWRNAFSFIKSFREEKIEDTDSFSYAPFSRK

SEQ ID NO: 19496 - protein, 374 aa, Coxiella burnetii RSA 493
MAKRDYYEVLGVNLNATEAEVKKAFRRLAMKYHPDRNPGDKDAEVKFKEAREAYEVLCDSRKRASYDQFGHAGVEQTFGGAGAGGFGFGDLGDIFGDIFGDIFGGARGGQAREQRGADLAYELVLSLEEAVHGLSRTIKVPTWINCKTCNGSGAKGSSPATCPRCNGSGQMRMQHGFLQVQQTCSVCRGRGQVIKDPCTDCHGQGRQQQTKTLSVKIPPGIDTGDRIRLAGEGEAGLFGAPPGDLYVQVRVKPHPLFHREGNDLHSEVPIDFTTAALGGEMEIPTLDGSVRLTIPPETQGGKQFRLRGKGVKALRSGAVGDLICHIVVETPVKLSPEQKDYLKQFAELLKKDEKNHSPRTRNWFDSVKDFFTSK

SEQ ID NO: 19497 - protein, 489 aa, Coxiella burnetii RSA 493
MRVKEEALTFDDVLLLPNYSEVLPKDVSLTTRLTREITLNIPLLSAAMDTVTEARLAIALAEAGGIGILHKNMSPTYQANEVRKVKKFESGVVFDPITVSPESTIGELKKITSEYNISGLPVVEGEQLIGIITSRDIRFETDMQQKVVNLMTPKDRLITIKEGASRDEIINLFRQHRVEKLLVINDRFELRGLITVKDILRSERNPNACKTKSGQLRVGAAVGTGGETPDRVTALAAGGVDVIVVDTAHGHSKGVIEQVKWIKKNYPHIPVIAGNIATASAARALADAGVDAVKVGMGPGSICITRVVAGIGVPQITAINAVAAELKKEDISIIADGGIRFSGDICKAIAAGAHAVMIGGLFAGTEEAPGEEVLYQGRSYKAYRGMGSAGAMFGKYGSSDRYFQESFDKQEKYVPEGIEGRVPYKGPLRGVVHQLIGGLRSGMGYTGCRTIDEMRTKTKFIRVTNAGVRESHVHDVTVTKESPNYSVEE

SEQ ID NO: 19498 - protein, 451 aa, Coxiella burnetii RSA 493
MTKTKTIFSCQHCGSQYAQWQGQCRDCGEWNSIVEEVTVKKSTHRASGFAGAQSVPILLSNVSMQSQPRLATGLAEFDHVLGGGLVSDSVVLIGGDPGVGKSTLLLQILCQISRNYSTLYISGEESLQQIALRAQRLQLPQDKLTLLAETHIEQILVLAEQSHPQVMVIDSIQTVYTDTVPSAPGGVGQVRESAAQLVRFAKQKGIALFIVGHVTKEGAIAGPRVLEHMVDAVLYFEGKNDSRFRVIRAVKNRFGAVNEIGVFAMTNAGLKQVNNPSAIFLSRYETPVSGSVVTVTWEGSRPLLVEVQALVDESHLANPRRVTVGLEQNRLSMLLATLHRHGGVPTYDQDVFVNAVGGLRIVETGADLPVLLAVLSSLRNKPLPSDLIVFGEVGLAGEIRPVPSGQERIKEAVKHGFKRAIVPKANAPKDAPEGMEIVAADKLQSVLNYNY

SEQ ID NO: 19499 - protein, 255 aa, Coxiella burnetii RSA 493
MQRRPLVAGNWKMHGSRESVGQLLRALKHGCERLETAELAVFPPFVFLQQCEEALMRTQISWGAQDVSEFERGAYTGEVSAAMLRDFHCRYVIVGHSERRQRHGETNEQVAAKVRAALRCGIRPIICVGETEKQRNANQTLSVIKEQLAVVLQMNDNLASLEGMVVAYEPIWAIGTGKNATPSQAEEVHAALRDQLHRQDATLAESTRLLYGGSVKPDNAAALFEMPNIDGALVGGASLEAEQFLKIGQQCNQSF

SEQ ID NO: 19500 - protein, 228 aa, Coxiella burnetii RSA 493
MEKRSGIGRLYQGSFFNRYSRAGGNPGAPSVRCARVRGDDGVLVFTPFGNDRRGTSSTTMKQWVKMMNDIVIDKRGFRLGVGMVIMNRQGELLWGRRVGNPDAWQFPQGGLLPNETLREALNRELDEEVGLSPHDVIYLRETRQWISYRLPKKFRRPEHRGPVCIGQRQKWFLLQFTGKDDAISLDHCSQPEFDQWRWVDYWYPVDHVVEFKRDVYQKVLTEFAEFIR

SEQ ID NO: 19501 - protein, 428 aa, Coxiella burnetii RSA 493
MTATITDINAHEILDSRANPTLEVRVTLSSQAYGCAAVPSGASTGEREAVELRDNDLERYGGKGVLQAVENVNGPIRDALLGQDPRSQEEIDRIMIELDGTENKANLGANAILGVSLAVAYAAANNADLPLYRYLGGDGGPFSMPVPMMNIINGGAHATNNLDFQEFMIVPVGAPTFAEALRYGAEVFHALKKRLVSRGLMSAVGDEGGFAPDLPNNEAAFELILEAIEDANYVPGKDIYLALDAASSELYQNGRYDFENNQLTSEEMIDRLTEWTKKYPVISIEDGLSENDWAGWKLLTERLENKVQLVGDDIFVTNPDILEKGIKKNIANAILVKLNQIGTLTETLATVGLAKSNKYGVIISHRSGETEDTTIADLAVATDARQIKTGSLCRSDRVAKYNRLLQIERELNDQAPYAGKEAFLFNRK

SEQ ID NO: 19502 - protein, 239 aa, Coxiella burnetii RSA 493
MAINVIINGINGKMGRVVKENITAQSDLELVSGTGRQDDLAKTIQTTHADVVIDFTTPQSVFHNAEIIIQSGARPVIGTTGLTLEQIALLDKQCRNKKLGAIVAPNFSVGAVLMMKYAKEAAHYFPDVEIIEMHHSQKIDAPSGTAIKTAQMIGEMRSSKKDEPFKDRARGEIKNGIPIHSIRLPGLFSHQSVIFGSNGETLTIRHDGMDRNCTMPGIFMACRKVMELDYLVYGLENLL

SEQ ID NO: 19503 - protein, 388 aa, Coxiella burnetii RSA 493
MNYKILLLDNISPRGLEKFNPEKYTLLTECEEPDAILVRSCNLHDKKIADRVQVIGRAGVGVNNIPVRPLTLSGVPVLNTPGANANAVKELVITGILLASRHIYPALDYARHIEGDDETITHQVEKNKKRFSGFELPGKTLGIIGLGQIGVKVANAAIRLGMKAIGYDPAITVRSAWELSSEVAQAESLRDVLRNSDFVTVHVPLNTHTHHLINEEAIAQMKDNVVVLNFARAEIVDNQALAQALAKNKIQNYVCDFPSTIFKSFPQVICLPHLGASTKEAEENCAIMVVEQVQDFLENGYIRNSVNFPTSKLARTEGCRIAITNKNVPNMVAQVSTVLSQADINIIDMINKSRDEIAYTLIDVNKKIDQNILHQLQSIDGIIRVRLL

SEQ ID NO: 19504 - protein, 432 aa, Coxiella burnetii RSA 493
MKKNTNYIIEVKNISKSFKKHGTQSLLVLDRISFNVGEGEIIAILGKSGSGKSTLLRTIAGLIKPSSGVVLYHGEPINAPVPGLTMVFQHFALMPWLTVLENVELGLEARGIAREERRARAIEAIDIVGLDGFESAYPKELSGGMSQRVGLARALVVDPEVLLMDEPFSALDVLTAENLRGDLINIWHSGKTNIKSVILVTHNIEEATFLADRILVFSSDPGTIRSEVNVELPHPRNDQDPEFRRLVDDIYGLMTRPAVEAVPDAIKFKTIDVGYRLPQVPISEMMGFLETLASHEQKKVDLPELAEELHFEIDELFPITEALEILHFAHVSGGDIVLTPAGRQLVEADILERKNIFAQHLIEYVPLARQIRQELDEHPNHEISEEHFLADLENYLSEQAADEVLTTVIDWGRYAEIFAYDYNSGMLSLENP

SEQ ID NO: 19505 - protein, 477 aa, Coxiella burnetii RSA 493
MLRSTKIIATLGPATDDLSILEEIIHEGVDIIRLNFSHGTHEKHKQRIEMVRKAAKKQERVIGILADLQGPKIRISSFKTGKINLKKGELFILDAGLPPEEGTEKSVGIDYKNLPKDVKAEDILLLDDGRLTLKVQNVKGEQIICRVVEGGALSDHKGINRLGGGLSAEAMTEKDINDLKFAVDFDVDYVAISFPRDAQDILKAKHLVQGYKGKAGIIAKIERTEAVKNIDAIIEASDGVMVARGDLAVEIGDAQVPLVQKDIIHRARSMDKPVIIATQMMESMIHATVPTRAEVSDVANAVLDNTDAVMLSAETAVGDYPVLAVAAMARTCVVSESQPRSHISRHRVECRFKRIDEAIAMATMYAANHLDIKAIITLTESGITPLWMSRIRTAIPIYGLSRFDKSLGRMTLYRGVYPIKFDPTQYTRDEINVKAVETLQSQDLLKNGDLVVLTKGDYMGVGGGSNAMKIMVVGKVV

SEQ ID NO: 19506 - protein, 391 aa, Coxiella burnetii RSA 493
MSNLNLHNKRVMIREDLNVPMKNGKITNDERIVRALPTIQKAIEQKARVMILSHLGRPEEGKFEKEFSLAPVARLLSKKLNQKVPLINDWLKGVAVEPGQAILCENVRFNKGENENNTELAKRMAELCDIFVMDAFATAHRAQASTAGVAAYAKLACAGPLLISEVEALSRALENPQKPLVAVVGGSKVSTKIHLLENLLDKVDQLIVGGGIANTFLKAQGYSIGKSLCENEWLDAAQQFWEKAAEKNVSLPLPVDVIVADELSEDAKATVKNIDAVTSNESIFDVGPNTSATYAKLMAQAGTIVWNGPIGVFEIEAFSQGTRALAQAVAKSTAYSIVGGGDTLAALDKFNLTDQMSYVSTAGGAFLEFLEGKILPAIKILTQRAKEYEQK

SEQ ID NO: 19507 - protein, 222 aa, Coxiella burnetii RSA 493
MNKKIISASILSADFSRLGEEVKSVIQAGADNIHFDVMDHHFVPNLSFGAVVCKALRDAKITAPIDVHLMVKNPNEFIKPFAEAGANLITFHPETVKDVEDTIARIKKAGMQVGMAFNPEKSLSLFTSFLTKIDLVLLMSVNPGFAGQSFMAESLKKIAATRQLLDTLQSKAFLGIDGGIKINNIADVSRAGADFFVVGSGLFHSSNYEEKLKEMRHAINDR

SEQ ID NO: 19508 - protein, 435 aa, Coxiella burnetii RSA 493
MVDHSAALFNKAQNYMPGGVNSPVRAFGAVGGVPRFIKKASGPYLIDVDEKKYIDYVGSWGPMILGHAHPAVIQAAQEAVQNGLSFGAPCENEIKLAALIGEFMPSIEKVRMVNSGTEATMSALRLARGVTGRSKIIKFEGCYHGHADCLLVNAGSGALTFGMPSSPGVPLGTVQDTLTATFNDLDSVAALFEKYSKDIAAIIVEPIAGNMNLIPAAPDFLTGLRELCNQYGSLLIFDEVITGFRVAKGGAQSLYNIRPDLTALGKIIGGGMPVGAYGGRREIMNQLSPEGPVYQAGTLSGNPVAMAAGLATLKELTAENFYSNLKEKTERLVMGILSRAKAAKIPLTANFSCGIFGLIFTSEERVTRYAQAVNGNVEHFRSFFHKMLDNGVYLAPSAFESGFISAAHTNKEVDNTLDIIENIFSVSETYLRISV

SEQ ID NO: 19509 - protein, 316 aa, Coxiella burnetii RSA 493
MVLDNILQVIGKTPVVRLHRIGQSLPCELYGKCEFLNPGGSVKDRIGAAMIESAEKQGKIKPGDTLIEPTSGNTGIGIALAGAVKGYRVIITMPEKMSHEKQVVLEALGATIYRTPTEAAYDDPESHISLAKRLNQEIPNSYILDQYSNAENPDIHYQTTGQEILDDMGENLSMVVMGVGTGGTIIGVAKKLKEVNPSIQIIGVDPIGSILGGGDEIKPYLVEGIGYDFIPEVLDNNLIDEYIKINDKDSFLMARRLIREEGLLVGGSSGSAVWAACQAAQRLKEGERCLVILPDAIRNYLTKFVDDAWMKAQGFL

SEQ ID NO: 19510 - protein, 477 aa, Valeriana officinalis
MSPQTETKASAGFKAGVKDYKLTYYTPDYQTKDTDILAAFRVTPQPGVPPEEAGAAVAAESSTGTWTTVWTDGLTSLDRYKGRCYHIEPVAGEEAKFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKSQSETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQLRNEGRDLAREGNEIIRAACKWSPELAAACEVWKEIKFEFEPVDTCNQ

SEQ ID NO: 19511 - protein, 406 aa, Burkholderia cepacia
MSADPFVIVGAGHAARRTAEALRARDADAPIVMIGAERELPYDRPALSKDALLNDDGEQRAFVRDAAWYDAQRIALRLGTRVDAIEREAQRVRLDDGTTLPYAKLVLATGSRVRTFGGPIDAGVVAHYVRTVADARALRAQLVRGRRVAVLGGGFIGLEVAAAARQLGCNVTVIDPAARLLQRALPEVVGAYAHRLHDERGVGFQMATLPRAIRAAAGGGAIVETDRGDVHADVVVVGIGVLPNVELAQAAGLDVDNGIRVDAGCRTADRAIFAAGEVTMHFNPLLGRHVRIESWQVAENQPAVAAANLLGADDAYAELPWLWSDQYDCNLQMLGLFGAGQTTVVRGDPARGPFTVFGLGGDGRIVAAAAVNLGRDIGAARRLIAAGAMPDPQQLADPTVGLKTFL

SEQ ID NO: 19512 - protein, 221 aa, Microcystis viridis
HKTQREALEFLQDFKSHLDETPDDREVVLCAPFTALAVLSKTLHGGRIRLGAQNVHWEKSGAYTGEISADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPEVTIQYGGSVKPDNIDEIMAQSQINGALVGGASLDPAV

SEQ ID NO: 19513 - protein, 221 aa, Microcystis wesenbergii
HKTQREALEFLQDFKSHLEETPDDREVVLCAPFTALAVLSKTLHGGRIRLGAQNVHWEKSGAYTGEISADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPEVTIQYGGSVKPDNIDEIMAQSQINGALVGGASLDPAV

SEQ ID NO: 19514 - protein, 427 aa, Rhizomucor pusillus
MLFSKISSAILLTAASFALTSRRPVSKQSDADDKLLALPLTSVNRKYSQTKHGQQAAEKLGGIKAFAEGDGSVDTPGLYDFDLEEYAIPVSIGTPGQDFYLLFDTGSSDTWVPHKGCDNSEGCVGKRFFDPSSSSTFKETDYNLNITYGTGGANGIYFRDSITVGGATVKQQTLAYVDNVSGPTAEQSPDSELFLDGMFGAAYPDNTAMEAEYGDTYNTVHVNLYKQGLISSPVFSVYMNTNDGGGQVVFGGANNTLLGGDIQYTDVLKSRGGYFFWDAPVTGVKIDGADAVSFDGAQAFTIDTGTNFFIAPSSFAEKVVKAALPDATESQQGYTVPCSKYQDSKTTFSLVLQKSGSSSDTIDVSVPISKMLLPVDKSGETCMFIVLPDGGNQFIVGNLFLRFFVNVYDFGKNRIGFAPLASGYENN

SEQ ID NO: 19515 - protein, 182 aa, Arabidopsis thaliana
MASSMLSSATMVASPAQATMVAPFNGLKSSAAFPATRKANNDITSITSNGGRVNCMQMQVWPPIGKKKFETLSYLPDLTDSELAKEVDYLIRNKWIPCVEFELEHGFVYREHGNSPGYYDGRYWTMWKLPLFGCTDSAQVLKEVEECKKEYPNAFIRIIGFDNTRQVQCISFVAYKPPSFTG

SEQ ID NO: 19516 - protein, 177 aa, Lemna gibba
MASSMMASTAAVARAGPAQSNMVAPFNGLRSSVAFPATRKANKNLSTLPSNGGKVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 19517 - protein, 177 aa, Lemna gibba
MASSMMASTAAAVARAGPAQSSMVPFNACRSSVPFPATRKANNNLSTLPGNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 19518 - protein, 177 aa, Lemna gibba
MASSMMASTAAAVARAGPAQTNMVPFNACRSSVPFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 19519 - protein, 177 aa, Lemna gibba
MASSMMASTAAVARAGPAQSSMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 19520 - protein, 177 aa, Lemna gibba
MASSMMASTAAVARVGPAQTNMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 19521 - protein, 163 aa, Oryza sativa (indica cultivar-group)
MEHQGQHGHVTSRVDEYGNPVGTGAGHAQMGTAGMGTHGTAGTGRQFQPMREEHKTGGVLQRSGSSSSSSSEDDGMGGRRKKGIKEKIKEKLPGGNKGEQQHAMGGTGTGTGTGTGTGGAYGQQGHGTGMTTGTTGAHGTTTTDTGEKKGIMDKIKEKLPGQH

SEQ ID NO: 19522 - protein, 178 aa, Trifolium repens
MALISSAAVTTINRAPVQANLATPFTGLKSSAGFPVTKKNNDITSITSNGSRVNCMQVWPPVGKKKFETLSYLPPLTDEQLLKEVEYLLRKGWVPCVEFELEKGFVHRQYNSSPGYYDGRYWTMWRLPLFGTTDAAQVLKEVAECKAEYPEAFIRIIGFDNVRQVQCISFIASTPKVY

SEQ ID NO: 19523 - protein, 305 aa, Saccharomyces cerevisiae
MSSSSQFKQLEKLGNGTYATVYKGLNKTTGVYVALKEVKLDSEEGTPSTAIREISLMKELKHENIVRLYDVIHTENKLTLVFEFMDNDLKKYMDSRTVANTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 19524 - protein, 423 aa, Trichoderma viride
MSLSNKLSITDVDVKGKRVLIRVSPDCPVDFNVPLDENKNITNPQRIAGAIPTIKHALDNGAKAVILMSHLGRPNGAVNAKYSLKPVVPKLEELLGKPVTFAPDCVGPEVEAIVNKADNGAVILLENLRFHIEEEGSSKDKEGNKTKADKAKVEEFRKGLTALGDVYVNDAFGTAHRAHSSMVGVDLPQKAAGFLMKKELDYFAKALESPQRPFLAILGGAKVSDKIQLIDNLLDKVNTLIICGGMAFTFKKVLDNLAIGDSLFDKAGAETVPKLVEKAKAKNVKIVLPTDFITADKFDKDANTGLATDKDGIPDGWMGLDCGDESIKLYKEAIDEAKTILWNGPAGVFEFEKFAGGTKATLDAVVEGCKNGKIVIIGGGDTATVAAKYGVEDKLSHVSTGGGASLELLEGKELPGVTALSSK

SEQ ID NO: 19525 - protein, 466 aa, Nesiota elliptica
SVGFKAGVKDYKLTYYTPDYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 19526 - protein, 465 aa, Shepherdia argentea
  misc_feature (5)..(5): Xaa can be any naturally occurring amino acid
  misc_feature (245)..(245): Xaa can be any naturally occurring amino acid
VGFKXGVKDYKLNYYTPDYQTKDTDILAAFRVTPQPGVPPEEAGAAVAAESSTGTWTTVWTDGLTSLDRYKGRCYHIEPVAGDENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAXFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDYIEKDRSRGIYFTQDWVSLPGVLPVASGGIHVWHMPALTEIFGDDAVLQFGGGTLGHPWGNAPGAVANRVALEACVQARNEGRDLAREGNEIIREACKWSPELAAACEVWKEIKFEFEAMDTI

SEQ ID NO: 19527 - protein, 127 aa, Betula pubescens
IRVDQYGNTVRTDEYGNPIRTDEYGNPIHHTAGTTAGYGAGGFDTTTPQGMRHDVTGTRGVSGKLHRSSEDDGHGGRRKKKGLAEKIKEKIPGVGNKDHRSNTSATTTQAYDEGELRQHEKKGVMEK

SEQ ID NO: 19528 - protein, 149 aa, Cocos nucifera
RTLRELKLLRHMDHENVVAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDVWSVGCIF

SEQ ID NO: 19529 - protein, 149 aa, Cocos nucifera
RTLRELKLLRHMDHENVIAIRDIIPPPVREIFNDVYIAYELMDTDLHQIIRSNQALSEEHCQYFLYQILRGLKYIHSANVLHRDLKPSNLLLNANCDLKICDFGLARTTSETDFMTEYVVTRWYRAPELLLNSSEYTAAIDGGLVGCIF

SEQ ID NO: 19530 - protein, 148 aa, Cocos nucifera
TLRELKLLRHMDHENVVAIRDIIPPPVREIFNDVYIAYELMDTDLHQIIRSNQALSEEHCQYFLYQILRGLKYIHPANVLHRDLKPSNLLLNANCDLKICDFGLARTTSETDFMTEYVVTRWYRAPELLLNSSEYTAAIDVWSVGCNV

SEQ ID NO: 19531 - protein, 338 aa, Populus balsamifera subsp. trichocarpa
MPVDASSLSGQGQTICVTGGGGFIASWMVKLLLDKGYTVRGTARNPADPKNSHLRELEGAEERLTLCKADLLDYESLKEGIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLLQPTVNASITHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQEKGHLPIPKQAAEESLKIQ

SEQ ID NO: 19532 - protein, 338 aa, Streptomyces avermitilis MA-4680
MTLRRVLSGLSAAATLGAAAAISTRRRALAAVPHELRHPVLFLPLNFGNPVTLAIARRLVPLVGAATRPGVRVERRTLPATTDDLPVGVLTYQASGQAPRAALLWIHGGGTVMGAARQENTWCSRVADELGALVVSVDYRLAPENPYPAALDDCFRTLRWLHANAAALGVDPARIAVGGESAGGGLAAAVVQRAHDSGVPVRFQLLLYPMLDDRTALRVDPPNSAIYTWTPDSNRFAWTSYLGRPPQDRDDRPYIAAARRRNLDGLPPAWIGVGDIDLFHDEDVDYARRLSEAGVACELRLESGMYHGADALLDGKAPSMTAFRTAALDALRTALAKP

SEQ ID NO: 19533 - protein, 420 aa, Zygosaccharomyces rouxii
MATHEEFIRTQVFGTVFEITNRYTDLNPVGMGAFGLVCSATDTLVGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLRRMLVFVPKKRITAADALVHPYLAPYHDPTDEPTAEAQFDWDFNDADLPVDTWRVMMYSEILDFHKIGGGDGQIDTNAAFDDQVAAAHAAAMAQHHHQTQQQSSGKHTNPTTSSSAATITVTVPIAITMPSLIMVIKRFTT

SEQ ID NO: 19534 - protein, 495 aa, Streptomyces avermitilis MA-4680
MANLAEFLVETARRQPERPALRLGGQVTSYAELDQRSARAAALLRAEGVRPGDRVALMLPNVPEFVVLYYGVLRAGAVVVPMNPLLKTRETEYHLRDSGAQMLFEWHQAPGEGAQGAAAAGVRHMAVEPAAFAGLLAGHAPLPEVSEPDSEDVAVLLYTSGTTGRPKGAMLTHTGLRHNTEVNAVDVQRMTAEDVVVGCLPLFHIFGQICAMSVTVRAGASLTLIPRFDPQTVLDAIARDRATIFEGVPTMYAALLQHPSEADVSTLRMCISGGASLPVEILHGFERRFGCVVLEGFGMSETSPVVTFNHPDRPRKAGSIGTPIKDVQVRLLDEKGQDVTPGEIGELAVRGPNVMKGYWNRPEETAATIPDGWLRSGDLAHRDEDGYLYIVDRKKDMIIRGGYNVYPREIEEVLHEHPAVALAAVVGLADAHLGEEIAAAVVLRPKAQATPDELRQFVKERVAAYKYPREVWLVDTLPTGPSGKILKREISAPTG

SEQ ID NO: 19535 - protein, 351 aa, Streptomyces avermitilis MA-4680
MSTEDLSFPEDEKVLVTGGSGFVGAHTVVRLLREGHRIRVAVRGPAQEAQVLAALRQAGVDRADLLEFAVADLSADDGWAQAMDGIAHVLHHASPFPPTPPETEDEVILPARDGALRVIAAARSAGIPRVVMTSSFAAVGYTLTPDDHYTEENWTDPNTPGLPAYHKSKVLAEAAAWDYVKTNGGIELAVVNPTGIFGPQLVDRPSGSIGLIKALMAGEMPVVPVWNFGVVDVRDVVDLHLRAMLHPAAAGERFLANSGSSSLFKIANILREQFPAAADRLPATELTIDQVREAAKTEPALKDAAVLGGRIPEISHEKASSILGWEPLDVRDTIVATAEALIELGAVTLPE

SEQ ID NO: 19536 - protein, 1073 aa, Streptomyces avermitilis MA-4680
MTTQPETDLRPIRSPRGVPLFGHTPQIPSTNPVEYFGKLSKQFPEGLYGMEIAGIEQVFVWDPDLVAEVCDETRFFKQIDKTPLAHVRDYAGAGLFTAHQHEEEWGMAHRVLLPVFSQRAMKGYFGQMLEIAQNLVGKWERKEGQPVNITDDYTRLTLDTIALSGFGYRFDSFAKEDLHPFLNALLQALVESLRRSQELPVMTKMRKADDKKYRENIRLMRDLVENVIKERREGKGTGEDDLLGLMLEATDPETGKGLDDDNVRDQVVTFLIAGHETTSGLLSFATYSLMRNPHILAQAYAEVDRLLPGDTVPDYDTIMQMDVIPRILEETLRLWAPIPMIGKSPLEDTVIGGCYGLKKGARVNILEGPLHTHPKAWERPEEFDINRWLPENRVNHHPHAYKPFGNGVRACIGRQFALTEARLALALVLQKFKFADTDDYKMDVKEALTRKPGGFELNVRARQEHERTVFGAADLQTDDTQAQAAVSGVGVNLTVAYGSSLGSCEDLARTIADRGERSGFGTTLVGLDELGDNLPTEGLLVVVASSYNGKAPDNAQRFDDLLAAGLPEGSLSNVRFALLGAGNTQWVATYQGFPKRIEAGLLAAGATRVIERGIADAAGDFDGMATRWMDTLWTTLAEEYAADTSETTGPRFEVQLLTEAEVRPAIVSEQAYPLTVVANEELVSDATGLWDFSIEPPRPAAKSITIELPDGVTYDTGNHLAVFAKNEPVLVNRALARLGVDRDQVLRLDQPGGGRTHLPVGTPVTTGLLFTEFVELQDVATRSQIQELAEHTQCPWTRPQLQAYTADTAEAEERYQKEILGKRVSVLNLLERFPAVELPLAVFLEMMGPIRPRFYSISSSPLANPRHVRLTVGLLEGPALSGDGRYRGTCSSYIAGLESGDVFYGYVRVPSPTFAPPADPATPLLLIGPGTGIAPLRGFLEERAHQHAHGTQVGLSQVFVGCRHPEHDYFYRQEMQDWEQAGIAQVHTAFSAVTGHPARFVQDAIVGAADTVWQAIQDGAYVYVCGDGRRMAPAVREALAAIYRKHTGSDDEAAQQWLAQLEADERYQQDVFA

SEQ ID NO: 19537 - protein, 454 aa, Streptomyces avermitilis MA-4680
MPGDLKDGRIVIVGASLAGLRAAEALREEGFTGSLTVVGDEPHPPYDRPPLSKQVLLGQATADSTGLPMRQDPNADWRLGVRATGVDLLAKQVLLEDGESLPYDRLLIATGTRARPWPNPAEAALDGVFALRTREDAGGLAQRLTAGPERVLVIGGGFTGSEIASACRERGLEVTVAERGPAPLVGALGGTLSKLAAAMQRNHGVDLRTGVTVTALNGNGSFTGAELSDGSRVDADVCVVALGAVRNVEWLAESGLAAGPRGIACDAGCRAFNMYGIVTDDVFVAGDVSRFPHPLFGYQMLSLEHWGNAVEQAEVAAHNMVNPGPLQRPHLAVPSFWSTQFGLNIKSVGVPTYSDHVVIAQGSLEARRLAMVYGYQGRVTAAVTVDMAKALDYYRHLIETAAPFPPPPGAQDRAVAADLAIPSDVPDPKGLSHGPTVALTGYLPDRRLTLVQPG

SEQ ID NO: 19538 - protein, 331 aa, Streptomyces avermitilis MA-4680
MQTRTLGSTGPAVSALGLGAMGMSGAYGATDRAESIATVHAALEAGVTLIDTGDFYGMGHNELLLAEVLRGRDRDSYQLSVKFGQLRGPGHEFGGQDGRPEAVKNLLAYSLTRLDTDHIDIYRPARLDPAVPIEETVGAIKEMIDAGYVRHIGLSEVDAATIRRAHAVHPVADLQIEYSLLSRAVEAEILPTLRELGIGLTAYGVLGRGLISGHWSAGHSAGPGDFRAFSPRFSSENVEHNLALVEALRRVAEAKGCTVAQLAFAWVAAQGEDIVALVGARTRERLAEALPAMELNLTADDLAEIEKAVPPGAARGDRYPSAFMSGLGVGN

SEQ ID NO: 19539 - protein, 479 aa, Streptomyces avermitilis MA-4680
MNETARTYDVIVIGGGPVGENVAERARAAGLSAVIVERELLGGECSFWACDPSKALLRPVVARADASRVPGLDPAVAGPLDVEAVLAHRDMMSSYWKDEDQADWLNAVSVDLIRGHGRLTGCKEVAVQTSEGDTIALTARHAVAVSTGTRAALPPIPGFDTVRPWTSREATSADKVPDRLAVVGGGVVAVEMATAWQALGSQVTMLVLENGLLERMEPFAGELVADGLREAGVDIRFSTTVTSMAREGGEDGEVRITLSDGRELAADEILLATGRAPQTRDVGLETVGLTPGDWLTVDDTFRVTGVDGGWLYAVGDVNRRALMTHQGKYQARIAGTVIGARAKGEPIDDAPWGAHVATADHAAVPQVVFTTPEVASVGLTSREAEQSGRRIEVVDYDLARVAGAHQYGDDYRGRARMLIDTDRNTVVGVTFAGPGVGELVHSATIAVAGEVPLDRLWHAVPAFPTLGEVWLRLLETYRG

SEQ ID NO: 19540 - protein, 331 aa, Streptomyces avermitilis MA-4680
MRAVRLHEHGGPEVLRYDEVPIPEPGPGEVLVRVHAVGVNPPDWYLRDGLTNLPPETRPKFSLPVIPGTDLSGVVEAVAADVDGLSVGDEVFGLLRFPSFDGSTYAEYVVAPASDLALKPAGIDHVHAAGAPMAGLTAWQFLIELGHDHPSPFQAAQHRPVPLGANMTVLINGAAGGVGHFALQLAKWKGARVIAVASGAHESFLRELGADEFIDYTKSRPEELVHDVDLVLDAVGGPDSKRFLRTLKRGGSQFPVFFGEFDEEETVKLGVTVTGTQVRSNGAQLAELGRLLDAGTVRVAIDSTFALADARAAHERAARGHIQGKIVLTVA

SEQ ID NO: 19541 - protein, 413 aa, Streptomyces avermitilis MA-4680
MRETAVSGTTTLPAPSGPYLDKGLLPADFFAYEELLSDGEREQLESVREFLRTQVAPIVDDYWARAEFPFQLVEGFGRLGLMDWADPDSPESRPSNLLAGFLALELAHVDASVATFAGVHTGLAMGTILTCGSDEQKRRWLPAMSRFEKIGAFGLTEPHGGSDVAGGLQTTARRDGDTWILDGAKRWIGNATFADLVVIWARDVETRHVLGFVVEKDTPGFTATKIENKMALRIVQNADIVLDGCRVPEANRLQNAHSFKDTAKILRQTRSGVAWQAVGVMFAAYEIALQYTKEREQFGRPIGGFQLVQDLLVKMLGNATASCGMMTRLAQLQDAGVFRDEQSALAKAYCTVRMRENVGWARELLAGNGILLDYKVGRFVADAEAIYSYEGTREIQTLIVGRAVTGGLSAFVR

SEQ ID NO: 19542 - protein, 350 aa, Streptomyces avermitilis MA-4680
MIHRRCVGGRRNHGGRVAQGSSRSRLPQQGTPVTMSSTSSTPPWNVQRLPGADGRVFLVTGGNAGIGYFVAEQLSATGATVVLGSRNPAKAEAATASIRARVPGSRVRAVRLDLADLSSLETAVESLEVERLDAVVHNAGVALDDPPREETGDGHELMFGTNHLGHFALTQWLMPLLSAAPAARVVTMGSFAAKSERLDLDDLQSRKDYQPKRTYGRSKLAQMYFGVELDRRLRAAGSTVASVVVHPGGALDSLTPSRPPVHVRSTGARLSAAPAALLLQGKHAGAWPAVRAVLDPAVRGGQLWGPRVFGLRGEPRREPVWDHLADPSVAARLWDASCDLMGTDLSTISG

SEQ ID NO: 19543 - protein, 479 aa, Streptomyces avermitilis MA-4680
MSSTFRNYIDGAFADASDGRTLDVVDPTTGDVYATSPLSGAADVDAAMAAAAAAFPVWRDATPSVRQRTLLKIADAMEARADELVAAESRDTGKPLHLTRSEELAPAIDQVRFFAGAARMLEGRSAGEYMEGMTSIIRREPVGVCAQVAPWNYPLLMAVWKFAPALAAGNAVVLKPSDTTPASTVLIAEIIGGVLEELGLPRGIFNVVCGDRETGRLMVEHPTPAMASITGSVRAGIQVAQSAAKDVKRVHLELGGKAPAVVFEDADLAKAVEDLVVGGFFNAGQDCTAATRVLVHESVHDEFVAALAKAAADTKTGQPDDEDVLYGPLNNAGQLAQVSGFIERLPEHATIEAGGHRVGEKGYFYAPTVVSGLRQDDEIVQNEVFGPVMTVQSFTDEAQAVQYANGVDYALASSVWTKDHARAMRMSKNLDFGCVWINTHMALVAEMPHGGFKKSGYGKDLSAYGFEDYTRIKHVMTSL

SEQ ID NO: 19544 - protein, 334 aa, Streptomyces avermitilis MA-4680
MWAWEVERPGPIEDGPLRFVERPVPVPGPGELLVRVRACGVCRTDLHVSEGDLPVHRPRVTPGHEVVGVVAGRGADAGGYAVGDRVGVAWLRRTDGTCRYCVRGAENLCPASEYTGWDTDGGYAEYTTVPAAFAYRLPTDVDDVALAPLLCAGIIGYRALVRASLPPGGRLGLYGFGGSAHLCAQVALAQGATVHVLTRDPASQRLALALGAASAGGAYDTPPEPLDSAILFAPAGGLVPVALRALDRGGVLSVAGIHLSDTPPLCYERELFYEKELRSVTSNTRADGREFLELAARYGVRATTHTYPLSEAQQALRDLKAGRFDGAAVLVNDV

SEQ ID NO: 19545 - protein, 508 aa, Streptomyces avermitilis MA-4680
MRAPLPTLSPAEAGTSDNLAAVLAGRAERRGWTGRPAFRQGHQVWTHGEVHDLAARTATVLAEHGVRPGDRVLLALPDSLAWVTAFLATARLGAVAVPVNPELTPAEHEFMADDAEAALCVTGPGLERRFAHRRRLGADQLVALAGTASPAADAHPVGPRTPLYIQYTSGTTGRPKGVVHCHGDPGTYHELIGRRLLRITADDVTLSVSKLFFAYGFGNAFVFPLFSGSSAVLVDGRPTPAAVDGLVARHRVTLLYSVPSAYAALVADRAVGHMACFASVRAAVSAGEGMPAGLAEQVAELLGAPVLEQLGSTEAGHAFCANSFDHHHPGTVGRPVPGFEVELRDRSGRPVGAGEEGELWVRGPSLTPGYLNLPEETDRTLVGGWLATRDRARREPDGTYRHLGRTDDMETVGGSTVSPLEVEALLGTHPAVREIAVAAVTDARGAGRLRAFVVPVTPIPVGLEADLVCLARDNLAAVQVPRSVSFVPTLPRTATGKLRRHLVRQGAW

SEQ ID NO: 19546 - protein, 441 aa, Streptomyces avermitilis MA-4680
MNDRTPEQPADTVARLRATFRTGRTKPVEWRTDQLDRLREMLTTHGADLAAALHADLGKSSTEAYRTEIDFTVREIDHTLSHLGTWLRPESAPVPPHLGDDATAWTQYDPLGVVLVIAPWNYPAQLLLTPMIGALAAGNAVVVKPSELAPATSAVLARLLPQYLDTDAVAVVEGGIPETTALLAERFDHIFYTGNGVVGRIVMRAAAEHLTPVTLELGGKSPVFVDRDADLAVVADRLARGKFLNAGQTCVAPDYVLTDPETGRALETELARAVSSLYGPEPETSGEYGRIVNERHFDRLSGLLDSGRVVTGGGSDRTAKYIAPTVLADVDPESPVMREEIFGPILPIVTVPGLDEAIDFINDRDKPLALYVFTASGTTRQRIAAETSSGGLGYGLPLAHLTVSDLPFGGVGESGMGNYHGRYSIETFSHRKAVLEKPLSV

SEQ ID NO: 19547 - protein, 308 aa, Streptomyces avermitilis MA-4680
MRAVVVEQWGGPEVLVEREVARPEPGLNEVLVRVHAAGVNPVDFKTRASGALIEWGEVPAVGWDVSGTVEAVGPGVGMFRPGDEVYGMPLFPRQAGAYAEYVVAPARHLAPKPANLTHVQAAALPLAALTAWQALVDTAGVRAGERVLVHAAAGGVGHLAVQIAKARGAYVIGTASAGKHDLLRQLGADEVIDYRTVRFEDAVGDVDVVLDGLGGQNAERSLTVLRPGGRLITLPGPDDVPADVPGHVRAVWMLVEPDHLGLREIAALAERGALTPVVETVVPLAEAAKAHEIGEQGRTTGKIVLSVA

SEQ ID NO: 19548 - protein, 331 aa, Streptomyces avermitilis MA-4680
MRAFVVTKYKEPLQEADVPEPTVGEHDVLVRVEAAGLNPLDEKIRAGEFKQILPYKLPLILGNDVAGTVISVGTAVRGFKPGDEVYARPHQDRIGTFAERIAIAEDDLALKPASISMEEAGSLPLAALTAWQALVERGKVRPGQKVLIHAGAGGVGSIAIQLAAHLGASVATTASGSNADFVRALGADTVIDYRSQDFEQLLTGYDLVLDSLGGENLEKSLRVLKPGGKAIGIAGPPDPAFAREAGLNPLLRLAVAGMSGKIRRQAKKLGVTYEFLFMRASGDQLRQITTLIDQGVVRPVVGKVVGFDQTPQALQSLSQGGIRGKAVIGSS

SEQ ID NO: 19549 - protein, 499 aa, Streptomyces avermitilis MA-4680
MTAGPSVTVDGVLRRSARRTPARRAIHYRDRSWTYAELDEAVSRAARALRETGLAPGDRVGAYGHNSDAYLIGFLACARAGLVHVPVNQNLTGDDLAYIVDQSGATLVLTDPDLAGNLADGVRTLALRDADDSLLTRLATTAQYDGAEPRGEDLAQLLYTSGTTALPKGAMMTHRALVQEYLSAIAALDLSAGDRPVHSLPLYHSAQMHVFLLPYLAVGAENVILDAPDAEQIFDLVEAGRADSLFAPPTVWIGLSNRPDFATRDLSGLRKAYYGASIMPVPVLERLKERLPELAFYNCFGQSEIGPLSMVLGPDEHKRRMDSCGRPVLFVEARVVDESGKEVADGEQGEIVYRSSQLCEGYWDKPEETAEAFRDGWFRSGDLAVRDAAGYFTVVDRVKDVINSGGVLVASRQVEDALYTHEGVAEAAVIGLPDERWIEAVTAVVVARGEVTEAELLAHAREKLAHFKAPKRVLFVDELPRNASGKILKRELRDRFAEA

SEQ ID NO: 19550 - protein, 306 aa, Streptomyces avermitilis MA-4680
MPKAYVFTRYGGPETEALVDLDRPSAGPGQLVVAVRAAGVNPVDWKQRTGYRRPGGPARELPAVFGNEVSGVVEETGEGVTGFAVGDEVFGNPVAGGYAQYAVLPVTTTAHKPAGLSFTDAATLPVAAATAYDGVRQLGLPSGATLLITGAGGGVGVAAVQLARAAGLRVVGVASEAKKDLVESLSAVHVPSGPELAERVRAAAPGDVDAVFDLVGGEVLEAAATLLTDRTKLITGADRETVARLGGAPVARARTAAVLDAVAALAVGGELKPYVTRTFPLELAAEALRTVEEGHARGKVVIEVAE

SEQ ID NO: 19551 - protein, 313 aa, Streptomyces avermitilis MA-4680
MVIMSASWSSHAFQPVLERIADEIERTPGRGRPADYIPALAACDPRRFGMAVAELDGTVYGVGDWRQPFSTQSITKVFTLALDLAREGDALWEHVGREPSGNPFNSLVQLEYESGIPRNPFINAGALVVTDRLQTQTGDAAGSLLEFLRAESGNPRLTFDQDVAASEAAHGDRNAALGHFMASYGNIDNSVPVLLDQYFRQCSIEASCADLALATGFLARHGIRADGSRLLTQSQAKQVNAVMLTCGTYDAAGDFAYRVGLPGKSGVGGGIIAVVPGRCTLCVWSPGLDERGNSVAGVAALDRFTTLTGVSVF

SEQ ID NO: 19552 - protein, 486 aa, Streptomyces avermitilis MA-4680
MSEQSLKGEAQGAIRTGTQPSRHVDAGDAGYAKSLKSRHVNMIAIGGAIGTGLFLGAGGRLADAGPSLFVAYAVCGIFAFLVVRALGELVLYRPSSGAFVSYAREFLGEKGAYTAGWMYFLNWATTGIADITAVAVYTHYWGMFSDIPQWVIALIALAVVLTVNLISVRMFGELEFWFAIIKVSALVVFMLIGIFLLVTQHPVDGHHPGPSLITDHGGIFPHGLLPMLLIIQGVVFAYASVELVGVAAGETENPEKIMPKAINSIMWRVGLFYVGSVVLLSMLLPWNKYTAGQSPFVTVLSNIGVPAAGGVMNLVVLTAAMSSLNSGLYSTGRILRSMAMSGSAPKFTGVMSRSQVPYGGILLTSGICILGVGLNFVVPADAFEIVLNFAAIGILATWGMIMLCHLMFWRKTRTGELSRPSYRLPGSPWTEIVTIGFLVSVLVLMYADGGAGRTTVLCLPLIAAALVAGWYGVRGRVARKASGADA

SEQ ID NO: 19553 - protein, 485 aa, Streptomyces avermitilis MA-4680
MHSAELPDLRARQDADGACIADDAADLDNAAFARRVRRAASALRARGVGRGDVVALLLPNTADFVVALFAAWRLGAAVTPVNPALTESEVRYQLGDAGAAVAVTAGPSPLAGALPVAELSTGPEDTTAPETDAGALALLIYTSGSTGRPKGVMLDHANLAAMAEMMTGTARLTETDHSLLILPLFHVNGIVVGVLSPLLAGGRVTVAGRFRAETFFDLVATVRPTCFSAVPAIYSMLAELPDHVRPDTSSVRFAACGAAPMPAALIERFERRYDIPVLEGYGLSEGTCASTTNPLYGRRKPGTVGLPLPGQQVAVMDPQGRIAPAGATGEVVVRGPNVMRGYLGRPEETARTVIDGWLHTGDVGRFDEDGYLVLVDRIKDLIIRGGENIYPKEIETVLGDHPEVLEAAVVGAAEPRLGEVPVAFVALRPGASATTADLLDHCRARLAEFKVPTGITLVGRLPRNPVGKTDKPALRSGTTALTTAG

SEQ ID NO: 19554 - protein, 403 aa, Streptomyces avermitilis MA-4680
MTALLPEKTSVDERLAADFYDIESLLPPHERELLTHARAFMRTEVKPLVNEYWAKGEFPRELIGKFRDLGLAGVPYEGYGDPLPAGSNLLVGMLSMEYTRTDASSATFFGVHSGLAMYSIYRGGDQEQRDRWLPSMAALDTIGAFAMTEPLGGSDVAGGMRTTARRDGENWVLNGAKRWIGNATFADLVVVWARDEADGKVKGFVVEKGTPGFSPVKIENKIAFRIVENAEITLTDVKVPEANRLQRIDSFRDVAEILRATRSGVAWQALGVMLGAYELALGYAKERKQFGRPIARFQMVQDLLVKSLGNITACWGMLVQLARLQDAGVFRDEHSSLAKAFVTSRMREVVAWCREIFGGNGIVLDYDIARFFADAEAIYSFEGTREMNTLIVGKAVTGESAFV

SEQ ID NO: 19555 - protein, 463 aa, Streptomyces avermitilis MA-4680
MVNHATGAPALARSLTLRAVTLFGLAYMTPLIVLGTFGVVAADTGGAVPTAYLLALVAMLFTAHSYGKMAAAYPVAGSAYTYVRKAIDGRLGFLVGWVTLLDYFFLPMVIWLIGGAYLQAQFPAVPSWIWIIGFIAVTTVLNIRGIKTAERVNDLLMVFQVLVIGIFVVLSLRHVLHIGGAGALASGAPFANGATTAAGISAGAAIAAYSFLGFDAVTTLTEETVDPKRTMPRAILLTALIGGGIFVLVAYTTQLAHPGSSFDDPSSAAFEIAKSIGGDLFSSVFLAGLVVAQFASGIAAQASTSRLLYAMGRDGALPRKVFARLHERYRTPALNIVLTGAVGLIALRLDVATSTSFINFGAFVAFTFVNVSVLAMYIRRRRAGDTLNPLSYVVAPAIGAVVDLYLLYNLDGRALTLGLIWLGLGVVYLAYLTRMFRVPPPEMSFTPADSDEAQVAGALQNTK

SEQ ID NO: 19556 - protein, 340 aa, Streptomyces avermitilis MA-4680
MSTYRAAQVAAASGPFEIVQREVPRPGPGHVRIAVDACGICHSDSVFVDALLPGVRFPLVPGHEIAGHIDELGEGTDISWQVGDRVAVGWFGGSCGHCPPCRQGDFVVCQNLKVPGWAYDGGYAEAVIAPADALARIPDALAATDAAPLGCAGVTTYNGLRRSSARPGDLVAVLGIGGLGHLGVKYAAAMGFETVAIARGSDKADFAKQLGAHHYIDSTADTTVADALQSLGGAKAVLATAANSDAITATVDGLAPRGELVAIGVDAEPLGISPNQLLMGGKIIRGHPSGTAQDVQDTMAFSALHGIRPMTETVPLDQADEAYRKMMSGAARFRMVLTTG

SEQ ID NO: 19557 - protein, 448 aa, Streptomyces avermitilis MA-4680
MLHVAVVGSGPSGVYTAQGLVQQDSGVRVDVLDRLPCPYGLVRYGVAPDHEKIKSLQNNLRTVLEHERVRFLGGVRIGPDGVPATRLRELYHAVVYCVGAATDRHLGIPGEELPGSWSATEFVSWYSAHPDSVADGFVRGARSAVVIGVGNVAVDVTRILARGPSELSPTDMPQAALTALAASRVTDIHMVGRRGPSQARFTTKELRELGALPDTDVVVDQRELALDPAYADPSGLPAAQRRNVEVLRAWAEAPPKGAPRRIRPRFFLRPVELLDGGGHVGAVRFERTAPDGRGGVAGTGQYEDIEAQLVLRSVGYRGVPLEGLPFDAEQGTVPHLAGRVLRDGAVSPGEYVAGWIKRGPTGVIGTNRPCAKETVTSLLADAPVLVRREVPDDPMAVLRAEGLRPVEWAGWQAIERAEAELGASLGRNVVKLPDWAALRAAAAGTAAH

SEQ ID NO: 19558 - protein, 359 aa, Streptomyces avermitilis MA-4680
MSALFEPYSLRDLTIPNRVWMAPMCQYSAAPQGPAAGAPHDWHFAHYAARATGGTGLIVVEATAVSPEGRISPYDLGIWNDTQVEAFRRITRFLAAQGTVPAIQLAHGGRKASTDRPWKGGAPLAADEHGWQPLGPSPVAFDERHPVPTELSVAEIRQIVGQFADAARRALAAGFEIAEIHGAHGYLINEFLSPHSNRRTDEYGGSYENRVRFALEVVDAVREVWPAGKPLFFRVSATDWLDEGGWTADDTVRFAAELQAHGVDLLDVSTGGNASGVRIPTGPGYQVPFAARVKAGTSLPVAAVGLITDAEQAEKILANGEADAILLGRELLRNPSFARLAARELGGDVHVPAQYHRSV

SEQ ID NO: 19559 - protein, 326 aa, Streptomyces avermitilis MA-4680
MSDKIALSTWPTPLEPMPRLAAALGLGENDLWIKRDDLIGLGGGGNKVRKLEWTVGAALAAGADTLVTTGAAQSNHARLTAAAGARLGLDVVLVFPGTPDSATHGSGNLVLDSLFGARVHWAGDGGPSTMGDVADEVCRQLRRDGARPHLIPFGGSSPLGARGYVEGGEELRSQLPDVDHVVVALGSGGTMAGLVGALGEQRVLGVHCGAVAEPAATVADLAGPLTRRSITPESLRLRTDQVGAGYGVLHEPVLEAMRTAAGTEGIVLDPVYSGRAMAGLIAAVRDGDIRPAQRTVFLHTGGLPGLFGHTETVQRSVSTLRSYEVE

SEQ ID NO: 19560 - protein, 503 aa, Streptomyces avermitilis MA-4680
MAATLSLAAILAENARRRPEKTALVEGELRLTFAEVWQRARAQAGALVGLGVRPGDRVALMAPNTADFPHAYYAIAAAGGVVVPVHLLLSASEVEHVLKDSGATLLLCHPAQAETGTAAAQAVGVQVITLGAEFEKLARIAEPLPSYVTRAADDPAVVFYTSGTTGVPKGAVLSHFNLVMNATVNAFDANDIRPDDVALGALPLFHAFGQTVSMNSTWRAGATLVLLPRFDAARAIELMVKEGVNTFHGVPTMFVALAGAAAAMDALPELRVCVSGGASLPLAVLERFEEAFGAKIYEGYGLSETSPTATVNQPVFGTRAGTIGHPLWGVDVEIARAEVEGRVELLPPGELGEVVVRGHNVFSGYLGRPEATAETLVDGWLRTGDLGTKDDEGFLRIVDRKKDVIIRGGYNVYPREVEEVLLRHPGVAQAAVIGLPDELHGEEVCAVVVRATGAVPEAAEITEWSKEHLGRHKYPRRVEFTDALPLGPSMKILKRELRVRYAQ

SEQ ID NO: 19561 - protein, 405 aa, Streptomyces avermitilis MA-4680
MKRILVVGASAAGLTAAETLRREGYDGTITLVGDECHAPYDRPPLSKQLLAAEWEPERLALRTPGDLEALDLDLRLGVAATGLDVTDRTVRLADGSSVPYDGLIVATGVRPRRLPGEGAHVLRTVDDALALRDRLGPGTRLVVVGAGFLGAEAAAVARRLGADVTLLEPAPVPLAHAVGAEVGEVLSRAHLEHGVELRTGVTVTEVTDEGVRLADGEVVEADEILVAIGCLPNTEWLKGSGLTLGDGLVCDAYGEAARSVYGAGDVARWHNPLFGVSMRIEHRTNAAEHGMAAARNLLRPEARRPFAPVPYFWSDQYDMKIQAYGYFRAHDETVVVEGDLAERRFVAAYRTGDRLTGALAAGLPPRAIRRWRQAIAAGATWREAVRDNISPATAPWGSVLPEKIT

SEQ ID NO: 19562 - protein, 488 aa, Streptomyces avermitilis MA-4680
MPDLFIDGEWVRGATGTTREVVNPFDATVVRSVDEGDATDVDRAVTAARRAFHAADWAAAPTQRRADVLFRVAEYLLRDIEEIARDETLNTGKTLAEARIDVKDVSNAFRYFAEMAGKDAGRVVDAGPDVLSRVVHEPVGVCALIAPWNYPLLQASWKVAPALAAGNTFVLKPSEITPLTTIAMMRLIEEAGAPPGVANLVLGAGATVGSAMTVHPEVDLVSFTGGLGTGRRIMESAAREVKNIALELGGKNPNVVFDDADFEAAVDHTLDASFLHSGQVCSAGSRLLVQDSWHDRFVRELADRASRIRLGNGLDPHTESGPLSSAEHRAKVEKYIDLGRSEGARLVTGGRRPDDPDLAHGFFLLPTIFDDCDRSMRIVQEEVFGPVVTVETFRTEDEAVELANDTRYGLAAGVWTGEASRAQRVAARLRHGTVWINDFHPYLPQAEWGGYGQSGVGRELGPTGLREYQEIKHIYQNLSPGPSGWFKG

SEQ ID NO: 19563 - protein, 476 aa, Streptomyces avermitilis MA-4680
MTIPSGKAPSEGAPSGNREFDLGALLAERGAERYELHAKYLNHQLPRMLHTIGFDKVYERAEGAHFWDADGKDYLDMLAGFGVMGLGRHHPVVRKALHDVLDASLADLTRFDCQPLPGLLAEKLLTHSPHLDRVFFGNSGTEAVETALKFARYATGKPRILYCSHAFHGLTTGSLSVNGEDGFRDGFAPLLPDTAVPLGDLDALARELKKGDVAALIVEPIQGKGVHEAPPGHLRAAQDLLQRHKALLIADEVQTGLGRTGDFYAYQHEEGVEPDLVCVAKALSGGYVPVGATLGKEWIFKKVYSSMDRVLVHSASFGSNAQAMAAGLAVLSVMENEQIVANARATGEQLKSRLAALVDTYELLSDVRGRGLMIGIEFGRPTSLKLRSRWTVLQAARKGLFAQMVVVPLLQRHRILTQVSGDHLEVIKLIPPLIIDERDVDRFVAAFTAVMDDAHSGGGLLWDFGKTLVKQAVAQR

SEQ ID NO: 19564 - protein, 487 aa, Streptomyces avermitilis MA-4680
MSKDAVDTARVASRTDVTQSPADAGDAGYSKDLKARHVNMIAIGGAIGTGLFLGAGGRLHNAGPALAIAYLVCGVFAFFVVRALGELVLYRPSSGSFVSYAREFLGEKGAYVAGWMYFLNWSTTGIADITAIALYTHYWSLFTDIPQWVLALIALAVVLAVNLISVKIFGEMEFWFAIIKVATLVGFMLIGIFLLATHHEVGGHTPGLSAVTDHGGIFPHGMMPVVLVMQGVIFAYAALELVGVAAGETAEPEKVVPRAVNSIMWRVGLFYVGSVVLLALLLPGSVYSADQSPFVTVLSKIGIPAAGDVMNLVVLTAAMSSLNSGLYSTGRILRSMAMAGSAPKFTARMNRSQVPYGGILLTCAVCVLGVGLNYLMPTQAFEIVLNVASLGIISTWVIIMICHLVFVRRARAGLVTRPSFRLFGSPVTEIVTIAFLLAVLGLMWNDPEVGRKTLLLIPLVAVLLVGGWFAVRRRVSQAEDRELAQLK

SEQ ID NO: 19565 - protein, 260 aa, Streptomyces avermitilis MA-4680
MDKVVATALEAVADVPDGATLAVGGFGLSGVPNVLIQALYERGVAGLGVVSNNCGAMESGLAVLLAAGRIARVTGSYIGANKEFARQYLAGELEVEMIPQGTLAERLRAGGAGIPAFYTPAGVGTQVADGGLPWRYDGSGGVALASPPKEVREFDGTEYVLEHGIRTDFALVRAAKGDRHGNLVFNKSARNFNPLAAMAGRVTIAEVEELVEPGGLDPDAVHVPGIFVQRVIALSPEQTNAKMIEKRTVSASAATGTVSG

SEQ ID NO: 19566 - protein, 292 aa, Streptomyces avermitilis MA-4680
MQLGLIGLGKMGGNMRERIRRAGHTVVGYDRNPEVSDVSSLTELVSALEGPRVVWVMVPAGAPTQSVVDELGDLLSPGDTVVDGGNSRWTDDEKHAEELAAKGIGFVDAGVSGGVWGLQNGYALMVGGDAEHIARVQPIFDALKPEGDFGFVHAGKVGAGHFSKMVHNGIEYAMMQAYAEGWELLEKVDSVTDVRAVFRSWQEGTVIRSWLLDLAVNALDEDEHLEKLRGYAEDSGEGRWTVEAAIHNAVPLPAITASLFARFASRQDDSPQMKMVAALRNQFGGHAVESAE

SEQ ID NO: 19567 - protein, 452 aa, Streptomyces avermitilis MA-4680
MTIDLAALPHDFLWGTATAAYQIEGAVAEDGRSPSIWDTFSHTPGKIDNNDHGDVACDHYHRWREDIGLMKQLGTNAYRLSVAWPRVIPGGDGPVNAKGLAFYDELVDGLLEAGITPSVTLYHWDLPQVLQDRGGWPERATAEHFAAYAAVVAERLGDRVTHWATLNEPLCSAWIGHLEGKMAPGLTDLTAAIRASYHLLLGHGLAAQAIRAAAPAAEVGIVNNLSTIHAASDRPEDVAAARRMDGHVNRWWLDPVHGRGFPADMREVYGVELPEQPGDLATIAAPLDWLGLNYYFPATVADDPTGPAPRVRSVRRLGVPRTGMDWEIDATGIETLLLRLTHEYGPRKLYVTENGSAFPDVVRPDGTVDDPERQDYLVRHLAACASAARKGAPLAGYFAWSLLDNFEWAYGYDKRFGLVHVDYRTQVRTIKGTGHRYADIVRTHRGRARRAA

SEQ ID NO: 19568 - protein, 426 aa, Streptomyces avermitilis MA-4680
MSDLYGRHRSVLPDWLALYYADPIEITHGEGRHVWDAAGNRYLDFFGGILTTMTAHALPEITKAVSEQAGRIVHSSTLYLNRPMVELAERIAQLSGIPDARVFFTTSGTEANDTALLLATTYRQSNQILAMRNSYHGRSFSAVGITGNKGWSPTSLSPLQTLYVHGGVRTRGPYAELGDADFIAACVEDLKDLLGHIRPPAALIAEPVQGVGGFTAPPDGLYAAFREVLQEQGILWIADEVQTGWGRTGEHFWGWQAHGQSGPPDILTFAKGIGNGMSIGGVVARADIMNCLDANSISTFGGTQITMAAGLANLIYLLEHDLQGNARRVGGLLIERLRAIGAQLPVVREVRGRGLMIGIELVKPGTDEANPQAASAVLEAAREAGLLLGKGGAHNTSALRIAPPLSLTVAEAEEGAAILDRALRSV

SEQ ID NO: 19569 - protein, 253 aa, Streptomyces avermitilis MA-4680
MSRAGCMAVDPLIELHDVNKYFGELHVLQDINLTVGKGEVVVVIGPSGSGKSTLCRTVNRLETIESGTIRLDGQPVPDEGKALAKLRAEVGMVFQSFNLFAHKTVLQNVSLAQVKVRGRKKDEADRHSRELLDRVGLADQALKYPAQLSGGQQQRVAIARALAMNPKALLFDEPTSALDPEMINEVLEVMQQLARDGMTMVVVTHEMGFARSAANRVVFMADGRIIEDRTPEEFFTNPRTERAKDFLSKILKH

SEQ ID NO: 19570 - protein, 305 aa, Streptomyces avermitilis MA-4680
MSSNPAPSPRPARPLVAWIGLGIMGSPMSENLIKAGYDVTGFTLEQDKLDRLTAAGGTAAGSIAEAVRDADVVITMVPASPQVEAISYGPDGILENARSGALLIDMSSITPRTSVDLAEAAAAKGIRVLDAPVSGGEAGAVEAVLSIMVGGEQADFDEAKPVFEALGRTIVLCGPHGAGQTVKAANQLIVAVNIQACAEAVVFLEKSGVDLKAALDVLGGGLAGSTVLTRKKDNFLHRDFKPGFRIDLHHKDMGIVTDAARAVGAALPVGAVVAQLVAALRAQGDGGLDHSALLRSVERLSGARL

SEQ ID NO: 19571 - protein, 334 aa, Streptomyces avermitilis MA-4680
MKTFMIERYGDKAGVRAGEMPDPQVGADDILVQIHAASVNPLDLRLRDGDFKAFLPYRLPLILGNDLAGVVVQVGSAVTRFAVGDEVYARPDKDRIGTFAELIAVHQDDVAAKPATLTMEEAASLPLVALTSWQALVERARVMPGQKVLIHAGSGGVGTIAVQLAKQLGAHVATTASTAKADLMKELGADVVVDYKKQAFETVLHGYDVVLDTLGGETLEKSLQVLKPGGKVISIAGPPDPAFARELGAKPILRLAMSALSFRTRRRAKRRNVTYSFLFMKASGDQLRELTPLIDTGKIRPVVDRVFPFAETRQAMEYVEKGRAKAGKVVVAMT

SEQ ID NO: 19572 - protein, 485 aa, Streptomyces avermitilis MA-4680
MTQQSVEPRSVADDAGAGTRVPAGRSWLDRYFHISRRGSTVAREVRGGVTTFMAMAYILLLNPLILSGKDAAGNTLGQQALITATAFAAACTTLLMGFAGRVPLALAAGLSVSGVLSSQVVPQMTWPQAMGMCVIYGVVIMLLVFTGLREMIMNAIPLALKHAITMGIGLFVALIGFYKAGFVHQGKATPVTLGPTGELAGWPVLLFAATLLLIFMLQARGVPGAILIGIVSGTVLAVVLNALGVIDPRQWASGAPELHGGAVSMPDFSIFGKVEFGGWDQVGAMTVGMIVFTLVLAGFFDAMATIIGVGTEAGLADDQGRMPGLSKALFIDGAGGAIGGVAGASGQTVFVESATGVGEGARTGLSSVVTGLFFAACLFFTPLTAIVPGEVAAAALVVIGAMMMMNARHVDWSDRGTAIPVFLTVVIMPFTYSITAGVAAGVLSYVAIKAAQRKAREIGAFMWGLTVIFLVYFALNPIESWLGVH

SEQ ID NO: 19573 - protein, 422 aa, Streptomyces avermitilis MA-4680
MTDAGTALTNWAGNITYSAKELHRPQSLDALRALVADSAKVRVLGSGHSFNEIAEPGADGVLLSLTALPPSVEVDTAARTVRVAGGVRYAELARVVHGHGLALPNMASLPHISVAGSVATGTHGSGVTNGSLASAVREVELVTADGSAVRIGRGDDRFDGAVTALGALGVVTALTLDLEPDYRVAQQVFTELPLAGLDFDAVAASAYSVSLFTGWRTSGFAQVWLKRRTDRPSADFPWAAPATEAMHPVPGMPAVNCTQQFGVPGPWHERLPHFRAEFTPSSGAELQSEYLLPRPYALDALHALDAVRETVAPVLQICEVRTVAADAQWLSPAYGRDTVALHFTWVEDLAAVLPVVRRVEEALDPFDPRPHWGKVFAVPARVLRGRYPRLGDFRALVDSLDPGGKFTNAFVREVLGSGDRPS

SEQ ID NO: 19574 - protein, 478 aa, Streptomyces avermitilis MA-4680
MENMNTPDVIVIGGGTGGYSAALRAAALGLTVVLAERDKVGGTCLHRGCIPSKAMLHAAELVDGIAEARERWGVKATLDDIDWPALVATRDDIVTRNHRGVEAHLAHARVRVVRGSARLTGPRSVRVEGAPDDLPGGAGDFTARRGIVLATGSRPRTLPGLVPDGRRVVTSDDALFAPGLPRSVLVLGGGAIGVEYASFHRSMGAEVTLVEAADRIVPLEDVDVSRHLTRGLKKRGIDVRAGARLLDAELLEAGVRARVRTVRGEIRTLEAERLLVAVGRAPVTDGLDLAAAGLATDERGFVTPSDWDRLETAVPGIHVVGDLLPPPSLGLAHASFAEGLSVAETLAGLPSAPVDYAAVPRVTYSSPQTASVGLGEAEARARGHEVDVNTMPLTAVAKGMVHGRGGMVKVVAEEGGGQVLGVHLVGPHVSEMIAESQLIVGWDAQPSDVARHIHAHPTLSEAVGETFLTLAGRGLHQQ

SEQ ID NO: 19575 - protein, 466 aa, Streptomyces avermitilis MA-4680
MSMSRTSRTKERLVVIGGDAAGMSAASQARRLKGPAELEIVAFERGHFTSYSACGIPYWVGGDVAERDQLIARTPEEHRARGIGLRIRTEVTEIDAEGARVRSRDLASGAESWTSYDKLVIATGARPVRPELPGVDAPGVHGVQTLDDGQALLDTLAATRGRRAVVVGAGYIGVEMAEALINRGYEVTVVNRSKEPMATLDPDMGRLVHKAMEGLGITMVNDAEVTGLPTGDDGRVRAVATEDAEYPADVVVLGIGVRPETTLAQAAGLPLGEHHGLLTDLAMRVRGHENIWAGGDCVEVLDLVSGSERHIPLGTHANKHGQVIGANVGGGYATFPGVVGTAVSKVCDLEIARTGLREKDARRAGLQFEAVTVESTSRAGYYPGADPMTVKMLAERRTGRLLGVQIVGGEGAGKRVDIAAVALTAGMTVEQMTALDLGYAPPFSPVWDPILVAARKAVAAVRANGV

SEQ ID NO: 19576 - protein, 469 aa, Streptomyces avermitilis MA-4680
MSQTTTAVSGVSAPVSIGVRLDRMPITPMHRRLTAVIGIGLLFDTFENSLSGTIAKVLQGDFAFGATSLKLVLASVFVGQFIGSLVLGRVADRFGRRRAFLINLAIYSGFSLLGAFSPNAGWLIATRFLAGIGIGAEQALSDCYLADVLPAAKRGRFIAWAYTLAFCGVPAVGFAALWLVPLTPLGVDGWRWLFVIGALGSAVVWVLRRQLIESPRWLAATGRTAEADRLVSRMEAQAPAGRTAEDLPAPYEAPGAARVRLRDVFAPGLRRRTVMLWIFCALSVVGYYGFGTLAPQILAAKGFDIVAGLGFTALCFLGYPVGSALSLPVIDRVERKTLVAASAAAMVAAGMGFAFTDSPALIVAFGFGYTLCSNVFSSVSHVYLSEQYPTAIRATASGAAYSLSKLSAAALPFVLLPVLDSYGPGALFAVIAAAMAALAVTVLTLGERTTGASVDRAPVPVNIPTLKRS

SEQ ID NO: 19577 - protein, 480 aa, Streptomyces avermitilis MA-4680
MPALRIKSPELLVAESGADLEGHGLKRTMGLFQLICFGVGAIVGTGIFVGLSDSVAQAGPAVVVSFVLAAITCVFTAFAFAELGGAIPVSGSSYSFAYAGLGERTAFLVGWCLLLEYGVSVSAVAVGWSQYVNELLDSLTGLELPAALSAGPGDGGVINLPAVVVIALASVLLVRGVRESARATAAMAVLKLAILVVFCAIGFSAFKDGNLTPFSPAGLGGIGAGTTAAFFSYIGFDAITTAGEEARNPRRDIPIAILVCLGLATLLYCAVALAAIGAIGGDQVGGRPAALSYVVNEVTGSTAGGAVIAFGAVVAIASVVLAVMYGQTRILMSMARDGLVPRVFERVSPKTSTPVTGTLLVALVFAVPAAFASLDAVVNLCTIGTLAIMAVVNVTVIALRRREPGLTRSFRVPLYPVIPVLGVGFCLYLMYETGWTTWIQFAAFLAAGCLVYALYGRRNSRLAKSAAATRTDAEAVSQAV

SEQ ID NO: 19578 - protein, 1352 aa, Streptomyces avermitilis MA-4680
MTTTPEAERTRTAEQVRTVCSYCGVGCGIVLDVGTGPDGRRTVLKASGDKEHPANRGRLCTKGATTADMLAAPGRLTSALVRDDRGAEPVPAPVDEAVRETARRLRAIVDEHGPDAVAFYVSGQMSLEAQYLANKLAKGFVRTNQIESNSRLCMASAGTGYKLSLGADGPPGSYDDLDKADVFLVIGSNMADCHPILFLRLLERVKAGAKLIVVDPRRTATAAKADLFLQVRPGTDLALLNGLLHLLYENGHTDAEFIARHTEGWEAMPDFLADYPPATVSEITGIPEDDIRAAARLIGEAGEWTSCWTMGLNQSTHGTWNTNALVNLHLATGAICRPGSGPLSLTGQPNAMGGREMGYMGPGLPGQRSVLVDEERAFVEELWELAPGTIRADGVGRGTVEMFRKMADGDIKACWIICTNPVASVANRKTVIEGLEAAEFVVTQDVFADTETNAYADVVLPGALWTESPGVLVNSERVLTLARPVVEPPGEATADWRLIAAVAREMGYTEGFAYESAEQVFEEIKRAWNPKTGWDLRGVTYERLRSTPVQWPAARADGPARNPVRYVADGLVFPTASGRAVFHARPHLPAAELPDDDFPFVLNTGRVQHQWHTLTKTGKVAKLNKLNPGPFVEVHPRDAAALGVVDGDSVEVASRRGRAVLPAVVTDRVQPGCCFAPFHWNDLFGEYLSINAVTSDAVDPLSFQPEFKVCAVALARVASPPSALPVRSLDAAPPAPDGGLTASSAPAGQAEIFGLTPGPPPVLTARERQYLTGFLAGLGSGAPGVPVLPAEAPFSAEHALWVNGVLAGMYSRAATAEAPAKPPGREVVVLWASQTGNAEEFAAATAERLTATGHRATLVGMDDTDVAQLPRTADLLLITSTFGDGDAPDNGSGFWDALSAEAAPRLDGVRYAVLAFGDSSYDDFCGHGRRLDTRLDELGAVRLAPRTDCEPDYEPYAGAWLDQVLGALGTKTDAPKPARPRKPEPAIARLTGNRLLSLPGAGKEVRRFTFDTSGTGLTYEAGDALGVRPVNSPDLVDEWLSVTGLDHSTPVAVEGVGEVPFAQALHRHLDITHITPDLLRFVSEHAHDNRELKKLLRPDNKDGLAQWSWGRQAVDVVAEHPVRATAEEWAEVFKRLQPRLYSISSSPLVDPHLVSLTVSVVRYEDRLGRPRGGVCSPFLADAEHHTPVPVFVQRSPHFRPPADSSTPMVMVGPGTGVAPFMGFLQERRALGHRAPNWLFFGEQHRATDFYYEEELTALLADGTLTRLDTAFSRDQRAKVYVQDRIREHGPELWHWLQNGARFYVCGDASRMAKDVDRALRDIAVTHGGLTEAEATAYVKQLAAEKRYVRDVY

SEQ ID NO: 19579 - protein, 439 aa, Streptomyces avermitilis MA-4680
MSTTVSGKSGTWRNWAGNVTARPVREVTPASVEELSAAVRKAADEGLRVKAVGTGHSFTAAAATDGVLIRPQLLTGIRGIDREAGTVTVEAGTPLKRLNVALAREGLSLTNMGDIMEQTVSGATSTGTHGTGRDSASIAAQIKGLELVTADGSVLTCSEKENPEVFAAARIGIGALGVVTAITFSVEPVFLLTAREEPMSFDKVTADFDELFAENEHFEFYWFPHTGNCNTKRNNRSAGPERPVGQLSGWIEDEFLSNGVFQVANLLGRAVPATIPTLARVSSRALSARTYTDIPYKVFTSPRRVRFVEMEYAVPREALVETLRELKSMVDRSPLRVSFPVEVRTAPADDITLSTASGRDSAYIAVHMFRGTPYQAYFTAAERIFTAHEGRPHWGKVHTRDAEYFSGVYPRFGEFTALRDRLDPERRFGNDYLRRVLGS

SEQ ID NO: 19580 - protein, 484 aa, Streptomyces avermitilis MA-4680
MAVTKSAVASLKREAEGAHAAHEGILRRQSARESAARTYARALPIVPVRARGLTIEGADGRRYLDCLSGAGTLALGHNHPVVLEAIRKVLDSGAPLHVLDLATPVKDAFTTELFRTLPAGLADRARVQFCGPAGTDAVEAAFKLVRTATGRSGLLAFTGAYHGMTAGALEASGGATDGRVARLPYPQDYRCPFGIGGERGAELGARWTESLLDDVKSGVPLPAGMILEPVQGEGGVIPAPDAWLRRMRAITADRSIPLIADEVQTGVGRTGRFWAVEHSGVVPDVMVLSKAIGGSLPLAVVVYRDDLDVWQPGAHAGTFRGNQLAMAAGTATLAYVREHRLAERAQTLGARMLDQLRSLATEFPCVGEVRGRGLMIGVELVRAEEDREAVSPGSGDFASLDTAGAGPRPAAPELAAAVQRECLRRGLIVELGGRHASVVRLLPPLTISDEQATAVLDRLADAVEAVARGRAERSRGFQRSERAG

SEQ ID NO: 19581 - protein, 258 aa, Streptomyces avermitilis MA-4680
MTEVSVAKDAVAATDELVVLKSVNKHFGALHVLQDIDLTITRGEVVVVIGPSGSGKSTLCRTINRLETIDSGDIRIDGKALPQEGKELARLRADVGMVFQSFNLFAHKTVLENVMLGQVKVRKADRKKAEEKARGLLDRVGVGTQSDKYPAQLSGGQQQRVAIARALAMDPKVMLFDEPTSALDPEMINEVLEVMQQLARDGMTMVVVTHEMGFARSAANRVVFMADGRIVEEAVPDQFFSNPRSDRAKDFLSKILHH

SEQ ID NO: 19582 - protein, 250 aa, Streptomyces avermitilis MA-4680
MSKLRVAVLGVKGRIGSEAVRAVEAAEDMELVAALGRGDKLETLADTGAQVAVELTTPASVMGNLDFCVRHGIHAVVGTTGWTDDRLAQLKGWLAQSPETGVLIAPNFSIGAVLTMKFAQLAAPYFESVEVVELHHPNKVDAPSGTATRTAQLIAEARRKAGSAPQPDATVTALDGARGANVDGVPVHAVRLRGLLAHQEVLLGAEGETLTVRHDSLHHSSFMPGILLGARRVVTTPGLTFGLEHFLDLN

SEQ ID NO: 19583 - protein, 1046 aa, Streptomyces avermitilis MA-4680
MAKVRVYELAKEFGVESKVVMAKLQELGEFVRSASSTIEAPVVRKLTDALQQGNGGKAAPRKAAPAKPGAPSPAQAARPAAPRPPAPKPAAAERPAAAERPAAAPAAPGPRPGPKPAPRPAPAAPAPAAPEFTAPPSAPAAPAAAASGPRPGARPGAPKPGGARPATPGQGQGGQVRGERTDRGDRGDRGDRQGAARPGGQAPRPGARPAGPRPGNNPFTSGGSTGMARPQAPRPGGAPRPGGAGAPGGPRPQGAGGQDRAPRPQGGPGGAPRPQGGPGGARPTPGGMPRPQAPRPGGAPGGNRPNPGMMPQRPAAGPRPGGGGPGGRGPGGGGRPGGPGGGGGRPGGGGFAGRPGGGGGGFAGRPGGPGGGGGGFAGRPGGPGGGGGGRPGFGGRPGGPGGRGGTQGAFGRPGGPARRGRKSKRQRRQEYEAMQAPSVGGVMLPRGNGQSVRLSRGASLTDFAEKIGANPASLVGVMMNLGEMVTATQSVSDETLKLLADEMNFVLEIVSPEEEDRELLESFDIEFGEDEGGEEFLVARPPVVTVMGHVDHGKTRLLDTIRKTNVVAGEAGGITQHIGAYQVTTEVNDEERKITFIDTPGHEAFTAMRARGAKSTDIAILVVAANDGVMPQTIEALNHAKAADVPIVVAVNKIDVEGADPTKVRGQLTEFGLVAEEYGGDTMFVDISAKQGLNIESLLEAVVLTADASLDLRANPEQDAQGIAIESHLDRGRGAVATVLVQRGTLRVGDTMVVGDAYGRVRAMLDDKGENVEEAGPSTPVLVLGLTNVPGAGDNFLVVDEDRTARQIAEKRAARERNANFARRGVRFSLENLDEALKAGLVQELNLIIKGDASGSVEALESSLLQLDVGEEVDIRILHRGVGAVTESDINLATGSDAIVIGFNVRAAGRAAQMAEREGVDVRYYSVIYQAIEEIEAALKGMLKPEYEEVELGTAEIREVFKSSKLGNIAGVLVRSGEVKRNTKARLIRDGKVIAESLNISGLRRFKDDVTEIREGFEGGINLGNFNDIKVDDVIATYEMREKPRS

SEQ ID NO: 19584 - protein, 444 aa, Streptomyces avermitilis MA-4680
MSALPQERRVVTAIPGPKSQELQARRTAVVAAGVGSVLPVFTTRAGGGIIEDVDGNRLIDFGSGIAVTSVGASAEAVVRRASAQLQDFTHTCFMVTPYEGYVAVAEALAELTPGDHAKKSALFNSGAEAVENAVKIARAYTKRQAVVVFDHGYHGRTNLTMALTAKNMPYKNGFGPFAPEVYRVPVAYGYRWLTGPENAGAEASAQAIDMINKQIGADNVAAIIIEPVLGEGGFIEPAKGFLPAISKFAKDNGIVFVADEIQSGFCRTGQWFACEDEGIVPDLITTAKGIAGGLPLAAVTGRAEIMDAAHAGGLGGTYGGNPVACAGALGAIETMKELDLNAKAKNIEAVMKARLGAMAEKFDIIGDVRGRGGMIAIELVKDRDTKEPNPEAAGALAKACHQEGLLVLTCGTYGNVLRFLPPLVIGEDLLNEGLDIIEQAFSRI

SEQ ID NO: 19585 - protein, 507 aa, Streptomyces avermitilis MA-4680
MHNPGHRFQAQDRFADGAQYIAGRFAKGTSGRRHAVVDPATGEEVYRYELAGTADVDAAVAAARAAFPGWAATTPGDRSDALHRFAAVLADRAEEFARAESLQCGKPLKLTREFDVPGTIDNTSFFAGAARHLQGQSAGEYSGDHTSYIRREPIGVVGSIAPWNYPLQMAAWKVLPAIAAGNTIVLKPAEITPLTSLLFAEAATRAGIPDGVVNIVTGAGRDAGEHLVAHPDVAMTSFTGSTAVGRRVAEIATSTVKRLHLELGGKAPFVVFDDADLDAAVHGAVAGSLINTGQDCTAATRAYVQRPLYEEFVARTAALMETVRLGDPFAHGTDLGPLVSHAQRDRVAGFVDRARAYARVVTGGEIPEELKDGAYYRPTLIADAAQDSEIVQSEIFGPVLVVLPFDSDDEGIRLANDTPYGLAASAWSRDVYRANRATREIKAGCVWVNDHIPIISEMPHGGYKASGFGKDMSAYSFEEYTQIKHVMFDNTAIVRKDWHRTIFGDRP

SEQ ID NO: 19586 - protein, 479 aa, Streptomyces avermitilis MA-4680
MSTELRRLRNHIDGEFRDAADGRTTEVVNPATGEAYATAPLSGQADVDAAMAAAAAAFPAWRDQTPAERQKALLKIADAFEERAEELIAAEVENTGKPIGLTRSEEIPPMVDQIRFFAGAARMLEGRSAGEYMEGMTSIIRREPIGVCAQVAPWNYPMMMAVWKFAPALAAGNTVVLKPSDTTPASTVLIADIIGSILPKGVFNVICGDRDTGRAMVEHPTPAMASITGSVRAGMSVAESAAKDVKRVHLELGGKAPVVVFEDTDIPKAVEDISVAGFFNAGQDCTAATRVLVQESIHDEFVAALAKAAADTKTGQPDDEDVLYGPLNNPNQLKQVAGFVERLPAHAKVEAGGHQVGEKGYFYAPTVVSGLKQDDEIIQNEVFGPVITVQSFTDEAQAIEWANGVDYALASSVWTKDHGRAMRLSKSLDFGCVWINTHIPLVAEMPHGGFKKSGYGKDLSAYGFDDYTRIKHVMTSLDS

SEQ ID NO: 19587 - protein, 470 aa, Streptomyces avermitilis MA-4680
MTSTAQAPGAREAHPEHLGHVIFIAAAAAMGGFLFGYDSAVINGAVEAIRSKYDIGSATLAQVIAIALIGCAVGAATAGRIADRIGRIRCMQIAAVLFTASAIGSALPFALWDLAFWRVIGGFAIGMASVIGPAYIAEVAPAAYRGRLGSFQQAAIVIGIAISQLVNWAILNAAGGDQRGKLLGLEAWQVMLGVMVVPAVLYGLLSFAIPESPRYLIEAGKDARAREVLEEVEGKEIDLDARVEEIRLAMYREEKPSFKDLLGGTFFFKPIVWVGIGLSVFQQFVGINVAFYYSATLWQSVGVDPTDSFLYSFTTSIINIIGTVIAMIFVDRVGRKPLAIIGSVGMVIGLALEAWAFSYDLVDGKLPATQGWVALIAAHVFVLFFALSWGVVVWVFLGEMFPNRIRAAALGVAASAQWIANWAITASFPSLADWSLSGTYIIYTVFAALSIPFVLKFVKETKGKALEEMG

SEQ ID NO: 19588 - protein, 310 aa, Streptomyces avermitilis MA-4680
MNWAYTGSRQRGDESLRTVHRALDVGVTLLDTADMYGPFTNELLVGRVLKERRSEAFVSTKVGLLVGDQHIVANGRPGYVKRACDASLRRLQTDVIDLYQLHRADPEIPVEETWGAMADLVRAGKVRALGLCAVGARSARRSGARLHDATIRQLERVQQVFPVSAVEAELSVWSKEALDALLPWCAARGVGLLAAMPLGNGFLTGTLTPGEGFEPDDLRARHPRFTAEMMAANQPIVVGLRRIARRHGDEVTPAQVALAWLLAQGPHVVPVPGAKRARWVAENATAAGLRLTARDLADVAALPAARGSWD

SEQ ID NO: 19589 - protein, 476 aa, Streptomyces avermitilis MA-4680
MRRSKIVCTLGPAVDSHEQLVTLIEAGMNVARFNFSHGTHAEHQGRYDRVRAAAAETGKAIGVLADLQGPKIRLETFAEGPVELVRGDEFIITTEDVPGDKHICGTTYKGLPGDVSKGDQILINDGNVELRVVEVDGPRVKTVVIEGGVISDHKGINLPGAAVNVPALSDKDIEDLRFALKMGCDLVALSFVRDASDVKDVHKVMDEEGRRVPVIAKVEKPQAVENMEAVVAAFDGVMVARGDLAVEYPLEKVPMVQKRLVELCRRNAKPVIVATQMMESMITNSRPTRAEASDVANAILDGADAVMLSAESSVGAYPIETVKTMSKIVTAAEEELLSKGLQPLVPGKKPRTQGGSVARAACEIADFLGGKGLVAFTKSGDTARRLSRYRAAQPILAFTTDEGTRNQLALSWGVESHVVPFVNSTDEMVDLVDSELQNLKRFNDGDVVVMTAGSPPGVPGTTNMVRVHHLGEGKRA

SEQ ID NO: 19590 - protein, 263 aa, Streptomyces avermitilis MA-4680
MTANVTKTDATTPMVKSEGVHKSFGAVEVLKGIDLEVKTGEVFCLIGPSGSGKSTFLRCINHLEKINAGRLSVDGELVGYRQKGDKLYELKDSEVAVKRRDIGMVFQRFNLFPHMTALENVMEAPVQVKGVSRAKARERAGQLLERVGLADKAKNYPSQLSGGQQQRVAIARALAMDPKLMLFDEPTSALDPELVGDVLDVMRDLAESGMTMIVVTHEMGFAREVGDSLVFMDGGVVVESGHPRDVLTNPQHERTQSFLSKVL

SEQ ID NO: 19591 - protein, 311 aa, Streptomyces avermitilis MA-4680
MSDNGGVTGPDVPEALDLAALRPRLPSPVQAVDDERFARHGVRLLLKRDDLIHPDLIGNKWRKLAPNLRAAAGRPLVTFGGAYSNHLRATAAAGRLLGLATIGVVRGQELADRPLNPSLTRCAADGMRLHFVDRSTYRRKTEPGTLAAILRAVAAEDAYVVPEGGSNSPAVRGCRALGEELRGHADVVALACGTGGTLAGLAAGLGPGQRALGVPVLKGDFLTAEVTALQERAFGGRQGAWSLDDRFHFGGYARTSPGLHAFAADFERRHGLPVERLYVAKMLYGLVALAEEGGFARGTTVAAVITGRPLG

SEQ ID NO: 19592 - protein, 456 aa, Streptomyces avermitilis MA-4680
MTLESVKPEAPEAPQLRNPPLAGGGIPGLGHGWKLARDPLGFLAQLRDHGDIVRLKLGPKTMYAVTTPALTGELALSPDYEIGGPLWESLEGLLGKHGVATANGPTHRRQRRTIQPAFRLDIIPEYGPIMEEEARAFAARWQPGEIIDCTSESFRVAVRIAARCLLRGHYMDERAERLSIALTTVFRGMYRRMVIPAGPLYRLPLPANRKFDRALADLHLLVDEIVAERRASGQKPDDLLTALLEAKDDNGDPITEQEIHDQVVAILTPGSETIASTIMWLLQVLTEHPEHAAKVCAEVESVTGDRTVAFDDVRKLSHTNNVVVEAMRLRPAVWILTRRAVTETELGGYRIPAGADIVYSPYAIQRDPRSYAEHLEFDPDRWLPERSKDLPKYAMRPFSLGNRKCPSDHFSMAQLTLITATVAAKWRFEQVSESSDATRVGITLRPHRLLLKAIPR

SEQ ID NO: 19593 - protein, 347 aa, Streptomyces avermitilis MA-4680
MTTTVAAYAAPAAKAPLERTTIERREVGEFDVLIDIKFAGICHSDIHQARDGWGEGIFPMVPGHEIAGIVAEVGSGVTKFQVGDRVGVGCMVDSCRECENCKAGLEQYCVGGNVGTYNALDKNGEPTYGGYSEKVVVDENYTVRIPDGLALDVAAPLLCAGITTYSPLKHWNAGPGKKVAVLGMGGLGHMGVKIAHALGAEVTVLSQSLRKKDDGLKLGADHYYATSDPKTFEELAGTFDIILSTVSAPLDFGAFLSLLRTDGALVNVGAPEEPISINLFSVIAGRKTLAGSGIGGIQETQEMLDFCAEHGLGAEIELISASEINDAYERVLNSDVRYRFVIDTATI

SEQ ID NO: 19594 - protein, 475 aa, Streptomyces avermitilis MA-4680
MIIGGGPGGYEAALVAAQLGAEVTVVDCDGLGGASVLTDCVPSKTLIATAEVMTTFDSSYEELGIIVADDTPPMEQAARVVGVDLGKVNRRVKRLALAQSHDITASVTRAGARVMRGRGRLDGMQSIDGSRKVVVRAADGAEETLVADAVLIATGGHPRELPDAQPDGERILNWTQVYDLDELPDELIVVGSGVTGAEFAGAYQALGSKVTLVSSRDRVLPGEDPDAAAVLEDVFRRRGMNVMARSRAESAKRIGDRVEVTLSDGRVISGSHCLMAVGAIPNSSGMGLEEAGVKLRDSGHIWTDKVSRTTAPGVYAAGDVTGVFALASVAAMQGRIAMYHFLGDAVAPLNLKTVSSNVFTDPEIATVGYSQADVDAGKIDARVVKLPLLRNPRAKMQGIRDGFVKIFCRPGTGIVVGGVVVAPRASELIHPISIAVDNNLTVEQIANAFTVYPSLSGSIAEVARQLHTRKTAGDA

SEQ ID NO: 19595 - protein, 478 aa, Streptomyces avermitilis MA-4680
MASAFEYAPAPESRSVVDIAPSYGLFIDGEFTEAADGKVFKTVSPSTEEVLSEIAQAGEADVDRAVKAARKAFEKWSALPGSERAKYLFRIARIIQERSRELAVLETLDNGKPIKETRDADLPLVAAHFFYYAGWADKLDHAGFGANPRPLGVAGQVIPWNFPLLMLAWKIAPALATGNTVVLKPAETTPLSALFFADICRQAGLPKGVVNIIPGYGDAGAALVEHPDVNKVAFTGSTAVGKAIARQVAGTEKKVTLELGGKGANIVFDDAPIDQAVEGIVTGIFFNQGQVCCAGSRLLVQESVQDELLDSLKRRLSTLRLGDPLDKNTDIGAINSAEQLSRITSLVDQGEAEGAERWSPACELPSSGYWFAPTLFTNVTQAHTIARDEIFGPVLSVLSFRTPDEAVAKANNSQYGLSAGIWTEKGSRILAVASKLRAGVIWANTFNKFDPTSPFGGYKESGFGREGGRHGLEAYLDV

SEQ ID NO: 19596 - protein, 417 aa, Streptomyces avermitilis MA-4680
MGRGVTRRRAVGNGVLVSTTETLIASADAHSAHTYHPLPVVVATADGAWMTDVEGRRYLDLLAGYSALNFGHGHRRLIDAARAQLERVTLTSRAFHHDRFAAFCTQLAELCGMEMVLPMNTGAEAVETAVKTARKWGYRVKGVPAEMAKIVVAGNNFHGRTTTIISFSTDPEARADFGPYTPGFEIVPYGDLTAMRSALTENTVAVLLEPIQGEAGVLVPPAGYLAGVRELTRDRNVLFVADEIQSGLGRTGRTFACEHEGVVPDVYVLGKALGGGIVPVSAVVASSEVLGVFRPGEHGATFGGNPLACAVALEVIAMLRSGEYQARAAELGEHLHRELGVLAGTGRVTAVRGRGLWAGVDVDPAYGTGREISEKLMDRGVLVKDTHGSTIRIAPPLVISKEDLDWGLAQLRGVLGV

SEQ ID NO: 19597 - protein, 509 aa, Streptomyces avermitilis MA-4680
MAGQQARQAGQTQRTIHVGGEWREADSRATREILDPADAKPFAVVAEGDERDADAAVAAARRAFDSGEWPHTPVAERAALLRRVADLLVRDRESLGLLESRDAGKTLEEGRVDIDCVADAFRYFADLVVGEGGGRVVDAGSPDIHSVVVHEPVGVCAMITPWNYPLLQASWKIAPALAAGNTFVIKPSEITPLTTAALVDLLVEAGAPAGVANIVTGPGHTVGARLAEHPDVDLISFTGGLASGTKVAQAAAVSVKKVALELGGKNPNVVFADACATDEDFDTAVDQALNAAFIHSGQVCSAGGRLIVEESVRERFVAELVRRAGRIRLGRGTEDGVECGPLVSEQQRDKVEGYVASALSEGAVLRTGGRRPEPSDVRPAAGYFFEPTVLDQCHRGMKVVREEVFGPVLTVETFRTEDEAVALANDTEYGLAGAVWTSDAGRARRVAGRLRHGTVWINDFHPYLPQAEWGGFGKSGVGRELGPAGLAEYRETKHVYQNLAPKPVRWFAG

SEQ ID NO: 19598 - protein, 464 aa, Streptomyces avermitilis MA-4680
MQFHDSMISLVGNTPLVRLNSVTAGIQATVLAKVEYFNPGGSVKDRIALRMIEAAEESGALQPGGTIVEPTSGNTGVGLAIVAQQKGYKCIFVCPDKVSTDKINVLRAYGAEVVVCPTAVDPEHPDSYYNVSDRLVRETPGAWKPDQYSNPNNPLSHYHSTGPELWEQTEGKITHFVAGVGTGGTISGTGRYLKDASEGRVQVVGADPEGSVYSGGSGRPYLVEGVGEDFWPTAYDRTVADEIVAVSDKDSFQMTRRLAKEEGLLVGGSCGMAVVAALRVAERLGPDDVVVVLLPDSGRGYLSKIFNDEWMADYGFLEDSGPSARVADVLSDKAGGSIPSLVHMHPDETVGEAIEVLREYGVSQMPIVKPGAGHPDVMAAEVVGSVVERELLDALFTQRASLQDPLEKHMSAPLPQVGSGEPVGDLMSVLGTADAAIVLVEGKPTGVVSRQDLLSFLAKGGGKQ

SEQ ID NO: 19599 - protein, 428 aa, Streptomyces avermitilis MA-4680
MPSIDVVVAREILDSRGNPTVEVEVGLDDGSTGRAAVPSGASTGAFEAIELRDGDPNRYQGKGVEKAVLAVIEQIGPELVGYDATEQRLIDQAMFDLDATDNKGSLGANAILGVSLAVAHAASEASDLPLFRYLGGPNAHLLPVPMMNILNGGSHADSNVDIQEFMIAPIGAESFSEALRWGAEVYHTLKKVLKTKGLSTGLGDEGGFAPNLESNRAALDLIIEAIKQAGYIPGEQIALALDVAASEFYKDGKYEFEGKSRSAAEMTEYYEELVSAYPLVSIEDPLYEDDWAGWKVITDKLGDKVQIVGDDLFVTNPERLARGIEEGSANALLVKVNQIGSLTETLDAVELAQRNGFKCMMSHRSGETEDVTIADLAVAVNCGQIKTGAPARSDRVAKYNQLLRIEEILDDAAEYAGRSAFPRFRSAN

SEQ ID NO: 19600 - protein, 327 aa, Streptomyces avermitilis MA-4680
MPDKTFPGILSTVGNTPLVELERLLPDFGSRVFGKIERFNPGGSIKDRSALGMLLAGIRSGEVQPGRTVIIESSSGNLAVGLAQICRYFGLRFICVVDGKTTEQNLAILSAFRAEVEVVTERDELTGEFLPVRLRRVRELVAATPDAYWPNQYASLLNPKAHETTMREIEESLDGAVDFLFCSVSTFGTLRGCRDHIRARGLDTTIVAVDALGSAIFGLESTQRLIPGHGASVVPPLMDASAADEVVHISDLECVVACRRLIGREAVLAGGSSGATVAALWKIRHRIPEGSNCVLIFPDGGDRYLDTIYSDAWVNQNFGDVAHLWKD

SEQ ID NO: 19601 - protein, 169 aa, Streptomyces avermitilis MA-4680
MTTDNAATSVLDTEIDALQGGSADLSQYAGKAVLIVNVASKCGLTPQYAGLERLQERYAAQGFTVLGVPCNQFLGQEPGTSEEIAEFCSATYGVTFPLTEKVEVNGDARHALYESLVGFADGEGHTGDIRWNFEKFLIGRDGKVVARFSPQTEPESAEVVTAVERQLAG

SEQ ID NO: 19602 - protein, 499 aa, Streptomyces avermitilis MA-4680
MTPGTPGNPAAPVTPGASDAQRLFIGGEWVAPDGGHYEVIDPATEAVVGWAPEASRDQVHAAAAAAREAFAAWSRTPAEERAAVLGRAAEVMRRNLVPYAELAQAESGATTGTARGMQVGVGAARFRRYARVEPAEEPIAPQINEAGPFGRAAVMGALAVRQPVGVVTCITSYNNPWANPAGKIAPALAMGNTVVVKPAPQDPLSVYRMAEALQAAGVPPGVVNVVSGSGAQAGEAAVDCPDVDMVSFTGSTAVGQRIAEVCGRGMKRQLMELGGKGAALVFEDADLASAVSGIGTTFSFYSGQICTAPTRVLAQRGVYDRVVDQLAAYARRLPVGDPRAPGTVVGPVISAAHRDRVESYVELGRKEGARVVTGGERPPCATGFYVAPTLLADCTTDMRVVREEIFGPVVAVLPFDDEEEGIELANSSDYGLIDYVWSADVARAFRVARRLRAGGVGVNTVGRNMEAPFGGFKRSGVGRDVGSYALHAYSELQAIVWPG

SEQ ID NO: 19603 - protein, 401 aa, Streptomyces avermitilis MA-4680
MADSTATSTPRAVPSHEDRPVYVIGGGPGGLAAAHALRAQGVRAVVLEKSDRVGASWRRHYDRLHLHTTRRLSALPGLPMPRSFGRWVSRDNVVRYLEKYVEHHQLEIVTGVEVSRVEPAPDGTGWLLHATGGRELTGSAVVVATGHNHTPHLPDWPGRDAYTGELLHAGDYRNATPHAGRDVLVVGVGNTGAEIAVDLVEGGASRVRLAVRTAPHIVRRSTAGWAAQFTGIVVRRLPVRLVDLLAGPMARLSVPDLSAQGLPRPDTGLYSRVREGSIPVQDVGLIDAVRKGRVEIVAAVDGFEDGKVVLADGNRIGPDVVIAATGYARALEDLVGHLDVLDGRGRPTVHGARTPRTAPGLYFTGFTNPISGMFRELAIDAEKIAKAVAKALARTTARTPA

SEQ ID NO: 19604 - protein, 349 aa, Streptomyces avermitilis MA-4680
MRGVVFDGKQTQVVDDLEIREPGPGEVAVAISAAGLCHSDLSVVDGTIPFPVPVVLGHEGAGVVEAVGSGVTHVRPGDHVALSTLANCGACAECDRGRPTMCRKAIGRPQQPFARGGRPLYQFAANSAFAERTVVKAVQAVRIPKDIPLPSAALIGCGVLTGVGAVLNRARVEHGDSVLVIGTGGIGLNVLQGARIAGALTIVAVDANPAKEAVARQFGATHFLTSTEGVRDILPTGADHAFECVGRAALIRQAVDLLDRHGQAVLLGVPPATAEASFLVSSLFLDKSILGCRYGSSRPQRDIALYADLYREGRLLLDELVTATYPVEDFEKAAADAHEGRVARAVLTF

SEQ ID NO: 19605 - protein, 499 aa, Streptomyces avermitilis MA-4680
MNDTAHALSTSGTLWELVVRRAGLTPDRTVLLQDDRSLSFGELRDRAERVAAGLYDMGVRPGTVVAWQLPTRIETALLSFALARLGAVQSPVIPFYRDREVGFALRESKAEFFAVPGTWRGFDHTAMARRLGAKGIFEAYDALPDGDPALLPAPPAQGTDVRWIYWTSGTTSDPKGVLHTDRSLIAGGSCLAHALRLTADDVGSMAFPYAHIAGPDYTVMLLLYGFPAVMFEQFALPDALAGYRGHGVTVAGGSTAFYSIFLAEQRRQPDTPVVPTLRLLAGGGAPKPPEVYHRVVREMGVQLTHGYGMTEVPMITMGSPDDTAENLATTEGRPPEGMEIRIVDGEVRLRGEAVCQGYLDPRQTAEAFDEDGFLRTGDLGHLTGSGHLVLTGRLKDVIIRKGENISAKEIEDLLHRHPAVGDVAVIGLPDAERGERVCAVVEQPPGAGALTLDAMTSYLRAEGLSVHKLPEQLEVVDALPRNETLRKVLKYRLRERYAR

SEQ ID NO: 19606 - protein, 483 aa, Streptomyces avermitilis MA-4680
MSTSAPAKVPAPEQPGDRPAYGALDRYFKISERGSTLSREIRGGFATFFAMAYIIVLNPIILSSAKDMYGHQLDYGQLVTATAVTAAFTTLLMGVIGNVPIALAAGLGVNTVVALQLAPRMSWPDAMGMVVLAGLVVMLLVATGLRERVMNAVPLGLRKGISIGIGLFIMLIGLVDSGFVSRIPDAAHTTVPLQLGTDGHLNGWPILVFVLGALLTLALIVRKVPGAILISIVAMTVLAMIINAVAHVPSWGLTTPKWPGNPVASPDFGLIGKVSLFGGFSEVGALTGILFVFTVLLSCFFDAMGTIMGVSDEAKLTDAEGNMPGINKVLFVDGIAVAAGGASSSSATTCFVESTAGVGEGARTGFANIITGGLFAVALFLTPVATMVPSQAATPALLAVGFLILSNSVKEIDWADYTIAIPAFVTMMMMPFTYSITNGIGMGFITFVVLRLAAGRGREIPVAMYVVAAVFGFYYLMPALGLT

SEQ ID NO: 19607 - protein, 375 aa, Streptomyces avermitilis MA-4680
MTVTTDATDRAAQILSRPVTLNGLTVPNRIVMAPMTRQFSPGGIPGEDVASYYARRAAAGVGLIVTEGTYVGHESAGQSDSIPRFHGEEQLAGWSKVADAVHAAGGTIVPQLWHIGMVRGAGEPPFADAPPVGPSGIGTEGAEVTGKAMTQQDLDDVIEAFAKAAADAERIGFDGVELHGAHGYLIDQFLWAGTNRRTDAYGGDPVARTKFAAEIVAAVRSAVSPSFPVLFRYSQWKQQAYDARLAETPEELEAILAPLAAAGVDAFHASTRRYWQPEFDGSDLNLAGWTKKITGKPAISVGSVGLNGEFLKAFQGEGSTVRGIDDLLDRLESGEFDLVAIGRALLQDPEWAAKVLAGRFSELAAYDASSLKTLH

SEQ ID NO: 19608 - protein, 340 aa, Streptomyces avermitilis MA-4680
MTQQDNTLPKRTLPKRTLGTQGLEAGAIGLGTMGMTMAYGAGDEPGGIATIHRAYELGVTLFDTAELYGMGTGSNEQLLGRAVKGFRDEVVLATKFGFDLSDPANVGVALDSRPGHIREVTENSLRHLGTDHIDVLYQHRVDPDVPIEDVAGTVGELIAEGKVRYFGLSEAGPEIIRRAHAVHPVSVLQTEYSVFERAVEADVLPVVRELGIGFVPYSPLGRGFLTGAVRPASAYPADDMRSWDDRWQPGNYEKNVAAVSELTTLAAAKGISVTQLALAWLLAQGDDIVPIPGTRSPQRLAENVAAAHVTLTPADLVRVQEILPKGAAGSRYPEVMMPSW

SEQ ID NO: 19609 - protein, 253 aa, Streptomyces avermitilis MA-4680
MADAPYKLILLRHGESEWNAKNLFTGWVDVNLNEKGEKEAVRGGELLKDAGLLPDVVHTSLQKRAIRTAQLALESADRHWIPVHRSWRLNERHYGALQGKDKAQTLAEFGEEQFMLWRRSYDTPPPPLADGSEFSQSDDPRYASIPPELRPKTECLKDVVNRMLPYWYDGIVPDLLTGRTVLVAAHGNSLRALVKHLDGISDEDIAGLNIPTGIPLSYELDTDFKPLNPGGTYLDPDAAAAAIEAVKNQGKKK

SEQ ID NO: 19610 - protein, 336 aa, Streptomyces avermitilis MA-4680
MTRNRASADGVPQPLMATYYAQRASAGLIIAEAATPNAVGQTYPNITAIHDATHVAGWRGVTDAVHAAGGRMFLQLQHGGRVGHPATSGLTPVAPSPVPLPETIFTPSGHRPSVVPREMTAADIRTTVADFAAAARNAIDAGFAGVEVHSANGHLLHQFLATNTNRRTDAYGGSVAARIRFAVEVTEAVADAIGAERVGVRISPGTTVNGVEEDDTELLYPAFVEALAALGPAYLHLVHADPDQPLFRHIRENWPTTLMANPVLGPELPADGGAHAAGRLLTAGADLIALGRPFLANPDLVTRLRTGAPVNPVRDRFMMYVGGERGYTDYPTLTVA

SEQ ID NO: 19611 - protein, 310 aa, Streptomyces avermitilis MA-4680
MPASYAYLGPEGTFTEVALRTLPEAATRELVPMVSVPAALDAVRNGEAEAAFVPIENSVEGGITTTLDELVAGEPLMIYREVLLSITFALLVRPDTKLSEIKTVTAHPAAQPQVRNWMKANLPDVVWESAASNADGARLVQEGRYDAAFAGEFAAAKYGLVPLETGIHDAENAQTRFVLVGRPARPAAPTGADKTSIVLWQRDDHPGGLRDLLGEFAVRGVNLMLLQSRPTGAGIGNYCFCIDAEGHISDRRVAETLMGLKRICLQVRFLGSYPRAGVRAEDVPTALPGTSDDEFVKASDWVARCQDGRF

SEQ ID NO: 19612 - protein, 291 aa, Streptomyces avermitilis MA-4680
MELGLVGLGKMGGNMRERIRRAGHTVIGYDRNPDVADVHSLEELVGKLKGPRVVWVMVPAGAATQSTVDELGELLEPGDIVVDGGNSRWTDDEKHAEELAAKGIGFVDCGVSGGVWGLQNGYALMYGGDAENIAKVQPIFDALKPEGDFGAVHAGKVGAGHFSKMVHNGIEYAMMQAYAEGWELLEKVDSVTDVREVFRSWQEGTVIRSWLLDLAVNALDGDEHLEKLRGYAEDSGEGRWTVEAAIDNAVPLPAITASLFARFASRQDDSPQMKMIAALRNQFGGHAVEKK

SEQ ID NO: 19613 - protein, 326 aa, Streptomyces avermitilis MA-4680
MYAITIPEPGGPEALVWTEVPDPEPGEGEVLVEVVASAVNRADLLQRQGFYAPPPGASPYPGLECSGRIAALGPGVSGWAVGDEVCALLAGGGYAEKVAVPAGQLLPVPEGIGLRQAAALPEVTCTVWSNVFMVAHLRPGETLLVHGGSSGIGTMAIQLAKAVGAKVAVTAGTKEKLDFCAELGADVLVNYREQDFVEEVRRATDGAGADVILDNMGAKYLGRNVDALAVNGRLAIIGMQGGAKGELNIGALLHKRGAVTATSLRARPLGEKAAIVAAAREHVWPLIASGRVRPIVDRELPMSDAATAHRVLEESGHIGKVLLVVP

SEQ ID NO: 19614 - protein, 396 aa, Streptomyces avermitilis MA-4680
MSTKDFIEKDYYKVLGVPKDATEAEIKKAYRKLAREFHPDANKGNAKAEERFKEISEANDILGDTKKRKEYDEARTLFGNGGFRPGPGAQGGSFNFDLGDLFGGGAQQGGGAGGGFGGGIGDVFGGLFNRGGAGPGTGTRTQPRRGQDIESEVTLSFTEAVDGATVPLRMSSQAPCKACSGTGDANGTPRVCPTCVGTGQVARGSGGGFSLTDPCPDCKGRGLIAENPCEICKGSGRAKSSRTMQVRIPAGVSDSQRIRLRGKGAPGERGGPAGDLYVVVHVDAHPVFGRKGDNLTVTVPVTFAEAALGGEVKVPTLGGPAVTLKLPPGTPNGRTMRARGKGAVRKDGTRGDLLVTVEVTVPKDVSGKARDALEAYREATAGEDPRAELFQAAKGA

SEQ ID NO: 19615 - protein, 398 aa, Streptomyces avermitilis MA-4680
MAAMTSSARPLLNRRLAEFGTTIFAEMSALAMSTGAINLGQGFPDTDGPEEIREAAVRALRDGRGNQYPPGPGVPELRTAIAAHQQRRYGLTYDPDTEVLVTAGATEAIAATLLALLEPGDEVIAFEPYYDSYAACIAMAGGTRVPVTLRPHPEDGRFRLDLDELRDAVTDRTRLLLVNTPHNPTGTVLTREELTAIAELAVERDLLVVTDEVYEHLVFDDAEHLPLATFPGMRERTVSISSAGKTFSFTGWKVGWVTGAPGLVTAVRSAKQFLTYVASGPFQYAVAEALALPDTYFEAFRADMLAKRDLLAAGLTAAGFEVFRPAGTYFITTDIRPLGERDGFAFCRALPERAGVVAIPNAVFYDHREAGAPFVRFAFCKRTDVLEEAAKRLGTLRG

SEQ ID NO: 19616 - protein, 451 aa, Streptomyces avermitilis MA-4680
MTPQPNPQVGAAVKAADRAHVFHSWSAQELIDPLAVAGAEGSYFWDYDGRRYLDFTSGLVFTNIGYQHPKVVAAIQEQAASLTTFAPAFAVEARSEAARLIAERTPGDLDKIFFTNGGADAIEHAVRMARIHTGRPKVLSAYRSYHGGTQQAVNITGDPRRWASDSASAGVVHFWAPYLYRSRFYAETEQQECERALEHLETTIAFEGPGTIAAIVLETVPGTAGIMVPPPGYLAGVRELCDKYGIVFVLDEVMAGFGRTGEWFAADLFDVTPDLMTFAKGVNSGYVPLGGVAISGKIAETFGKRAYPGGLTYSGHPLACAAAVATINVMAEEGVVENAANLGARVIEPGLRELAERHPSVGEVRGVGMFWALELVKDRETREPLVPYNAAGEANAPMAAFGAAAKANGLWPFINMNRTHVVPPCNVTEAEAKEGLAALDAALSVADEYTV

SEQ ID NO: 19617 - protein, 486 aa, Streptomyces avermitilis MA-4680
MSSYFTDLAQQYIGGEWRPGTGSWDIIDFNPYDGEKLASITIATVDEVDEAYRAAAAAQKEWAATNAYARRAVFQRALRLIEDREAEITEAIIAELGGTHLKAGFELHLAKQFLLESINLALRPEGRIIPSPVDGKENRLYRVPVGVVGVISPFNFPFLLSLKSVAPALALGNGVVLKPHQNTPIVGGSLIAKIFEDAGLPGGLLNVVITDIAEIGDAFLEHPVPKVISFTGSDKVGRHVATVCAAQFKRSVLELGGNSALVVLEDADIDYAVDAAVFSRYVHQGQVCMAANRVLVDRSIEAEFTEKFVAKVKTLKSGDPRDPQTIIGPVINSSQADAISGAVDQAIADGAIALVHGTTTDNLVEPSVLTGLAADAPILQEEIFGPVALLIPFEGEEEAVRIVNDTPYGLSGAVHTADVERGVAFAKQIDTGMFHVNDGTVHDEPLVAFGGEKSSGIGRLNGEATVESFTTQKWISVQHGRSFFPF

SEQ ID NO: 19618 - protein, 186 aa, Streptomyces avermitilis MA-4680
MRVDAKDMGTDLKSVLITKEEIDAKLAELAAKIDAEYAGKDLLIVGVLKGAVMVMADLARALSTPVTMDWMAVSSYGAGTQSSGVVRILKDLDTDIKGKHVLIVEDIIDSGLTLSWLISNLGSREPASLKVCTLLRKPEAAKVAIDVEWVGFDIPNEFVIGYGLDYAEKYRNLPFVGTLAPHVYGG

SEQ ID NO: 19619 - protein, 469 aa, Streptomyces avermitilis MA-4680
MAARTKTAKDRPSYRCTECGWQTAKWLGRCPECQAWGTVEEYGTPAVRTTTPGRVTTSALPIGQVDGRQATARSTGVPELDRVLGGGLVPGAVVLLAGEPGVGKSTLLLDVAAKAASDEHRTLYVTGEESASQVRMRADRIKAIDDHLYLAAETDLAAVLGHLDAVKPSLLIMDSVQTVASPEIDGAPGGVAQVREVAGALIRASKERGMSTLLVGHVTKDGTIAGPRLLEHLVDVVLHFEGDRHARLRLVRGVKNRYGATDEVGCFELHDEGITGLADPSGLFLTRRAEPVPGTCLTVTLEGRRPLVAEVQALTVDTQIPTPRRTTSGLETSRVSMMLAVLEQRGRISALGKRDIYSATVGGVRLSEPAADLAIALALASAASDAPLPKNLVAIGEVGLAGEVRRVTGVQRRLAEAHRLGFTHALVPTDPGKIPSGMKVLEVADIGDALRVLPRSRRREAPRDEEDRR

SEQ ID NO: 19620 - protein, 367 aa, Streptomyces avermitilis MA-4680
MDPVRLALTRRLVDAFGLDREIEVVSAKPAGESTLRLVHREDYIEAVKAASAEPDAADGKYGLGTLDDPAFAGMHEVSALIAGQSVGAAEAVWHGDALHAVNFAGGLHHAMPGGASGFCIYNDASLAIARLLELGAERVAYIDVDVHHGDGVQAAFWEDPRVLTISLHEHPQTLFPQTGWPTETGADRAEGSAVNVALPAGTGDAGWLRAFHAVVPELIADFRPQVLVTQHGADTHFEDPLAHLAVSLDAQRAVQLACHDLAHQYADGRWVALGGGGYAVVDVVPRSWTHLVAIAAGRPLEPESMIPESWRQEVFARTRQLAPMRMTDGRWPVSWADWESGYDPADRLDQAVLATRKAAFPLRGMLP

SEQ ID NO: 19621 - protein, 438 aa, Streptomyces avermitilis MA-4680
MACVSYPYEAPVSQTLFERAAAVTPGGVNSPVRAFRAVGGTPRFMVSGNGPYLTDADGRTYVDLVCSWGPMILGHSHPEVIAAVQEAVARGTSFGTPGEGEVALAEEIVARVEPVEQVRLVSSGTEATMSAIRLARGFTRRAKVIKFAGCYHGHVDSLLAAAGSGLATFALPDTPGVTGAQAGDTIVLPYNDLDAVREAFRAHPGEIACVITEASPGNMGVVPPAPGFNQGLKDACAENGALYISDEVMTGFRTSKAGWYGVDGVRPDLMTFGKVMGGGFPAAAFGGRRDVMAHLAPAGPVYQAGTLSGNPVATAAGLAQLRLLDDAAYAKVDAVSAEIRTLVTDALTKEGVAHRLQNASNMFSVFFTDRPVNNYEDAKGQESFRFTAFFHSLLAQGVYLPPSSFESWFVSTAHDEQAVQRIADALPAAARAAAEATA

SEQ ID NO: 19622 - protein, 220 aa, Streptomyces avermitilis MA-4680
MRIVLVGPPGAGKGTQAAFLAKNLGIPHISTGDLFRANISQQTELGKLAKSYMDEGNLVPDEVTIAMAKDRMEQPDAVNGFLLDGFPRNVKQAEALDEMLKSEGMKLDAVLDLEVPEDEVVKRIAGRRICRNDSAHVFHVSYKPPKQEGVCDVCGGELYQRDDDSEETVRRRLEVYHTQTEPIIDYYRAQGLVVTISALGPVEEVTQRAMDALKREDASK

SEQ ID NO: 19623 - protein, 476 aa, Streptomyces avermitilis MA-4680
MRTAYSVETVRSAERSLMARLPEGALMQRAAAGLAAACAQLLGRVYGRRIVLLVGSGDNGGDALYAGARLARRGAGVTAVLLAAGRAHASGLAALRRAGGSVTGTGPAEELIRRADLVVDGIVGIGGKGGLRPDAALLAESVERSGAAVVAVDLPSGVDADTGEVPGAAVRADLTVTFGTHKPGLLIDPAREYAGSVRLVDIGLELPDGPDLEALQHADVARLLPVPGAESDKYRRGVVGIAAGSARYPGAAVLAVAGALRGGAGAVRYVGPAGDAVLARFPETLVSDKGPKQAGRVQAWVVGPGAGDDAPVVAEVLAADVPVLVDADGLRLAGRDAVRGRTAPTLMTPHAGEAAALLGVSREEVERARLVSVRELAGRYGATVLLKGSTTLVADSGGGAVRVNSTGTSWLATAGSGDVLSGLAGSLLAAGLPALDAGSVAAYLHGLAGRYAADGAPMGAHDLAETIPEAWRDVRD

SEQ ID NO: 19624 - protein, 502 aa, Streptomyces avermitilis MA-4680
MTANVDGVPAKFATLGLTYDDVLLLPGASDMAPDQIDTASHVSKNVRVNIPLLSAAMDKVTEARMAIAMARQGGVGVLHRNLSIEDQANQVDLVKRSESGMVTDPITVHPDATLAEADAICAKFRISGVPVTDGNGKLLGIVTNRDMAFETDRSRQVREVMTPMPLVTGKVGISGNDAMQLLRRHKIEKLPLVDDAGILKGLITVKDFTKAEKYPNAAKDAEGRLLVGAAVGVAGDAFERAQALIEAGVDFIVVDTAHGHSRLVGDMVAKIKSNSGGVDVIGGNIATRDGAQALIDSGVDGIKVGVGPGSICTTRVVAGIGVPQVTAIYEASLAAKEAGVPVIGDGGLQYSGDIAKALVAGADTVMLGSLLAGCEESPGELLFINGKQFKSYRGMGSLGAMQSRGEQRSFSKDRYFQEGVASDEKLVPEGIEGQVPYRGPLSAVVHQLVGGLRQSMFYVGGRTVPELQDNGRFVRITSAGLKESHPHDIQMTVEAPNYSRSK

SEQ ID NO: 19625 - protein, 374 aa, Streptomyces avermitilis MA-4680
MTEIEIGRGKRGRRAYAFDDIAVVPSRRTRDPKEVSIAWQIDAYRFELPFLAAPMDSVVSPATAIRIGELGGLGVLNLEGLWTRYEDPQPLLDEIAELDADTATRRLQEIYAAPIKEELIGQRIKEVRDSGVVTAAALSPQRTAQFSKAVVDAGVDIFVIRGTTVSAEHVSGAAEPLNLKQFIYELDVPVIVGGCATYTAALHLMRTGAAGVLVGFGGGAAHTTRNVLGIQVPMATAVADVAAARRDYMDESGGRYVHVIADGGVGWSGDLPKAIACGADSVMMGSPLARATDAPGRGHHWGMEAVNEELPRGKKVDLGTVGTIEEILTGPSHIPDGSMNIFGALRRAMATTGYSELKEFQRVEVTVADAQHKR

SEQ ID NO: 19626 - protein, 322 aa, Streptomyces avermitilis MA-4680
MPKTQSGTSNRTRSTTAGGSARGKWNAGDIPDQTGRTAVVTGANSGLGIATVEALARAGAHVVLAVRDLERGEAAAAGVHGSVEVRRLDLADLASVREFAAGWQGDLHLLINNAGVMNIPEASTKDGFEMQFGTNHLGHFALTNLLLPRIKDRVVTVSSGAHRMPGSPYIHFDNLNLTGEYAPLTAYSQSKLANLLFTLELQRRLAEAASPVRALAAHPGWAATNLQSHDGSALRRALMRVGNRFIAQDNRAGALPTLYAAVQDLPGASYVGPDGFGEMRGGPTLVGRSAAAGDPVSARRLWTASEDLTGVTFPRLTAAVSA

SEQ ID NO: 19627 - protein, 442 aa, Streptomyces avermitilis MA-4680
MNPADLGLPVDVPSTALFTDQYELTMLQAALAAGTAERRSVFEVFTRRLPEGRRYGVVAGTGRVLDAVENFRFDAALLGFLRERRIVDEPTLEWLASYRFRGDIWGYPEGEVYFPGSPLLRVEGSFAECVLLETVILSILNHDSAIAAAASRMSSAAGARPLIEMGARRTHELAAVAAARAAYVGGFATTSDLAAGFRYGIPTVGTSAHAFTLLHDTERDAFRAQVDSLGRGTTLLVDTYDVAEAVRMAVEIAGPELGAVRIDSGDLLLVAHRVRQQLDDLGATETKIVVTSDLDEYAIASLAAAPVDAYGVGTQLVTGSGHPTCSMVYKLVARAHSADPAAPLEPVAKKSTGGKTSIGGRKWAARRLDEHGVAEAEVIGTGPVPAGLEGRQLLVELIKGGQVVARESLDVVRDRHAAARAGLPLSANQLSRGEPVIPTEYV

SEQ ID NO: 19628 - protein, 483 aa, Streptomyces avermitilis MA-4680
MTSSQVDKQYDGNGAVGGDAPEEGYERGLGSRQVQMIAIGGAIGVGLFLGAGANIAKAGPSLILMYALAGVIIFFIMRALGELLLYRPVSGSFAEYSREFLGPFFGYFTGWTYWLMWVVTGMAELTAAAIYVHYWFPAVPQWVTALVFLVVLFVANLISVKLFGEIEFWFSMVKVTALIGMIVIGLGVLTFGFSSAGDTASVANLWQFDGFFPKGIGSSLMTLQGVMFAYLAVELVGVTAGESEDPEKTLPKAINTLPWRIALFYVGALTVILCVVKWTEFAPGVSPFVKAFAMIGIPAGAGIVNFVVLTAALSSCNSGMYSTGRMLRTLADNGEAPRVFSKLSASKTPAFGITISVLFMGIGVILNYVVPEKAFGYVTSVATAAGIWTWLMILVSHVLYRRAVDAGRLPASSFPAPGGAKCSWVAIVFLLFVTGLIAYDADSRVCLYVMAVWAAALAIGWYVLKARNPQVAERHEPKFEKVG

SEQ ID NO: 19629 - protein, 316 aa, Streptomyces avermitilis MA-4680
MRYDSPLAAVGNTPLVRLPRLSPSEDVRIWAKLEDRNPTGSVKDRPALHMIEQAEKDGRLTPGCTILEPTSGNTGISLAMAAKLKGYRIVCVMPENTSQERRDLLGMWGAEIVSSPAAGGSNTAVRVAKELAAEHPDWVMLYQYGNPDNAGAHYATTGPEILADLPSVTHFVAGLGTTGTLMGVGRYLREQKPDIKIVAAEPRYDDLVYGLRNLDEGFVPELYDASVLTTRFSVGSADAVTRTRELLQQEGIFAGVSTGAALHAAIGVGNKAVKAGETADIVFVVADGGWKYLSTGVYTAATTEEAIATLQGQLWA

SEQ ID NO: 19630 - protein, 501 aa, Streptomyces avermitilis MA-4680
MSASAPQAHGPAATGTVTTDVPARLDRLPWSRWHWMIVIGLGTVWILDGLEVTTVGNIAGRLSEDGSGLSITSAQVTGVAAALYVAGACAGALFFGWLTDRFGRKKLFMVTLVVYLSATALTALSFNSWWFFTFRFLTGFGIGGEYAAINSAIDELIPAKYRGRVDLIINGSYWLGAIGGALLSIVMLDTSIFPKDLGWRLTFALGVVLGLVILLVRRHVPESPRWQFIHGRGEDAEALVSSVEREIEQEKGEPLPRAESEITIEQRKSIGFGLIAKTVFGRYPKRAVLGLALFIGQAFLYNAITFGFGAILTTFYDVPTGGTGYYFAVIAAGNFIGPLLLGKLFDTVGRRIMIASTYLLSGLLLFGTAWLFDRGSLSAMTLTACWCAVLFFASAGASSAYLTVSEVFPMETRAMAIAFFYALGTAAGGISGPLVFADLTESGVVGDTVLAFQIGAGLMCAAGLVAAFLAVNAERRSLEDIAEPLSVAQTTAPAPASASGT

SEQ ID NO: 19631 - protein, 271 aa, Streptomyces avermitilis MA-4680
MPADTTPSTQTAGPTVDGDELIRFEKVTKSFGSHTVLDSLDFSVDSGKHVTLIGPSGSGKTTILRLLMTLTKPDSGTIRVNGDYLTHEEKNGALVPAGEKHVREVRKNIGMVFQQFNLFPNMKVLRNVTEAPVTVLGLAKDEAEQRARELLDLVGLADKADAYPTQLSGGQQQRVAIARALAMRPQVLLLDEVTSALDPELVAGVLDVLRDIARSTDITMLCVTHEMNFARDISDQVLMFDAGHVIESGSPEKIFGDPDHERTREFLSAVR

SEQ ID NO: 19632 - protein, 482 aa, Streptomyces avermitilis MA-4680
MASAETSAAPVSPVTFPPAFLWGAATSAYQIEGAVREDGRTPSIWDTFSHTPGKTAGGETGDIAVDHYHRYRDDVALMAELGLGAYRFSVSWSRVQPMGRGPAVQRGLDFYRRLVDELLAHGVKPALTLYHWDLPQELEDAGGWPERDTAYRFAEYAQIVGDALGDRVEQWITLNEPWCSAFLGYGSGVHAPGRTDAAASLRAAHHLNLAHGLGTSALRAAMPARNTVAVSLNSSVVRTVSDSPADVAAGRRIDDLANGVFHGPMLHGAYPAGLFAATASVTDWSFVQDGDLEAVNQPLDALGLNYYTPTLVSATESAPAGPRADGHGASSFSPWPGADDVVFHLTPGERTEMGWSIDPTGLHELIMRYTREAPGLPLYITENGAAYDDKPDPEGRVHDPERIAYLHGHLTAVRRAITDGADVRGYYLWSLMDNFEWAYGYGKRFGAVYVDYATLARTPKSSARWYAQAARTGTLPGATAAE

SEQ ID NO: 19633 - protein, 322 aa, Streptomyces avermitilis MA-4680
MSSNETPRGPVDSSRVPRYAGPATFARLPRLDEVGTADVAVVGVPFDSGVSYRPGARFGGNAIREASRLLRPYNPAQDASPFALAQVADAGDIAANPFNINEAVETVEAAADELLGTGARLMTLGGDHTIALPLLRSVAKKHGPVALLHFDAHLDTWDTYFGAEYTHGTPFRRAVEEGILDTEALSHVGTRGPLYGKQDLTDDEKMGFGIVTSADIYRRGADEVADQLRQRIGDRPLYISIDIDCLDPAHAPGTGTPEAGGMTSRELLEILRGLASCNLVSADVVEVAPAYDHAEITAVAASHTAYELTTIMSRQIAEARNK

SEQ ID NO: 19634 - protein, 316 aa, Streptomyces avermitilis MA-4680
MAYDLITMGRIGVDLYPLQTGVPLPQVTSFGKFLGGSATNVAVAAARLGRSTAVVTRTGDDPFGTYIHEALRGFGVDDRWVTQVAGLPTPVTFCEIFPPDDFPLYFYRQPKAPDLEIDAHELDLDEIRAARIFWMTGTGLSEEPSRTATLAALAHRAKSGTTVFDLDWRPMFWADPAQARPFYTEALRHTTVAVGNVDEVEIATGERDPHSAARALLAAGVELAVVKQGPKGVLAVHRDGTTAEVPPLPVKVLNGLGAGDAFGGSLCHGLLDGWDLERLMRYANAAGAIVASRLECSSAMPTPAEVEDALTAGAVL

SEQ ID NO: 19635 - protein, 462 aa, Streptomyces avermitilis MA-4680
MSSRTTLDTAPETSAADAPLSHGLKQRHLSMIALGGVIGAGLFVGSGAGIAAAGPSIVIAYSVSGLLVMLVMRMLGEMSAAYPSSGSFSAHAERAIGPWAGFTAGWSFWVLLCTAVGLEGIGAAKIVTGWLPGTPEWGWVALFMVVFCVANLAAVKNFGEFEFWFAALKVGAISLFLVLGVLAMTGVLPGTDSPGASNLHDFLPNGSEGLVIGLLASVFAYGGLETVTIAAAESENPVQGVARAVRTAMWRIALFYIGSMAVIVTLVPWDSKEVVEKGPYVAALDHLGIPGAGQLMNVVVLVALLSAMNANIYGSSRIAYSLVERGQGPKALGRVSGGVPRIAVLVSCVFGFVCVVLSYWRPNDVFPWLLNMIGAVILVVWIFIAVSQLLLRRKVEREAPEKLVVRMWAYPVLTWVALAGMAAIFILMARQPDTRVQLYSTGAMTLVLAAVGYAWQRARARA

SEQ ID NO: 19636 - protein, 494 aa, Streptomyces avermitilis MA-4680
MTSQPTLSKAENGPDRPGEPGGGLQAGLKNRHLSMIAIGGVIGAGLFVGSSTGIATAGPGILLSYALVGTLVVLVMRMLGEMSAANPTSGSFSAHADRALGRWAGFSIGWLYWFFWVVVLAVEATAGAKILEGWMPGVPQWGWALIVMVVLTATNLVSVGSYGEFEFWFAGIKVVAIGAFIVVGGLAIFGVLPGVDAPKAGLGNLTDSGGFLPHGPGAILTGVLLVVFSFMGSEIATLAAGESEDPQRAVTKSTNSIIWRIGVFYLGSILVVVSLLPWNDPSIKDKGSYVAALDSLGIAHAGQIMNFIVLTSVLSCLNSGLYTASRMAFSLGQRGDAPKAFARTTSRGVPLAAIVVSVVFGFVAVFFNYKFPDSVFLFLVNSSGAVALFVWLVICFSQLRMRKIIQRESPEKLVVKMWLYPYLTWATAALIVFVLGYMLTDTEHDGRETVLLSLLVAAVVLVIAVVKQKLDGSRAVAAAGADEPAVAEAVADAH

SEQ ID NO: 19637 - protein, 315 aa, Streptomyces avermitilis MA-4680
MGLRKRRREIDERASGRIPGPIPGRTPLASGADGADPGAYGAVPGVDRTAPGVDRTAPSVGRAVSGADWAVELRGVRRRYGRGGSAVHALRGVDLALARGSFTAVMGPSGSGKSTFLQCAAGLDRPSGGTVHLGGTDITGLSENKLTALRRSRLGFVFQAFNLLPSLTVEQNVVLPLRLAGHRPDRRRAAEVLAQVGLQDKGRRRPGQLSGGQQQRVAIARALVTRPDVVFADEPTGALDTTTAAEILGLLRQAVDVHGATVVMVTHDPTAAAWADRVLFLADGSIVDHLERATAPRIAARVAALTTPSFEGAAA

SEQ ID NO: 19638 - protein, 378 aa, Streptomyces avermitilis MA-4680
MATDYYAVLGVRRDASQDEIKKAFRRLARELHPDVNPDPKTQERFKEINAAYEVLSDPQKKQVYDLGGDPLSQSGGGGAGGFGAGGFGNFSDIMDAFFGTASQRGPRSRTRRGQDAMIRVEIELDEAAFGTTKDIQVETAVVCTTCSGEGAAPGTSAQTCDMCRGRGEVSQVTRSFLGQVMTSRPCPQCQGFGTVVPTPCPECAGDGRVRSRRTLTVKIPAGVDNGTRIQLAGEGEVGPGGGPAGDLYVEIHELPHQTFQRRGDDLHCTVTIPMTAAALGTKVPLETLDGMEEVDIRPGTQSGQSIPLHGRGITHLRGGGRGDLIVHVEVTTPTKMDPEQERLLRELAKLRGEERPTGQFQPGQQGLFSRLKDAFNGR

SEQ ID NO: 19639 - protein, 441 aa, Streptomyces avermitilis MA-4680
MIRRMATNPISQFPAGFLWGVSTSAHQIEGAADEREPSVWDAFTAEPGRVKDGSTAAVACDHYHRYAEDVALLADLGVDAYRFSVSWPRVNSPGGLDFYDRLVDELCAAGVRPVPTLFHWDLPLALDWLDRDTAARFAEYAARVAERLGDRVTKWITLNEPAEHTLLGHALGAHAPGRQLLFDALPAAHHQLLAHGLAVRALRAAGVTDIGIANSHGPTWPASQEPADLEAAAFYDLLLNRLFSDPLLLGRYPEGIGELMPKGSAGIESDLKVIAEPIDWYGINYYAPTKVGAPQGAEIEFGGLTLPAELPFSVREIEGHPVTDFGWPVVPQALTELLTGFRERFGDRLPPIVITENGCSYEGIDDQERIAYLDGHVRALHRAVEAGVDVRGYFVWSLLDNFEWAEGYERRFGLVHVDYDTLERTPKASYGWLRDALRARR

SEQ ID NO: 19640 - protein, 342 aa, Streptomyces avermitilis MA-4680
MPGSLRRPSVVSRVSDLIGYTPLLELAATETGSRLLLKLEMFNPTGTAKIRMARQMITDAEERGELRAGGRIIESTSGNTGLGLAVIAAERGYTFTAVVDNHAAVDKLRAMKALGAELVHVVDDGTDELATAAREELAEEMARGQDNTIFTEQHNNPSNGVGYFPVAHELHEALDGRLDVLVGAVGTGGGLCGTARELRTLIPGFTTIGVEPKGSIAFGGPAHDYYQSGTGTPEGAPIGALVDFGLIDEGAKVGDVEAFATCRAVARTGLLIGGSAGGVVHEALTRLPGLPPGTTMVALINDGGEKYMDTVFNDDWMRARDLLDPAAEREVDELLTKLRGNR

SEQ ID NO: 19641 - protein, 338 aa, Streptomyces avermitilis MA-4680
MRTRPLGSTGPQVSALGLGCMGMSSLYGEADRAESVATIHAALEAGVTLLDTGDFYAMGHNEMLIGEALRTAPAGLREQALTSVKFGALRGPDGNWIGYDGRPAAVQNFAAYSLQRLGVDHIDVYRIARVDPDVPIEETVGAIAELVEKGYVKHIGLSEVGAETIRRAAATAPISDVQIEYSLISRGIEDRILPTTRELGIAITAYGVLSRGLISGHFTRDRQLAATDFRAFSPRFQGENLDHNLTLVEALRKIAEQKGVSVAQLAIAWVLSRGQRHNTDIVPLIGARTRERLSEALGALEVTLDDADLNAIEAAVPADSAAGERYPQAQMAHLDSER

SEQ ID NO: 19642 - protein, 308 aa, Streptomyces avermitilis MA-4680
MADWNTSDIPDQRGRVVVVTGANSGLGYVTARELARKGARVVLACRSEARGAEAGDRLAAELPGAEVELGRLDLGDLGSVRDFAAWFPYERLDLLVNNAGVMALPYGTTADGFETQFGVNHLGHFALTGLLLPTLLGTPGARVVTVSSGMHALANIDIHDLNGERRYRRWIAYARSKTANLLFTHELTRRLAAHGSEVLAAAAHPGYAATNLQTAGVRMEGRRAAERIVELGNRVLAQPAEAGALPVLYAATAPEVRPDSFTGPSFAGWRGAPAPSWRAPWTLNDAMGERLWSASEQLTGVTYEALKV

SEQ ID NO: 19643 - protein, 421 aa, Streptomyces avermitilis MA-4680
MVDADQTFVIVGGGLAGAKAAETLRAEGFTGRVILICDERDHPYERPPLSKGYLLGKEERDSVFVHEPAWYARNDIELHLGQTVDAVDRAAKTVRFGDDGTLVHYDKLLLATGAEPRRLDIPGTDLAGVHHLRRLAHAERLKGVLAALGRDNGHLVIAGAGWIGLEVAAAAREYGAEVTVVEHGPTPLHGVLGPELGQVFAELHREHGVRFHFGVRLTEIVGQDGMVLAARTDDGEEHPAHDVLAAIGAAPRTGLAEAAGLTLADRAHGGGIAVDGRLRTSDPDIYAAGDVAAFHHPLFDTRLRVEHWANALNGGPAAARAMLGRDLTYDRMPYFFSDQYDLGMEYSGWAPPGTYDQVVIRGDAGKRQFIAFWVKEGRVLAGMNVNVWDVTEPIQALIRSGTPVDTEALANPHVPLETLTP

SEQ ID NO: 19644 - protein, 320 aa, Streptomyces avermitilis MA-4680
MSPRQITVLGECVADAFTEPANASNELALRVLPGGGPANTAVALARLGTPARFLARLSGDVFGRLFRAHLEESGVDLSYAVAAAEPSTLAVAELDATGQAAFSFHAQNTADWQWTPGELAGVDLSETACVHTGSLALVREPGGAAVEEFLAAAAPRATISIDPNVRPLLVRPEVYRARLAHWCALADILRLSEDDLELLLPGTPPEQACDIWHAAGVRLVVITLGAGGALASLDGERLRVPAVATRVVDTVGAGDSFTAGLLHHLGARGLLGGRLTDLGLDEVAEACRFGARVAALTCSVAGPNPPWRDQLAQLTTAGGA

SEQ ID NO: 19645 - protein, 318 aa, Streptomyces avermitilis MA-4680
MGRHRAACSRPMGRGRGSAVQTQTRMLDQVRTTDGRLLKVEISGDPRGRPVFLLHGMPGSRVGPRPRPMFLYQRGARLISYDRPGYGGSDRKAGRRVADVVQDVAEVADALELDRFAVAGRSGGAPHALACAALLPDRVTRAAALVTLAPRDAKGLDWFAGMAPSNVHEFRTAFNDPERFVARLIPRSAKIRSNPARLLEELRGDLTADDRQIVADGAIRSMLLRNYHEALRSSPYGWVDDALALTGPWGFDPADIRVPVLLWHGAQDVFSPAAHSTWLAGRIPRATAVLEPAAAHFAALRALPAVLTWLLADAARQG

SEQ ID NO: 19646 - protein, 489 aa, Streptomyces avermitilis MA-4680
MSSLFPALSGGAAERRPALRFGDRALTYAELAAAAGCLAARISGSGRVAVWATPTLETAVGVVAALLAGVPAVPLNPRSGESELGHILADSAPSLILAAAGDELPSAVRGLERVDVEVNAPAAGAPAPATGSVTDDAPALIVYTSGTTGPPKGAVLPRHAIATTLDALADAWQWTADDVLVHALPLFHVHGLILGILGPLRRGGSVRHLGRFGTDGVARELNDGATMVFGVPTMYHRIAEALPDDPGLAKALGRARLLVSGSAALPVHDHERIAAATGRRVIERYGMTETLMNTSVRADGEPRAGTVGVPLPGVQLRLVEEDGSPVPSCDGESVGEIQVRGPNLFTEYLNRPDATAAAFTEDGWFRTGDMAVRDADGYVRIVGRKATDLIKSGGYKIGAGEIENALLEHPGVREVAVTGEPDDDLGERIVAWVVPADPGTPPDADELAGHVARRLAPHKRPRTVRFLDSLPRNDMGKIMKRALPQGSGH

SEQ ID NO: 19647 - protein, 338 aa, Streptomyces avermitilis MA-4680
MTDSRIATAQLGTDGPTVGVQGLGCMGMSFAYGPADAGESRATLERALELGVTFYDTADAYGAGENEKFLSPFFKAHRDEVVIATKFALSIPPGEPTKRVIRNDRPYIRQAVEASLKRLDVDVIDLYYMHRRDVNVPIEETVGAMAELVREGKVKHLGLSEVTGGELRTAQAVHPIAAVQSEWSLFSRDIEAGVVPAARELGVALVPYSPLGRGFLTGSFANAEKDLTADDFRRLQPRFTGDNAAANAALLEPVRAVAKAHDASLGQIALAWVQQQGAVHGLPVVPIPGTSKRARVEENATATRIVLTEEELGLLEPIAAKVAGDRYADMTFTSAGRE

SEQ ID NO: 19648 - protein, 502 aa, Streptomyces avermitilis MA-4680
MRPGRQSAMTELVEHGQLFIGGVLADPLGKDVIEVISPHTEEVIGRVPHASTADVDRAVAVARKAFDEGPWPRATLDERIEVVTRIKDAIAVRHEEIARVISSENGSPYSWSVLAQALGAMMVWDAAITVARNFTYEETRDGVLGKIVVRREPVGVVAAVVPWNVPQFVAAAKLAPALLTGCTVVLKPSPESPLDAYLLGEIAREAGLPEGVLSILPADREVSEYLVGHPGIDKVSFTGSVAAGRRVMEVASRNLTRVTLELGGKSAAVVLPDADITTSVPGIVSAAWMNNGQACVAQTRILVPRSRYDEFADAFAAAASALVVGDPLDPATQVGPLVARRQQRRNLDYIRIGQEEGAKILTGGGRPPGLDRGWYVEPTLFGDVDNSMRIAREEIFGPVICLLPYGDETEAVKIANDSDYGLSGSVWTADVEHGIDVARRVRTGTYSVNTFSLDMLGPFGGYKNSGLGREFGPEGYGEFLEHKMIHLPAGYEAPTGVEGAGA

SEQ ID NO: 19649 - protein, 358 aa, Streptomyces avermitilis MA-4680
MRAAVLHEIGQDKLEVLDDVESVGFGPGRVRIRVRATGLCHSDLSAMSGVLPQPAPFVPGHEGAGEIVEVGEGVSHLKPGDRVVVCWLPACGVCPACKRGQSQLCLAGFMNAGTPNFRRPGGDVFGFAGTGTFAEEVVVDAGSAVPIPDDVPFDIAALIGCGVTTGLGAALNTADVAAGSSVAVIGCGGVGISAVQGARLKGAAEIVAVDPVASRRESALRFGATQAVSPDELAAAKQAVTGGEGFDYVFEVVGRSATARTAYENTRRGGTLVVVGAGALDDFLQLNMFELFFDEKRILPSMYGGGDVLRSYERTIALWRAGRIDLEGLITHRVPLAEINEALDQMRTGTALRTCIEI

SEQ ID NO: 19650 - protein, 326 aa, Streptomyces avermitilis MA-4680
MSELLHGRRVDRMGVEICVEGLTKSFGQQVIWQDVSLTLPAGEVSVMLGPSGTGKSVFLKTLVGLLKPDRGSVKVAGRDVTKLREHELYEVRKLFGVLFQDGALFGSMSLYDNIAFPLREHTRKSESQIRRIVLEKMDMVGLIGSEGKLPGEISGGMRKRAGLARALVLDPEIILFDEPDSGLDPVRVAYLNQLIVDLNAQINATFLIVTHDIASARQVPDNIGLLFRRELVMFGPREELLTSDEPVVRQFLNGRMQGPIGMAEEKDAAQVEQELARLGDTDREPRHVGNDMTPRLMPGPGIARPARWEAIARREAELHRKAVTGA

SEQ ID NO: 19651 - protein, 453 aa, Streptomyces avermitilis MA-4680
MDKQQEFVLRTLEERDIRFVRLWFTDVLGFLKSVAVAPAELEQAFDEGIGFDGSAIEGFARVYESDMIAKPDPSTFQVLPWRAEAPGTARMFCDILMPDGSPSFADPRYVLKRALAKTSDLGFTFYTHPEIEFFLLKDKPLDGSRPTPADNSGYFDHTPQNVGMDFRRQAITMLESMGISVEFSHHEGAPGQQEIDLRYADALSTADNIMTFRLVMKQVALEQGVQATFMPKPFSEYPGSGMHTHLSLFEGDRNAFYESGSEYQLSKVGRSFIAGLLKHAAEISAVTNQWVNSYKRIWGGSERTAGAGGEAPSYICWGHNNRSALVRVPMYKPGKTGSARVEVRSLDSGANPYLAYALLLAAGLKGIEEGYELPPGADDDVWALSDAERRAMGIEPLPQNLGEALALMQRSELAAETLGEHVFDFFLRNKKQEWEEYRSEVTAFELRKNLPVL

SEQ ID NO: 19652 - protein, 1806 aa, Streptomyces avermitilis MA-4680
MDLIPRGSAPRTRRTHRHSRTAAAVAAAALAVSLAQPLEARAATPPAPPSDAKLAAEPARHDATREQFYFVMPDRFANGDTSNDKGGLTGSRLSTGYDPTDKGFYQGGDLKGLTRKLDYIKGLGTTSIWLAPIFKNQPVQGTGKDASAGYHGYWITDFTKVDPHFGTNKDLETLISKAHAKGMKVFFDVITNHTADVVDYEEKSYGYLSKGAFPYLTKDGRPFDDAGYTDGPRKFPAVDGDSFPRTPAVAARKKNAKVPSWLNDPTMYHNRGDSTFAGESSTHGDFSGLDDLWTERPEVVRGMEKIYEKWVRDFGIDGFRIDTVKHVNTEFWTQWATALDAYAKKRGKDDFFMFGEVYSADTSVTSPYVTQGRLDSTLDFPFQDAARSYASQGGSAKKLASVFGDDYKYTTDKANAYEQVTFLGNHDMGRIGYFLNQDNPKATDAELLRKDRLANELMFLSRGNPVVYYGDEQGFTGSGGDKDARQTMFASKVADYLDDDEIGTDRGHASDAYDTSAPLYKEIAALSKLRKDNPALADGIQTERYAADGAGVYAFSRTDARTGTEYVVAVNNADKASAATFATGSADTAFKGIHGTDDVLKSDADKKITVTVPAGAAVVLKAAGRPGTPAAKPSLTLKAPDAGATGTVELSADVDGGRLNRVVFAAQVGNAKWRTLGSADHAPYRVTQTIGKDVPAGTALRYKAVVIDAAGRTASATAASTTGTPPAAETPTASSRDYAIVHYKRPDGDYTDWRLYAWGDLADGESTTWPAGHDFVGRDAYGAFAYVKLKPGASTVNFLVIDKDGDKDVSADRTIDVTKAGEVWVEQGKETVRTERPDYPAQDKTKAVIHYHRADGDLTGWGLHVWTGAATPTDWSKPLEPVRTDAYGAVFEVPLTDGATSLSYIIHKGDEKDLSADRSLDLTADGHEVWLLNGQENHLLPQPAGSAAALDLTTSKAVWIDRNTVAWNGSDAAASTQLLSSRDGSIAVKDGSLTSDDERWLRLSKTSLTDAQKAAFPHLKSYTAWSVDPRDRDRVREALAGQVVASQRAANGAVLAATGVQLAGVLDDLYDATKADLGPTFRGGHPTLAVWAPTAQSVSLELDGAHVRMKRNNATGVWSVTGPASWKGKPYRYVVKVWAPTVRKVVTNKVTDPYSVALTTDSERSLVVDLDDRSLAPSGWSSLKKPKAVPLRDAEIQELHIRDFSVADRTVPAKDRGTYLAFTDKNSDGSRHLRQLAESGTSYVHLLPAFDIATIAEKKSGQQATDCDLASYAADSEKQQECLTAVAAKDAYNWGYDPYHYTVPEGSYATDANGTRRTVEFRRMVKSLNQDGLRVVMDVVYNHTAAAGQAGTSVLDRIVPGYYQRLLADGSVATSTCCANTATENAMMGKLVVDSLVTWAKEYKVDGFRFDLMGHQPKANILAVRKALDALTVAKDGVDGKKIILYGEGWNFGEVADDARFVQATQKNMAGTGIATFSDRARDAVRGGGPFDADPGVQGFGSGLYTDPNSSDANGTPAEQKARLLHYQDLIKVGLSGNLAKYRFTDSSGKEVTGSEVDYNGTGAGYADAPGDALAYADAHDNESLYDALTYKLPKGTPAGDRARMQVLAMATAALAQGPSLSQAGSDLLRSKSLDRNSYDSGDWFNAIHWNCQDGNGFGRGLPMAADNKSKWPYATPLLTSVKVGCDQIEGTSAGYQDLLRIRTTEPDFSLSTAGQVQSKLTFPLSGKDETPGVITMKLGDLVVVFNATPDQQEQTVAALAGKDYALHPVQAAGADPIVKSASYTAKSGMFAVPGRTVAIFSQVAR

SEQ ID NO: 19653 - protein, 469 aa, Streptomyces avermitilis MA-4680
MFQNADEAKKYIADEDVKFVDVRFCDLPGVMQHFTIPAEAFDPAEELAFDGSSIRGFQAIHESDMALRADLSTARVDPFRRDKTVNINFFIHDPITGEQYSRDPRNVAKKAEAYLASTGIADTAYFGPEAEFYVFDSVRFKTAENESFYHIDSEAGAWNTGAIEDNRGYKVRYKGGYFPTPPVDHFADLRAEISLELANSGLQVERQHHEVGTAGQAEINYKFNTLLAAADDLQLFKYIVKNVAWRNGKTATFMPKPIFGDNGSGMHVHQSLWANGDPLFYDEAGYAGLSDTARYYIGGILKHAPSLLAFTNPTVNSYHRLVPGFEAPVNMVYSQRNRSAAMRIPITGSNPKAKRVEFRAPDSSGNPYLAFSALLLAGLDGIKNKVEPAEPIDKDLYELAPEEHASVAQVPTSLPAVLSALEADHEYLLQGNVFTPDLIETWIDYKRTNEIAPLQLRPHPHEFELYFDV

SEQ ID NO: 19654 - protein, 409 aa, Streptomyces avermitilis MA-4680
MSEQTQERGRTAARRVVVVGAGMAGVQTAVALREQGFTGGVTLIGAEPHQPYDRPPLSKAVLLGKAEGSAFDVDFEALGIELQLGREALGLRPEDHELDTDSGPVPYDVLVAATGAEPIQLPGAEGVPGVHLLRTLDDAERLRPVLAQQHDIVVVGAGWIGAEFATAAREAGCAVTVVEAADRPLAGALPAEVAAPMTAWYGDSGARLLTHARVERIEPGAVVLDNGSRVPAGAVVVGIGARPATAWLVGSGIALGAHQEVLADNHLRTSLPDVYAVGDCASFPSGRYEARLLVHHWDNALQGPRTVAANIIGEAPAAYDPVPYFWSEQFGRFVQYVGHHATADATVWRGDPEGAAWTVCWLREGRLVALLAVGRPRDLAQGRKLIESGAPMNPELLADASRPLKAAVV

SEQ ID NO: 19655 - protein, 133 aa, Streptomyces avermitilis MA-4680
MTSTPQPSRPSSLDAEIAARLKRSADGLVPAIAQQYDTGEVLMLGWMDDEALHRTLTTGRCTYWSRSRGEYWVKGDTSGHVQYVKSVALDCDADTVLVKVDQVGAACHTGAHTCFDADVLLKDGDSGVPAADQ

SEQ ID NO: 19656 - protein, 277 aa, Streptomyces avermitilis MA-4680
MSGAAFSRQRGQLLSDTLAAAKAEGRSALIAYLPAGFPTVDGGIAAIKAVFDGGADVVEVGLPHSDPVLDGPVIQTADDIALRGGVRIADVMRTVREAHEATGKPVLVMTYWNPIDRYGVERFTAELAEAGGAGCILPDLPVQESALWREHAEKHGLATVFVVAPSSKDARLAEITAAGSGFVYAASLMGVTGTRASVGEQAQDLVRRTRATTDLPVCVGLGVSNATQAAEVAGFADGVIVGSAFVKLMLDAEDEAAGLEAVRALAGELAKGVRGGD

SEQ ID NO: 19657 - protein, 486 aa, Streptomyces avermitilis MA-4680
MADPKGFLTHGREVARTRPVEERVKDWNEVYVPGSLLPIISKQAGRCMDCGIPFCHNGCPLGNLIPEWNDYAYREDWTSASERLHATNNFPEFTGRLCPAPCESACVLGINQPAVTIKNVEVSIIDKAWDTGDVKPQAPERLSGKTVAVVGSGPAGLAAAQQLTRAGHTVAVYERADRIGGLLRYGIPEFKMEKRHINRRIEQMRAEGTKFRTGVEIGRDIDAAKLRRRYDAVVVAAGSTTARDLPVPGRELKGVYQAMEYLPLANKVQEGDFVAPPITAEGKHVVVIGGGDTGADCVGTAHRQGAASVTQLEILAKPGEERAAHQPWPTFPMLYKVTSAHEEGGERVYSVSTTHFEGDEDGNVQWLHLVEVEFVDGKLTQKPGTERRIPAQLVTLAMGFTGTDQDNGLVTQFGLGLDERGNIARDADFQTNVPGVFVAGDAGRGQSLIVWAIAEGRSAAKGVDRFLTGASELPAPIRPTDRSLMV

SEQ ID NO: 19658 - protein, 478 aa, Streptomyces avermitilis MA-4680
MRRAKIVCTLGPATDSYDQIKALVEAGMDVARFNLSHGTYAEHEERYQHVRKASDETGRSVGVLGDLQGPKIRLGRFNEGPVLLERGDTFTITVEEGVEGDRQTCGTTYAGLAADVTPGERILVDDGKVCLEVTSVDGPRVHTTVVEGGMVSDHKGLNLPGVAVSVPALSDKDEADLRWALRQGFDVIALSFVRSGKDIKDVHRIMDEEGRRLPVIAKVEKPQAVENIDDIVAAFDGIMVARGDLGVEMPLEQVPIVQKRAIKLARRNAKPVIVATQMLDSMIDNSRPTRAEASDVANAVIDGTDAVMLSGETSVGKYPVETVRTMSRIVEAAEEDILATGLPPLTERNKPRTQGGAVARAAAEMGDFLGAKFLVAFTQSGDTVRRLSRYRSPIPLLAFTPMPATRSQLNLTWGVETFLGPHVDSTDAMVDQVDELLLKYGRCEKGDVVVITAGSPPGVSGSTNLVRVHHIGEDDSPK

SEQ ID NO: 19659 - protein, 496 aa, Streptomyces avermitilis MA-4680
MADPKGFLTTPREEWPRRPVEERVRDWDEVYVPGALLPIISRQADRCMDCGVPFCHEACPLGNLIPEWNDLVSREDWRAASDRLHATNNFPEFTGRLCPAPCEAGCVLAINQPAVTIKNVEVAIADRAWADGFTPPCPPERLSGRTVAVVGSGPTGLAAAQQLTRAGHTVAVFERADRIGGLLRYGIPAFKMEKRHLNQRLEQMRDEGTKFRTSTAIGRDIGAEELRARYDAVVLAVGATAWRELDVPGRELAGIHQAMEYLPLADRVCEGDLEVSPLSAAGKHVIIVGGGDTGADCLGTAVREGAASVTQLDIYPLPEAERDEDIEPWPVYPKIYRMSPAHEEARDLKTAPAADADARLFAASTLRFAGDAAGHVRALHLVEVDARRRPLPGSGRTLPADLVLLALGFSGPDRDDGLVDQLGLALDPRGTITRDADFATNVPGVFAAGDAARGQSLIVWAIAEGRAVAAAVDRRLTGAASKLPAPIGPYDRPMRA

SEQ ID NO: 19660 - protein, 303 aa, Streptomyces avermitilis MA-4680
MIVVAGEALIDLVPQGAGALAGLKPALGGGPYNTAVALGRLGSPTAFCSRTSRDAFGEALLDGLRTAGVDVSAVQRGAEPTTLAVATIDEHGSAAYSFYVDGTADRQFAAPDRLPGATRAVSFGTCSLVLEPGASAYEELLRSAAAQGLFTTLDPNIRAGLIPDPDAYRARFKSWLASVTLLKLSEDDATWLGGSPREWLASGPSAVVLTRGGDGLTVFTRDGAEHSVPGEPVDVVDTIGAGDTVNAALLHGLAARDALSPEGLAGLDAEGWTELLRFAARAAAITCSRAGAEPPYASELGAF

SEQ ID NO: 19661 - protein, 403 aa, Streptomyces avermitilis MA-4680
MKTIDELLAEGVDGKRVFVRADLNVPLADGLITDDGRIRAVLPTVKALAEAGAKVVVASHLGRPKGAPDPAFSLLPAAERLGELLGAPVAFAQDTVGPAAHDAVNGLQPGQVAVIENLRFNAGETSKDDAERGAFADRLAALADIYVGDGFGAVHRKHASVYDLPARLPHYAGYLIATEVNVLKKLTEDVKRPYVVALGGAKVSDKLAVIDQLLGKADRLLIGGGMAYTFLKAKGYEVGISLLQEDQIPTVKEYMERAEKNGVELVLPVDVLVSTEFPDLKTKAPANPTTVAADAIPADQEGLDIGPETRKLYASKLADAATVFWNGPMGVFEHPDYAEGTKAVAQALVDSQAFTVVGGGDSAAAVRILGFDETAFGHISTGGGASLEYLEGKTLPGLAALED

SEQ ID NO: 19662 - protein, 258 aa, Streptomyces avermitilis MA-4680
MTSRMPLMAGNWKMNLNHLEAIAHVQKLAFALADKDYEACEVAVLPPYTDLRSVQTLVDGDKLKIKYGAQDVSAHDSGAYTGEISGSMLAKLKCTYVAVGHSERRQYHHETDEIVNAKVKASFRHGLIPILCVGEELEVREAGNHVTHTLTQVEGGLKDVPAEQAETIVIAYEPVWAIGTGKVCGADDAQEVCAAIRAKLAELYSQELADQVRIQYGGSVKSGNVAEIMAKPDIDGALVGGASLDADEFVKIARFRDQ

SEQ ID NO: 19663 - protein, 443 aa, Streptomyces avermitilis MA-4680
MNAQTWHGHVTTTVLVGCTALALAVTGTTATATAQAQAQPRDLGRQTLAAGDGWASDGTGTTGGAAADAAHVYTVTTWAGFKAALKDGGTAPKIIKVKGTIDANAEGCDSFAAAGYDFDAYLRKYSPENWGYGANLDAEPDDSPEGLRRVSADTQAKAIKASVPANTTIVGLGKNAGFEGASLQITAVDNVIIRNVAFESPLDCFPQWDPTDTSVGNWNSEYDSAVVYGATHIWLDHNTFTDGEHPDSSLPTYFGRIYQQHDGELDIVKGADHVTASWNVFTDHDKTILIGNSDSASTAAVDRGHLRVTFHHNLFSGLVERAPRVRFGQVDSYNNHFVAGSAYSYSFGIGMESQLVAEHNAFTLPEGISAATVLKKWKEAPVTAADNYVNGAPTDLIAVHNAEIPAETLQSGAGWTPTLRTKVDPPRAVPGIVDHRAGAGKVC

SEQ ID NO: 19664 - protein, 483 aa, Streptomyces avermitilis MA-4680
MSETQQVTDLPSAVPPGGNGIDRFFKISARGSTFGREIRGGFATFFTMAYILVLNPIILGSAKDKFGHQLDHVQLTTATALVAAVMTVVMGVGGNLPLALAAGLGLNAVVAFQIAPLMSWDDAMGLVVLEGLLICVLVVTGLREAVMHAIPQPLKQAISVGIGLFIAFIGFVDAGFVSRVPDVAGTTVPVQLGGTGTLTGWPVLVFCLGVLLTIGLLARRVRGAILISIVTMTIVAIVINSVADVKNWGLTVPKVPDDVVASPDFGLLGHFSLFGAFGETGAITVVLLVFTLVLSDFFDTMGTVVGISAEAGLLDEEGKVPDLGRVLLIDGAAAVAGGAASASSATSYIESAAGVGEGSRTGFSNLVTGGLFAFALFLTPLLTIVPMQAAAPALVAVGFLMMTQVKHIDWDRYEIAIPAFLTIAVMPFTYSITNGIGAGFLAYVLIKAVLGKAKEIHWLLWATSALFLVYFAIDPVEQILGVK

SEQ ID NO: 19665 - protein, 423 aa, Streptomyces avermitilis MA-4680
MTITQPDLSVFETVESEVRSYCRGWPTVFDRAQGSRMYDEDGHAYLDFFAGAGSLNYGHNNPVLKRALIDYLERDGVTHGLDMSTAAKRAFLESFQNLILRPRDLPYKVMFPGPTGTNAVESALKLARKVKGREAIVSFTNAFHGMSLGSLAVTGNAFKRAGAGIPLVHGTPMPFDNYFDGKVPDFLWFERLLEDQGSGLNKPAAVIVETVQGEGGINVARPEWLRALAELCKRQDMLLIVDDIQMGCGRTGAFFSFEEAGVTPDIVTVSKSISGYGLPMSLCLFKPELDIWEPGEHNGTFRGNNPAFVTAAAALQTYWADGSAMEKQTLARGEQVEQALISITEENLADVKEYRGRGLVWGIEFKDKDRAGRIAQRAFELGLLIETSGPESEVVKLLPALTITPEELDEGLRTLARAVRETA

SEQ ID NO: 19666 - protein, 267 aa, Streptomyces avermitilis MA-4680
MSTPEIDVRGLHKSFGDNEVLRGIDLEIGSGEVVCVIGPSGSGKSTLLRCVNLLEEPTKGQVFVAGAEVTDPDVDIDAVRRRIGMVFQQFNLFPHLSVTDNLTLPQRRVLGRDKAQAAEVAADNLRRVGLSEKAEAYPASLSGGQQQRVAIARALAMGPQVMLFDEPTSALDPELVGDVLAVMRRLADEGMTMMVVTHEMTFAREVADRVVFMDGGVIVEDGTPEQVIGNPRHERTRHFLSRLLDPAMADVEEEISDQVGKSEQPPN

SEQ ID NO: 19667 - protein, 391 aa, Streptomyces avermitilis MA-4680
MTAFDPADFLGIDDLLDAEDLAIRDTVRTWAAQRVLPYVAEWYENGELPGIRDLARELGAIGALGMSLTGYGCAGASAVQYGLACLELEAADSGIRSLVSVQGSLAMYALHRFGSEEQKQEWLPRMASGDVIGCFGLTEPDHGSDPASMRTYAKRESGGDWVLNGRKMWITNGSVAGVAVVWAQSDDGIRGFVVPTDAPGFSAPEIKHKWSLRASVTSELVLDDVRLPAAAVLPEVTGLKGPLSCLSHARYGIVWGAMGAARASFEAAVEYAKTREQFGRPIGGFQLTQAKLADMAVELHKGILLAHHLGRRMDAGRLRPEQVSFGKLNNVREAIEICRTARTILGANGISLEYPVMRHATNLESVLTYEGTVEMHQLVLGKALTGLDAFR

SEQ ID NO: 19668 - protein, 262 aa, Streptomyces avermitilis MA-4680
MSTTTPATPAPAMVDIRSVHKSFGPLDVLKGIDLEVRAGEVTVVLGPSGSGKSTLLRTINHLEKVDQGTISVDGRLVGYRRSGDKLYELPEREILKQRTRIGFVFQNFNLFPHLTVLDNLVEAPVSVLKRPRKAAVESARRLLGRVGLADKADAYPGQLSGGQQQRVAIARALALEPALLLFDEPTSALDPELVGEVLDVIRDLAHQGTTMIVVTHEIGFAREVADTVVFMDDGRIVEQGTPGEVLDRPRHERTRAFLSKVL

SEQ ID NO: 19669 - protein, 462 aa, Streptomyces avermitilis MA-4680
MKAQDGMYIDGAWRPAAGPDMIEVVNPADEQVIGRVPAGTPEDVDAAVRAARAALTAWAATPPAERAARISALRDVLVARQDEIAETVTAELGSPLSFSQSVQVGLPILVAGSYAELAATYAFEERVGNSTVHHEPVGVVGAITPWNYPLHQIVAKVAPALAAGCTIVLKPAEDTPLTAQLFAEAVHEAGVPAGVFNLVTGLGPVAGQALAEHEDVDLVSFTGSTAVGRQIGATAGAAVKRVALELGGKSANVILPSADLAKAVNVGVANVMANSGQTCSAWTRMLVHAERYEEAVELAAAAAVKYADRIGPLVNAKQRARVRGYIDKGVAEGARLVAGGPESTEPQGYFVSPTVFADVTPEMTIAKEEIFGPVLSVIRYEDEEEALRIANGTVYGLAGAVWAGDEAEAVAFARRLDTGQVDINGGRFNPLAPFGGYKQSGVGRELGAHGLAEYLQTKSLQF

SEQ ID NO: 19670 - protein, 359 aa, Streptomyces avermitilis MA-4680
MVRAAVLPAVGAPLEITGIELPEPGPGQVRVRLAAAGVCHSDLSLSDGTMRVPVPAVLGHEGAGTVVSVGEGVTQVSPGAGVVLNWAPSCGRCHACSLGEVWLCADALTGAGTVYARRTDGSDLYPGLNVAAFAEETVVPAACVLPVPDGVPLTDAALLGCAVLTGYGAVHHSAKVQPGETVAVFGVGGVGLATLQAARIAGASKIVAVDVSPEKESLARRAGATDYLVASENTAREIRGLTDKQGVDVAVECVGRAVTIRTAWDSTRRGGRTTVVGIGGKDQQVVFNALEIFHWGRTLSGCVYGNSDPAKDLPVLAEHVRAGRLDLGALVTERIALDGIPAAFDNMLAGKGGRALVVF

SEQ ID NO: 19671 - protein, 303 aa, Streptomyces avermitilis MA-4680
MRQVTRKGLMTVAAATGVLAATGGYAHADSGAYGSASHSPGVLSGNSVQVPVHVPVNVCGNTVNVVGLFNPAVGNQCANGGGGGHHDGGGHHGGGGHHGGGYGDSPSGGGGHHGGGGHQGGGYGDGPSGGGGGGGGSQAGGHTGDSPGVGSGNHVQVPVDVPVNVCGNNVTVGGLGNAAGGDACADTPGGGHATTPPGGGGGTTPPGGGGGGTTPPGGGGGGTTPPGGGGGTTPPGTPGHPGQPGGDSSAHPNHPGGQSVTQPEGTAQLAHTGSDMPLGLLVPAGAGALLGGALLYRRARSAA

SEQ ID NO: 19672 - protein, 334 aa, Streptomyces avermitilis MA-4680
MRRRSVLLAVPAGLVTLAGCGDEKSDTAKTKPSTSPSPSASASSAPPPKIVDGPLPAITAGTKFDEKPTVAKGSGDPSKDVAVKTVIAGSGKTVAENDYIQANYLGQVWDTAKVFDNSYDRKTPLVIQLAQGSIIDGWRYALAGKKAGSRVLMSVPPTWGYGKQGNSQAGIKGTDTLVFVVDIQNTFNAKSSAQGKDVAQGDAKLPKVGTNTDGKAPSIDVPKTAAPTKLVANYVIEGDGDVVKADSSVLVQYKGVLWDTGKEFDSTYSRSALTSFSLQQVVKGWSQGLTGKKVGSRVLIVVPPKLGYGDSPPSGSGIEKDSTLVFSVDILAKM

SEQ ID NO: 19673 - protein, 124 aa, Streptomyces avermitilis MA-4680
MSIEKPEIDFPGGEPPADLEIKDIWEGDGPVAKAGNTVSVHYVGVAFSTGEEFDASWNRGTPLQFQLGAGQVIKGWDQGVQGMKVGGRRQLTIPAHLAYGDRGAGGGRIAPGETLIFVCDLVAV

SEQ ID NO: 19674 - protein, 454 aa, Streptomyces avermitilis MA-4680
MADRTPPLGVEELHALVAGGEIDTVVLAFPDMQGRLQGKRFAARFFLDEVLEHGTEGCNYLLAVDTDMNTVDGYDMSSWDRGYGDFAMHPDLSTLRQVPWNAGTALLIADLAWNDGSPVVAAPRQILRRQLDRLAALGYTAQVGTELEFIVFKDTYEQAWDAGYKGLTPANQYNIDYSVLGTGRIEPLLRRIRNEMQAAGLTVESAKGECNPGQHEIVFRYDEALVTCDQHAVYKTGAKEIAAQEGVSITFMAKYNEREGNSCHIHLSLADADGTNAMAGDGPGGMSDVMRHFLAGQLAALRDFSLLYAPNINSYKRFQPGSFAPTAVAWGYDNRTCALRVVGHGRSMRFENRLPGGDVNPHLAVAGLVAAGLYGIEHKLELPEACAGNAYAAEYEHVPTTLREAAELWENSPIAKAAFGDDVVAHYRNMARVELKAFDAAVTDWELRRSFERL

SEQ ID NO: 19675 - protein, 463 aa, Streptomyces avermitilis MA-4680
MRPHVSHPHELVVLDPATEEVVATVPAATPQDVDAAVVRASKAQVRWAALAPGERARLLRRFAVVVDEHLEELARLEVREAGHVIGNARWEAGNVRDLLDYAAGGVERLTGRQIPVPGGLDITILEPLGVVGVIAPWNFPMPIAAWGTAPALAAGNAVILKPAETTPLTALRLAELALEAGLPEHLFQVLPGAGPVAGNALVEHPGVAKIVFTGSTAVGKQVWAKGSALLKRVTLELGGKSPNIVFADADVEAAAAAAPMAFLDNSGQDCCARTRILVQRSVYDRFLALLAPAVESVAVGDPLDERTAMGPLISKVQLERVRSYVPAGAPALRGKAPEGPGFWFPPTVLTDVDPHAPVAVEEVFGPVAVVLPFEDEADAVRLANATEYGLAGSIWTRDVGRALRVSGAVRAGNLSVNSHSSVRYWTPFGGFKQSGIGRELGPDALTAFTETKNVFISTEGPAQ

SEQ ID NO: 19676 - protein, 403 aa, Streptomyces avermitilis MA-4680
MTGTATNAELTERWQGALMNNYGTPRLPLVRGAGTRLWDADGKEYLDFVGGIAVNALGHAHPAIVEAVSTQIASLGHVSNLFVAEPPVALAERLLQLFGRDGRVYFCNSGAEANEAAFKIGRLTGRSHMVATQGGFHGRTMGALALTGQPGKQEPFLPLPGDVTHVPYGDAQALAAAVTEETALVVIEPIQGENGVVVPPAGYLKAARAITAATGSLLVLDEVQTGIGRTGHWFEYQAHEGVLPDVVTLAKGLGGGLPLGATVAFGRAAELLQPGHHGTTFGGNPIACAAGLAVLETIQAEGLLENVKSASEKLRDGIESLGHPLIAHVRGSGLLLGIVLTEPLAPQAQQAAQDAGFLVNAPAPDVVRLMPPLNLGDDEVDAFLRALPGVLDAVTNGDGRAKE

SEQ ID NO: 19677 - protein, 228 aa, Streptomyces avermitilis MA-4680
MAVQINPSILSADFARLAEEAKAVEGADWLHVDVMDNHFVPNLTLGVPIVEALARATDTPLDCHLMIEDADRWAPQYVEAGAGSVTFHAEAAAAPVRLAREIRAKGARASMALKPATPIEPYEDLLPELDMLLIMTVEPGFGGQAFLDIMLPKIRRTRELISKHGLELWLQVDGGVSASTIERCAEAGADVFVAGSAVYGAADPADAVRALRTQAEGATALASWACDH

SEQ ID NO: 19678 - protein, 483 aa, Streptomyces avermitilis MA-4680
MQHVRFLNDIKPPYDLTYDDVFMVPSRSAVGSRQGVDLTSPDGTGTTIPLVVANMTAIAGRRMAETVARRGGLVVIPQDIPIEVVTEVVSWVKGRHLVLDTPIVLVPHQTVADALALLPKRAHNAGVVVDEDGRPVGVVTDTDLTGVDRFTQLSEVMSRDLLLLDADIEPREAFNKLDGANRRYAPAVDRDGRLAGILTRKGALRATLYTPATDADGRLRIAAAVGINGDVAGKAKQLLDAGVDTLVIDTAHGHQESMISAIRTVRALDPQVPIAAGNIVAADGVKDLVEAGADIIKVGVGPGAMCTTRMMTGVGRPQFSAVMECAAEAKKYGKHVWADGGVRHPRDVAMALAAGASNVMIGSWFAGTYESPGDLQQDADGRLYKESFGMASARAVRNRTSEESAYDRARKGLFEEGISTSRMFLDPGRPGVEDLIDSIIAGVRSSCTYAGANSLEEFTEKAVVGIQSAAGYAEGKPLHASWS

SEQ ID NO: 19679 - protein, 439 aa, Streptomyces avermitilis MA-4680
MSTTPPSPQLTAATAPGAGEPASEDGAFGFLRALGPRGRRAFAGAFGGYALDSYDYFTLPLSMVALAAYFGLDSGQTGLFTTVTLVVSAIGGAVAGVVADRIGRVKALMITVITYAVFTVACGFAPNYETLLVFRALQGLGFGGEWAVGAILVAEYASARHRGRTLGAIQSSWAVGWALAAVVYTLVFSFVGDDLAWRVMFWTGALPALLVVWVRRRVHDAPEAAVERQKSAHKGSFTAIFRPGTADAPGLLRITVFAGLLSTGVQGGYYTLATWVPTYLKTERGLSVVGTGGYLTFLISGAFIGYLTGGYLTDKLGRKRNILLFAVLSAICVLVYANIPSGADTLLLVLGFPLGFCMSAIFSGFGSFLSELYPTAVRGTGQGFTYNTGRAVGAVFPTLVGFLADSWGVGGALVFGAIGYALAALALLGLPETRGKELR

SEQ ID NO: 19680 - protein, 507 aa, Streptomyces avermitilis MA-4680
MAARAAGRRPCLTRTTPQEAIVPDLFIDGEWRAALDGRTREIRCPADGSLVGVVDEAGGKDTAEAIAAARRAFDEGPWPWLPAADRGDLLLRVADLLVRDRAKLARAESLDTGKRFVESEYDIDDIVNCFRYFGRLAAAESGRVIDTGSASTDSRVVYEPVGVCALITPWNYPLLQTAWKVAPALAAGNTFVLKPSELTPHTAIHLMRLLQEAELPPGVANLVLGAGPEAGAPLADHPDVDLVSFTGGLHTGRRLMAAAAGTVKKVALELGGKNPNIVFADADFDTAVDMALTAVFLHSGQVCSAGARLLVEDSLHDRFVDEVVRRAAEIRLGGPFDERAQTGALISAAHRAKVEAYVAKGLDEGAVLRCGGRRPEGLDEGFFYLPTVLDECTSGMSVIQDESFGPVLTVERFTGEAEAVRLANDTVYGLAGAVWTTDEAKAQRVVSRLRIGTVWINDYHPYVPQAEWGGYKQSGFGRELGPSGLAEYREAKHIWRNTDPSPQGWFA

SEQ ID NO: 19681 - protein, 363 aa, Streptomyces avermitilis MA-4680
MVVPHEVRAVVAVKKGAPVEVQTIVVPDPGPGEVLVAVQACGVCHTDLHYREGAITDDFPFLLGHEAAGTVEAVGAGVTDLAPGDYVVLAWRAPCGSCRSCRRGRPWYCFDSRNATQPMTLLDGTPLSNALGIGAFAEKTLVAAGQAVKIDPAARPEAAGLIGCGVMAGYGAAVNTGKVGRGDTVAVIGCGGVGNAAIAGACLNGAMKVIAVDIDDKKLDQAEKFGATHTVNSRGTDPVEAVRALTDGFGVDIAIDAVGRPETYKQAFYMRDHAGTLVQVGVPDPEMKIDLPLIDLFSRGGALKSSWYGDCLPSRDFPFLIDQYLYGLLDLNAFVSETISLEQVEEAFAKMHRGEVLRSVVVL

SEQ ID NO: 19682 - protein, 413 aa, Streptomyces avermitilis MA-4680
MRTVTVVGASLAGLYAARELRAQGFDGRLVIVGEEPHPPYDRPPLSKDFLTGRADQDRLALADAEETAELGAEWLLGVRARGLDPRGRTVLLDDGRTVSTDGVVIATGASARRLPGDDLSGVHTLRTLDDARALRDELSRGARRVVVIGGGFIGAETASSCAALGHDVTVVEAAPLPLVPQLGAEMAAVCAALHRRGGAGLVTGTGVAGLRGRAGAGAERSGHQGAGAAGPRRSVTAVELSDGRLLPADGVIVGIGATPNTGWLAGSTLALHDGVLCDDGCATALPQVVAVGDVARVGGTRAEHWTSATEQPRVAVRNLLAGRTTETVRSVPYFWSDQYGARIQFAGRRHDGDTVRITEGAIERGGPAEGGLLALYERDGRTTAVLSVDRPRPFMRARRELSRAADPVEPAAL

SEQ ID NO: 19683 - protein, 408 aa, Streptomyces avermitilis MA-4680
MTAPARTRSSADLIRAEAPVLAHNYHPLPVVVARAEGTWVEDVEGRRYLDMLAGYSALNFGHRHPVLIEAAHRQLDQLTLTSRAFHNDRLAQFAESLAELTGLDMVLPMNTGAEAVESAIKVARKWAYEVKGVAPDQATIVVAADNFHGRTTTIVSFSTDDTARTGFGPFTPGFRIVPYNDLAALEAAVDETTAAVLIEPIQGEAGVVIPDDGYLAGVRELTRRTGCLFIADEIQSGLGRTGRTLAVEHESVVPDMLLLGKALGGGIVPVSAVVARRDVLAVLRPGEHGSTFGGNPLAAAVGSAVVGLLETGEFQRGAAELGVVLRDGLAALVGKGVVGFRARGLWAGVDIDPAIGTGREISERLMREGILVKDTHGSTIRLAPPLTITGEELASALGTLEKVLTQEA

SEQ ID NO: 19684 - protein, 254 aa, Pseudomonas marginalis pv. alfalfae
MSERVKQPVSPEGIIQMQGVNKWYGQFHVLKDINLNVKQGERIVLCGPSGSGKSTTIRCLNRLEEHQQGRIVVDGVELTNDLKQIEAIRREVGMVFQHFNLFPHLTILQNCTLAPMWVRKMPKRKAEEIAMHYLERVRIPEQAHKFPGQLSGGQQQRVAIARALCMKPKIMLFDEPTSALDPEMVKEVLDTMIGLAEDGMTMLCVTHEMGFARTVANRVIFMDKGEIVEQAAPNDFFDNPQNDRTKLFLSQILH

SEQ ID NO: 19685 - protein, 464 aa, Streptomyces avermitilis MA-4680
MPIATVNPATGETLKTYEALDAEAIERRLAAAQSAFRTHRTTTFAERARLLHRAADLLDEDQRDIARVMTTEMGKPVKQARAEAAKCAKAMHWYADHAEELLADEEPADSDVKDSGASRALVRYRPLGPVLAVMPWNFPLWQVVRFAAPALMAGNVGLLKHSSNVPQTALYLEDLFRRAGFPDGCFQTLLIGSGAVEGILRDPRVRAATLTGSEPAGRAVASVAGDQVKKTVLELGGSDPFVVMPSADIDRAAKTAVTARVQNNGQSCIAAKRFIVHTDVFDAFAERFTAGMAALKVGDPLDEDTEVGPLSTEQGRTDLEELVDDAVENGATVLCGGERPEGYTERGYYYAPTVLTDITPEMRIHLEEAFGPVATLYRAADLDEAVAIANDTPFGLSSNVWTREDAEVDRFVRDLEAGGVFVNGMTASHPAFPFGGVKRSGYGRELSGHGIREFCNITTVWHGA

SEQ ID NO: 19686 - protein, 318 aa, Streptomyces avermitilis MA-4680
MPDSVETFDLITMGRIGVDLYPLQPGVPLPQVESFGKFLGGSAANVAVAAARLGRSTAVITRTGNDPFGTYLHQALEEFGVDDRFVTPVDAYPTPVTFCEIFPPDDFPLYFYRQPKAPDLEIRTEELDFFALRAARIFWITGTGLSEEPSRSATLAALKARTKGGTTVFDLDWRPMFWQDPRAARPYYAEALRHATVAVGNLDECEIATGVREPRACAEALIEAGVELAVVKQGPKGVLAVHRDGTTAEVPPVPVEVVNGLGAGDAFGGSLCHGLLAGWELERTMRYANAAGALVASRLACSSAMPTLDEVEDLVARG

SEQ ID NO: 19687 - protein, 482 aa, Streptomyces avermitilis MA-4680
MSILNDVPKQLFIGGTWADAADGATMPVDDPATGEILCHVADAGPKDARLAADAAVEAQDGWARTAPRERSEILRRAYEIIVSRTGELALLMTSEMGKPLAEARGEVAYAAEFFRWFSEEAVRIDGGYGVLPDGRNRMLLMRRPVGPCLLVTPWNFPLAMGTRKIGPAIAAGCTMVLKPAPQTPLSSLALAGILKEAGLPDGVLNVVTTSRAGEVVEPLLTGGRIRKLSFTGSTRVGRLLLAQCADAVVRTSMELGGNAPFIVLDDADLSAAVDGAMTAKMRNMGEACTAANRFFVHRSVADEFGRRLAERMGALVVGPGTRDGVDVGPLIDEAGRAKVEELVADAVERGARVLVGGVAPDGPGRFYPPTVLADVDPGSRLMETEIFGPVAAILVFDDEDEVVRRANDTPWGLVGYVFTQGLDRALRVSERLEVGMVGVNTGLVSNPAAPFGGVKQSGLGREGGRVGIEEFLEYKYLAVPLR

SEQ ID NO: 19688 - protein, 419 aa, Streptomyces avermitilis MA-4680
MSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 19689 - protein, 360 aa, Streptomyces avermitilis MA-4680
MPVISVPYAFNEEELYVDLRSIFGHSLFLKCEGFNFAGSIKLKAATEMVEAAERDGVLTPESILVESSSGNLGVALSMIAASKGYRFLCVTDSRGNLSTRMMMEALGSEVHMIAGQEANGGFLGARIAYVRALCASDDRYVWLSQYTNPSNWKAHYRKTAPEIARQFPRLDVLFVGAGTTGTLMGCARYFREWHRPVRIVAVDSVGSVSFGGPPGRRMIPGLGMSMRPPLLDESYVDEVIRVEEADTIRTCHRLARRGFLFGGSTGTVVSGATDWLAGHDARELTAVAVGPDLGERYLDTIYQTNWLKDLYGDEVLDSDDVAAGSWASSPAQPTRWGRSLDLQTGDHHGNQHHQFHDRKT

SEQ ID NO: 19690 - protein, 507 aa, Streptomyces avermitilis MA-4680
MTRFAAPGTDGAIVSYQARYDHFIGGEYVPPARGQYFENPSPVNGQPFTEIARGTAEDVERALDAAHAVAPAWGRTSVAERSDILRRIADRMEANLEKLAVAESWENGKPVRETLAADIPLAIDHFRYFAGAIRAQEGSLGEVDDDTVAYHFHEPLGVVAQIIPWNFPILMATWKLAPALAAGNAVVLKPAEQTPASIHYWLSLVADLLPPGVLNIVNGFGVEAGKPLASSPRVAKVAFTGETTTGRLIMQYASENITPVTLELGGKSPNIFFDDVWSANDDFRDKALEGFTMFALNQGEVCTCPSRALVQRGQYAEFMEAAVARTELIKTGHPLDTDTMIGAQASNDQLEKILSYLDIGRQEGAKILTGGERIEHDGELKGGYYVQPTIFEGDNRMRIFQEEIFGPVVSVTSFNDFDDAIKIANDTLYGLGAGVWTRDINTAYRAGRAIQAGRVWTNCYHAYPAHAAFGGYKGSGIGRETHKMMLDHYQQTKNLLVSYSPKKLGFF

SEQ ID NO: 19691 - protein, 281 aa, Streptomyces avermitilis MA-4680
MAERLKRLGLIGELSAEFAGTMILILFGAGVVAQVVAGGALTTPPGGLGNHDSIAWAWGIGVTMGVYVAARLSGAHLNPAVTVTLAAFKGFPWSKVAPYAVAQTLGAFVAALLVRWNYTEALAKADPGHTLKTQGVFSTLPANGNPNLPVHEWGAFRDQVIGTAILLLLILAITDLLNTPPGANLAPFIIGLVVVAIGMAWGTNAGYAINPARDFGPRLASFITGYGSAWRDQYGNFYFWVPIIGPLIGGLLGGVVYKFFVGRFLPTAEPEPPGRVPTPEA

SEQ ID NO: 19692 - protein, 261 aa, Streptomyces avermitilis MA-4680
MTTETLKVDSAAVEVHDVHKWYGAHRVLNGVELTVRPGEVTVILGPSGSGKSTLLRVINHLEKPEVGYVSVNGELIGVRRHGDRLKELSERVILAQRSRIGFVFQNFNLFPHLTVLDNVAAAPVATGRLKKPEAQELARDLLGRVGLADRTGAYPRQLSGGQQQRVAIARALALRPGVILFDEPTSALDPELVGEVLAVIKDLATSGTTLVVVTHEIGFAREVADRVVFMDGGRIVEQGPPAEVLDHPKHERTRDFLSKVL

SEQ ID NO: 19693 - protein, 317 aa, Streptomyces avermitilis MA-4680
MARDYYEVLGVSRSASQDEIQQAYRKLARRHHPDVNKDPGAEERFKDLNEAYSVLSDPKTRARYDRFGEDFRKIPEDFDERVAAGAGGGFRGRRTAGGGGPRVRYAPGFGDDFGAEGIDIEDLFGSMFGAGAARGGVPGADQEAELPLTVEEAYRGGRRTVTLAGPDGQPRRYEVDVPPGVTDGQRIRLAGEGGRGSGDAAAGDLYLRVRIQPHPRFRLDGRDVHVQVPVAPWEAALGATVPVPTPGGGTAKVTVPAGSSSGRRLRLRGEGMPNPRGANGDLYAELRIVVPPTLGDQERELFEELAATSSFDPRRTR

SEQ ID NO: 19694 - protein, 479 aa, Streptomyces avermitilis MA-4680
MSTTAQIGVTGLAVMGRNLARNFARNGYTVAVHNRTASRTRDLVEEFGHEGDFVPAETAKDFVAALERPRRLVIMVKAGAPTDAVIEEFAPLLEPGDMIIDGGNAHFADTRRRERELREQDIHFVGTGISGGEEGALHGPSIMPGGSPESYDSLGPMLEKISAKAADGAPCVTHVGPDGAGHFVKMVHNGIEYADMQLIGEAYQLLRDVAGYTPAQIADIFRTWNTGRLDSYLIEITAEVLSHVDAATGKPFVDVVQDQAEQKGTGRWTVQIALDLGVPVSGIAEAVFARSLSGHQELREASRGLAGPKAAPLGESEAAAFADRVEQALYASKIVSYTQGFHEIAAGSDEYDWNIDLGKIASIWRGGCIIRAAFLDRIREAYDARADLPSLLSDDTFAQEIAAAQDDWREVLIAATRQGVPTPGFAAALAYYDALRAERLPAALTQGQRDFFGAHTYRRTDREGSFHTLWGGDRSEVTA

SEQ ID NO: 19695 - protein, 477 aa, Streptomyces avermitilis MA-4680
MTETESIAYDVVVLGAGPVGENVADRTRAAGLSTAVVESELVGGECSYWACMPSKALLRPVIARADARRVPGVSHLAQGHLDTAAVLAHRDYEVSHWKDDGQVGWLDGIGADLYRGHGRLSGPREVTVTGPDGDRRVLTARHAVAVCTGSRALLPDLPGLDQVEPWTSREATSAQAAPGRLIVVGGGVVAVEMATAWRALGSEVTVLVRGKGLLPRMEPFAGELVAEALKEAGADVRTGTSVSAVTREGPTVVVLTDTGDRIEADEILFATGRAPRTDDLGLDTVGLEPGSWLSVDDSLRVTGSDWLYAVGDVNHRALLTHQGKYQARIAGAAIAARASGVPLLESDPWGAHAATADHAAVPQVVFTDPEAAAVGLSLAEAERAGHHVRAVDVEFSSVAGAGLYADGYRGRARMVVDVNRETLLGVTFVGPGVGELIHSATIAVAGEVPIGRLWHAVPSYPTISEVWLRLLEAYRDA

SEQ ID NO: 19696 - protein, 322 aa, Streptomyces avermitilis MA-4680
MNTAQHKIGSGFGATSTAVDVLHGIDLSGQLAIVTGGYSGLGLETTRALTGAGARVVVPARRPDVAREAVAGIDGVEVDELDLGDLESVRGFAERFLASGRTIDIVINNAGIMACPETRVGPGWEAQFATNHLGHFALVNRLWPAVEPGGARVVSVSSGGHHLSGIRWDDVHWTHDYDKWEAYGQAKTANVLFAVHLDRLGRESGVRAFSLHPGGILTPLQRHLAKEEMVERGWIDENGDLVHPDAFKTPEQGAATQVWAATSPQLAGMGGVYCEDCDIAEPASADGERGGVKDWATDPEQAARLWDLSAELTGVNAFASRA

SEQ ID NO: 19697 - protein, 315 aa, Streptomyces avermitilis MA-4680
MSTVNTMRAISQDVLGGPEVLKEVETERPAPRPNEVLVRVRAAGVNPTDWKHRATGGFLGEPPFVLGWDVSGVVEATGIGVARFKPGDEVFGMLSYPFGHGSHAEYVTAPARAFAHKPSGVDHIQAGALPLVSLTAWQALVETADVRPGQRVLIHAAAGGVGHVAVQIAKARGAYVIGTASAGKHDFLRGLGVDETIDYRETDFAEAVRDVDIVLDTIGGDHSLRSLRVLRPGGIVVSILPVGSDDFYEEAERLGVRALRMLVDASHTGMKAIAELVEAGKLRATIAETFPLADAAKAHALGDTGRTTGKLVLTM

SEQ ID NO: 19698 - protein, 459 aa, Arabidopsis thaliana
MSTKRVDMGSRDYISSLPDEILGKILSLFCTNRAACTSVLSKRWRNLLELVDNLDLNDAYGNHQYFCDFVDRTLALLSNSTTVKRFSLNCAFHNDASRVNSWIRTVFDRGFLDLHLETAHMHRIDTEFFTSNTLLELTICGGFYAEGRLPPGRVFFPALKSLSLVSVEFTDTLMYQNFISGCPVLEELFLHYDNETQCPAWKGLVSSPSIKRLNIYDNPSELRYEAYKCCFQIPSLVYLDYSSYVAKQYAVDLVSLEEARLNIRYPERLVDQNEDIFGDVTDLLKGISNVKTLHLSSDSLEVFHLCCDTMPVFHNLLTLSFESDEEIGWQVVPLLLNKSPNLETLVIKSLVHQVTDMCGNACACISKRRKKKKKTTEDDECCLSTCQVKVLNISGYRGTCKELKQMRHFLENLKCLETVNVGVDVKRREYKNGNNKYQRITNAVMELPRFSSNCQIQFF

SEQ ID NO: 19699 - protein, 459 aa, Arabidopsis thaliana
MSTKRVDMGSRDYISSLPDEILGKILSLFCTNRAACTSVLSKRWRNLLELVDNLDLNDAYGNHQYFCDFVDRTLALLSNSTTVKRFSLNCAFHNDASRVNSWIRTVFDRGFLDLHLETAHMHRIDTEFFTSNTLLELTICGGFYAEGRLPPGRAFFPALKSLSLVSVEFTDTLTYQNFISGCPVLEELFLHYDNETQCPAWKGLVSSPSIKRLNIYDNPSELRYEAYKCCFQIPSLVYLDYSSYVAKQYAVDLVSLEEARLNIRYPERLVDQNEDIFGDVTDLLKGISNVKTLHLSSDSLEVFHLCCDTMPVFHNLLTLSFESDEEIGWQVVPLLLNKSPNLETLVIKSLVHQVTDMCGNACACISKRRKKKKKTTEDDECCLSTCQVKVLNISGYRGTCKELKQMRHFLENLKCLETVNVGVDVKRREYKNGNNKYQRITNAVMELPRFSSNCQIQFF

SEQ ID NO: 19700 - protein, 339 aa, Arabidopsis thaliana
MHRIDTEFFTSNTLLELTICGGFYAEGRLPPGRVFFPALKSLSLVSVEFTDTLMYQNFISGCPVLEELFLHYDNETQCPAWKGLVSSPSIKRLNIYDNPSELRYEAYKCCFQIPSLVYLDYSSYVAKQYAVDLVSLEEARLNIRYPERLVDQNEDIFGDVTDLLKGISNVKTLHLSSDSLEVFHLCCDTMPVFHNLLTLSFESDEEIGWQVVPLLLNKSPNLETLVIKSLVHQVTDMCGNACACISKRRKKKKKTTEDDECCLSTCQVKVLNISGYRGTCKELKQMRHFLENLKCLETVNVGVDVKRREYKNGNNKYQRITNAVMELPRFSSNCQIQFF

SEQ ID NO: 19701 - protein, 133 aa, Boea crassifolia
MEPYGNHQIGDQLRKTDEYGNPVHHTPGGEYGGPHVGAEHHHGAPISIPPTTDVPHHRRSGSSSSSSSEDDGQGGRRKKGIKDKVKEKLPGGHKDNQPHHEAGYGGGYGAQPEPEKKGMMDKIKEKLPGGHRN

SEQ ID NO: 19702 - protein, 290 aa, Zea mays
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYCTAGISGGHINPAVTFGLFLARKVSLVRALLYIVAQCLGAICGVGLVKAFQSAYFDRYGGGANSLASGYSRGTGFGAEIIGTFVLVYTVFSATDPKRNARDSHVPVLAPLPIGFAVFMVHLATIPVTGTGINPARSLGAAVIYNKDKPWDDHWIFWVGPLVGAAIAAFYHQYILRAGAIKALGSFRSNA

SEQ ID NO: 19703 - protein, 479 aa, Dunaliella salina
MATVQEYIDKHQLQKKTEDVLNIAVKSKPDEPLSFLAKELLRMAPSEILKVVGRQIIDSRGNPTVEADVHTHKGMFRAAVPSGASTGIHEAVELRDGDKTKFLGKGVQKAVESINTIISPALKGMDPKNQSEVDQKMIDLDGTPNKAKLGANAILAVSLATAKAGAAEKEVPLYRHIADLAGNPKLYLPVPAFNIINGGSHAGNALAMQEFMILPTGASSFSEAMRMGTEVYHTLKGIIKAKYGQDATNVGDEGGFAPNIQSNDDGLSLVTDAIEKAGYTGKVKIGMDVAASEFITEDKMYDLNLKQQPNDGSHKKTAAQMLEMYKEFCTKYPVISIEDPFEQDDWEPAKSLTAENICQVVGDDMLVTNPIRVKRGIEQKAVNSLLLKVNQIGSLTESIEAVRMSKEAGWGVMTSHRSGETEDCFIADLAVGLSTGQIKTGAPCRSERNAKYNQLLRIEEELGENAVYAGEKWRFIEWQ

SEQ ID NO: 19704 - protein, 383 aa, Coxiella burnetii RSA 493
MKNQSVVIIGSGLAGYLFAKEFRKLDTTTPLEIITANEGVFYSKPLLSTALTNKKSADELAVCTADKMASQLQAIIHTHSMVEVIDPISQTVTTSHKKIAYKKLILACGSYPIAPSLQGDAVSDVHSVNDLTAYGRFRRWINNKNRIAVIGAGLVGCEFTNDLVNGGYQVEVITKEPYPLAKFVPEPIGRALQQALADKGVQWHLQQVASTVNRHQKDYEISMTKGKAVAADGIFSAIGIRARCDLAESINLDRKTGIIVDSYLKTSIENIYALGDCAEVAGEIRQYIAPLLQCARALANHFAGDKKPVHYPPMPIVVKTPACAIVTYPPPKTLKGEWQCNGEGNNQRALFYDHQEKLQGFALSGECVKERMSLTQQLPSVFE

SEQ ID NO: 19705 - protein, 1104 aa, Micrococcus sp.
MSKKWKQKFLMVLALLLVIGGDAVCSSATGQAETSTAPADREVRLSILVRINDRDWIFGRGHRRRLMIKSILSRMKVGVRVSRHVAVAPRNEGIWICFAQHLKLDYSPKRIWGSLIQVNKDSLTQAFVTSGIEQIRIVPDGSAPVIDNGENAMFYYRDKELFAADAMNTIEKVELQFDGETHEMTYEPENERFVFLANDIPTGEHPYTYLVTKAGVTTEVTDPYNTVDGVSTLVFNQADLAVSGTVAPAAIDFNQNAVLSVDIEGITEDVKISKIVADTSLLGGSAQLEIDPTLKEISIAVDDDIAAGTKAIPLTVTDSYGNLYKGTAEVEVKTRQSVGEGDFDWDESVIYFMLTDRFFDGDASNNDPYDLNYDKESRGTYQGGDFKGITDKLDYLDELGVNTIWISPVVENIKYDVRYYETSEPYYGYHGYWANNFGELNPHFGTMEEFHDLIDGAHDRNMKIMVDVVVNHTGYGLKEIDGSVTNPPAGYPSDADRARFSDLLRQGADVGTDEVVGELAGLPDFITEDPNVRKQIIDWQTDWIEKATTENGNTIDYFRVDTVKHVEDATWMQFKNALTEKMPEFKMIGEAWGAKVDNTLGYLETGTMDSLLDFGFKETARSFVNGSLEAANASLTARNAKLDNTATLGQFLGSHDEEGFLHSLAGDKGKLQVAATLQATAKGQPVIYYGEELGQTGANNYPQYDNRYDFAWDQVEGNEILAHYTKILNFREGYSKVFAKGERTLVGGSDKDQFLLFSRDYQDQKVYVGLNVAEESKAVTLTVDSADAVVTDAYSGTEYTATAGKVNLTLPGKADPGTVLLTVEGGNITGVAKDNGEVVVELVPENNIRIHYKREDNVYKNYGAWLWNDVASPSANWPVGATMFEKTDSYGAYIDVPLADGAKNIGFLVMDITAGDAGKDGGDKGFTISSPQANEIWIKQGSDKVYTYEPVDLPANTVRIHYTREAVDYDDFGIWNWGDVASPSDGWPTGAVNFDGTDRYGAYPDIKLTEAAKEIGFLVVNEKTQEKDAGDKSFNLLDKFNHLWIKQGDDTVYVSPYDEVASGLGSAEVVSENTLLLRFNSTDGFTSEKLVAGLAIQDADSAAL

SEQ ID NO: 19706 - protein, 379 aa, Ophiostoma novo-ulmi
MLGITTLLLTLAVAANASPVVAPANTPTPSPVLAERATSCTFSGANGASLAIQSQAACATIVLNNVAVPSGTTLDLSKLADGATVIFEGETTWGYKEWAGPLLQIKGNGITVQGASGAVFNANGARWWDGKGSNSGKTKPKFFYAHGLTNSKILNLSIKNTPIQAVSINGCDGLTITDMTIDSSAGDSAGGHNTDGFDIGTSKNIIIDGAKVYNQDDCVAVNSGTKITFQNGLCSGGHGLSIGSVGGRSDNTVDTVTFYNSQIKNSVNGIRVKGTVGTTGTIKGVTYNKITLSGITNYGVLIEQNYNGGDLKGTATSGVPITGLTIKDISGTKAIASSGYNVVITCGSGACSGWTWSGVSVTGGKSYDKCTNVPNGISC

SEQ ID NO: 19707 - protein, 471 aa, Sulfolobus solfataricus
MPSTAEDVLKFLKENNIKWVDLQFTDVPGRLHHITIPADEFDLESLKTGFGKLDGSSIRGFTSIYESDMVLLPVPETMTLIPWSPGVARVLCKVFWGGGKGRFERDPRFIAEEAEKYQTEQGYTSYYGPELEFFMFDKVKLDVSAPQSGTGYKIYAREAPWTDSGTFVIRFKEGYYPAPPVDQLMDVRVEIVDTLVKYFGYTIEATHHEVATAGQGEIDFRFSTLVDTADKVQTLKYVAKNIAAKHGLVVTFMPKPIYGDNGTGMHTHLSLWTKDGKKNLMYDPNDEYAEISQFGRYVIGGLLTHARALSAIVSPTVNSYRRLIPGFEAPVYIAWSKGNRSAVIRVPAYYRGMEKAKRIEYRPPDPSTNPYLAFAALLMAALDGVNKKIDPGDPVDENIYHLTPEKRRQLGIKELPRSLNEALDELESDKEFLKPVFNSSILDTYIDLKRDEARSLQGYPHPMELYYYLDS

SEQ ID NO: 19708 - protein, 200 aa, Nicotiana tabacum
MATSGNKNMNAKLVLLGDVGAGKSSLLLRFVKGQFIEFQESTIGAAFFSQTVAVNDATVKFEIWDTAGQERYHSLPPMYYRGAAAAIIVFDITNQASFDRAKKWVQELQAQGNPNMVMALAGNKADLLDARKVAAEEAQTYAQENGLFFMETSAKTASNVNDIFYEIANRLPRLQPAQNPSGMVLMDRPAQTPASASCCS

SEQ ID NO: 19709 - protein, 491 aa, Malus x domestica
MTSILMGYDIGVMSGASIYIEKDLKVTDTQIEIMIGVIEIYSLIGSAMAGKTSDWVGRRYTIVISGAIFFIGAILMGFSTNYTFLMCGRFVAGIGVGYALTIAPVYSAEVSPTSSRGFLTSFPEVFVNIGILLGYLSNYAFSFCPLDLGWRLMLGVGAIPSVGLAVGVLAMPESPRWLVMQGRLGEAKRVLDRTSDSKEESMLRLADIKEAAGIPEECNDDIVQVSGHSHGEGVWKELLVHPTPTVRHILIAAIGFHFFQQASGIDALVLYSPRVFAKAGITSTNQLLLCTVGVGLSKTVFTLVATFFLDRVGRRPLLLTSMAGMVGALVCLGTSLTIVDQHEGVRMTWAVILCLCCVLAYVGFFSSGIGPIAWVYSSEIFPLRLRAQGCGMGVAVNRLMSGILSMTFISLYKAITMGGTFFLYAAIGTVGWIFFFTMLPETQGRTLEDMEVLFGKFHKWRKANKLLEKKKRVAHGDIGTSDPDNRAHLLA

SEQ ID NO: 19710 - protein, 481 aa, Malus x domestica
MTSILLGYDIGVMSGASLFIKENLKISDVQVEIMNGTLNLYSLIGSALAGRTSDWIGRRYTIVLAGTIFFIGALLMGFAPNYAFLMFGRFVAGVGVGYALMIAPVYTAEISPASFRGFLTSFPEVFVNIGILLGYVSNYAFSKLPIHLNWRIMLGVGAFPSVILAVGVLAMPESPRWLVMQGRLGDAKRVLQKTSESIEECQLRLDDIKEAAGIPKESNDDVVQVSKRSHGEGVWKELLLHPTPAVRHILIAALGIHFFEQSSGIDSVVLYSPRIFEKAGITSYDHKLLATVAVGVVKTICILVATVFLDKFGRRPLLLTSVAGMVFSLSCLGASLTIVDQQHGKIMWAIVLCITMVLLNVAFFSIGLGPITWVYSSEIFPLQLRAQGCSMGVAVNRVTSGVISMTFISLYKAITIGGAFFLYAGIAAVGWVFFYMLYPETQGRTLEDMEVLFGKYHKWREANALLQKAKQVDGDDKGQVH

SEQ ID NO: 19711 - protein, 472 aa, Anaxagorea phaeocarpa
QTETKASVGFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCVEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRMSGGDHIHAGTVVGKLEGERDITLGFVDLLRDDYIEIDRSRGIYFTQDWVSMPGVLPVASGGIHVWHMPALTEIFGDDSVLQFGGGTLGHPWGNAPGAVANRVALEACVQARNEGRDLARQGNEIIREASKWSPELAAACEVWKEIKFEFAAVDTL

SEQ ID NO: 19712 - protein, 319 aa, Solanum tuberosum
MAVNGSALSSGLIVSFGEMLIDFVPTVSGVSLAEAPGFLKAPGGAPANVAIAVTRLGGKSAFVGKLGDDEFGHMLAGILKTNGVQADGINFDKGARTALAFVTLRADGEREFMFYRNPSADMLLTPDELNLDLIRSAKVFHYGSISLIVEPCRSAHLKAMEVAKEAGALLSYDPNLRLPLWSSEAEARKAIKVSDVELEFLTGSDKIDDESAMSLWHPNLKLLLVTLGEKGCNYYTKKFHGSVGGFHVKTVDTTGAGDSFVGALLTKIVDDQAILEDEARLKEVLRFSCACGAITTTKKGAIPALPTESEALTLLKGGA

SEQ ID NO: 19713 - protein, 156 aa, Thinopyrum elongatum
MEYQGQQQHDQATTNRVDEYGNPVAGHGVGTGMGAHGGVGTGAAAGGHFQPTREEHKAGGILQRSGSSSSSSSSEDDGMGGRRKKGIKDKIKEKLPGGHGDQQQTAGTYGQQGHTGMAGTGGNYGQPGHTGMAGTDGTGEKKGIMDKIKEKLPGQH

SEQ ID NO: 19714 - protein, 258 aa, Archaeoglobus fulgidus
LRYNLWFGVYDGKEIKLSENFEESFLKAENPSPLPFNVSEVGAKALGKDYYRILRKTALAVSEKMVEKELRREDRYVVALVKALEEIDESINMLNEKLEDIRAVKESEITEKFEKKIRELRELRRDVEREIEEVMEKIAPNMTELVGAKVAAKLLERAGSMERLVRLPASKIQVIGAEKSLYKAFARMKKGKKAKIPKHGIIFLHPFIRTLPKAKRGKMARFLAAKLAIAAKIDYFRGEIDESLYESIRRRYEELRRK

SEQ ID NO: 19715 - protein, 468 aa, Thermotoga maritima
MGSSHHHHHHSSGLVPRGSHMASNVKKFPEGFLWGVATASYQIEGSPLADGAGMSIWHTFSHTPGNVKNGDTGDVACDHYNRWKEDIEIIEKLGVKAYRFSISWPRILPEGTGRVNQKGLDFYNRIIDTLLEKGITPFVTIYHWDLPFALQLKGGWANREIADWFAEYSRVLFENFGDRVKNWITLNEPWVVAIVGHLYGVHAPGMRDIYVAFRAVHNLLRAHARAVKVFRETVKDGKIGIVFNNGYFEPASEKEEDIRAVRFMHQFNNYPLFLNPIYRGDYPELVLEFAREYLPENYKDDMSEIQEKIDFVGLNYYSGHLVKFDPDAPAKVSFVERDLPKTAMGWEIVPEGIYWILKKVKEEYNPPEVYITENGAAFDDVVSEDGRVHDQNRIDYLKAHIGQAWKAIQEGVPLKGYFVWSLLDNFEWAEGYSKRFGIVYVDYSTQKRIVKDSGYWYSNVVKNNGLED

SEQ ID NO: 19716 - protein, 475 aa, Alnus incana
MSPQTETKASVGFKAGVKDYKLTYHTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 19717 - protein, 475 aa, Betula papyrifera
MSPQTETKASVGFKAGVKDYKLTYHTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFPAMDTL

SEQ ID NO: 19718 - protein, 475 aa, Carpinus caroliniana
MSPQTETKASVGFKAGVKDYKLTYHTPDYETKDTDILAAFRVTPQPGVPAEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIRAAAKWSPELAAACEVWKEIKFEFPAMDTL

SEQ ID NO: 19719 - protein, 212 aa, Corynebacterium ammoniagenes
GWIRITVLLAMLMGLTQQITGVNAVVYFAPTMMNQVGISATNSVYTSIVIGVVSVIACMVGIKVVDRIGRKRLLLIGLAGNTISLFILAGAYSFANGSVFFAMVSLFFMATFIASQQAAVSPATWLLISELVPSQVRGLGMGIAGLSLWVTNWAVAQYFLPLVEWLTGPVAFAIFGVLGIIAMGYTRALVPETMGKSLDEVGAEMHNRYAHK

SEQ ID NO: 19720 - protein, 449 aa, Sordaria macrospora
MVALTNLLLTTVLASAGLGSALPPRIGNTVIEAREPSEVPPLPLSSRKYTVSQKHNPNYKFNGAVSVYKTYLKYGAKVPDYLVQAVAVHFGVSTDDVLNRVFTHSKAPAPDQRRRRDRGSAAAVPIDKYDVAYVTPVSIGTPAQTLNLDFDTGSSDLWVFSSSLPLAQISGQEVYSPNTSTTAKLLSGASWSITYGDGSASRGNVYLDRVTIGGLVVQDQAVETAQQVSQSFTAETAIDGLVGLGFSSLNTVSPTAQKTWFDNVKSKLDAPLFAVDLKFNAAGTYDFGFIDPAKHTGNFTYVPVNTNPGYWTWTSTGYQVGSAPFVSQPIVNIADTGTTLVYLPNAILQAYYKQIAGAQNSRSYGGWVFPCATTIPDFTFGVTADAKITIPGRFINYGPVTDGSATCFGGLQSSAGVGINIFGDVALKAAYVVFNGGETPTLGWASKPV

SEQ ID NO: 19721 - protein, 407 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKVHVHQFSIITDLLGSPPRDVIITICSEDTLKFVTSLPHRDPVPFQERFKAVEPDAVDLLGRMLVFDPKKRITAADALVHPYLAPYHDPTDEPIAEAQFDWDFNDADLPVDTWRVMMYSEILDFHKIGGSDGQIDTNAAFDDQVAAATAGPMLPLWLNSNININNSHPVNIQVQLLRHQQPRITVVYQ

SEQ ID NO: 19722 - protein, 493 aa, Azorhizobium caulinodans
MNVKTWSRVGLPTLLAASALALPVLAQTAAPAADAPAAAAAIPINKGDTAWMLVSAALVLMMSVPGLALFYGGLVRTKNMLSVLMQVFYTVSVVGILWVLYGYSLAFTGGSDFVGGFSKAFLAGITPDSGTGTFSVGVNIPEFAFIAFQMTFAMITPALIFGAFAERVKFSAIVLFVPLWVTFIYFPMAHMVWYWAGPDAVDAAAKALAAADAGGKAAAQSALDAVLADAGYIYKLGAIDFAGGTVVHINAGIAAFVGCLIVGKRTGYGKEAFQPHSLTLTLVGAGLLWVGWFGFNAGSNLEANGLTALAMMNTFIATCAAALSWMVVEWLAKGKPSMLGVVSGAVAGLVAVTPMAGFAGIMGSLVSGLIVGVLCFFFCTTVKNAFGYDDSLDVFGVHCIGGIFGAIATGIVVSPALGGTGIFDYTTGKVADYDMATQVIAQVKAVVVTLVWSGVGSAVLYYIVHAVVGLRATVEREREGLDITEHGERAYHS

SEQ ID NO: 19723 - protein, 509 aa, Brassica juncea
MTSVNVKLLYHYVITNLFNLCFFPLTAIVAGKAYRLTIDDLHHLYYSYLQHNLITIASLFAFTVSGFGLYIATLPKPLTLVEYSCYLPPRHLKVSVSKIMDIFYQIRKADTSSRNVACDDPSSLDFLRKIQERSGLGDETYSPEGLIHVPPRKSFAASREETEKVIIGGIENLFENTKVKPKDIGILVVNSSKFNPTPSLSAMVVNTFKLRSNIKSFNLGGMGCSAGVIAIAIDLAKDLLHVHKNTYALVVSTENITQGIYAEENRSMMFSNCLFRVGGAAILLSNKSGDRRRSKYELVHTVRTHTGADDKSFRCVQQGDDEDGKIGVCLSKDITNVAGTTLTKNIAICRPLILPLSEKFLFFATSVAMKLLKDKIKHYYVPDFKLAVDHFCIQPGGRAVIDELEKNLGLSPIDVEASRSTLHRFGNTSSSSIWYELAYIEPKERLKKGNKGWQIALGLGFKCNSAVWVALNNVKASANSPWEHCIDRYPVKNDSDLSKSKTHVQNGRS

SEQ ID NO: 19724 - protein, 325 aa, Malus x domestica
MSSGAGKVVCVTGASGYIASWLVKLLLQRGYTVKASIRDPNDPTKTEHLHALDGAQDRLQLFKANLLEEGSFDSAVEGCEGVFHTASPFYHDVTDPKAELLEPAVKGTLNVLNSCAKSPSIKRVVLTSSIAAVAYNGKPRTPDVVVDETWFTDPDVCKESKLWYVLSKTLAEDAAWKFVKEKGIDLVTINPAMVIGPLLQPTLNTSAAAVLNVIKGARTFPNASFGWINVKDVANAHIQAFERPTASGRYCLVERVAHFSEVVRILRELYPTLQLPEKCADDKPFVPTYQVSKEKAKSLGVEFIPLDVSLKETVESLKEKGFVNF

SEQ ID NO: 19725 - protein, 422 aa, Aspergillus aculeatus
QLSGSVGPLTSASTKGATKTCNILSYGAVADNSTDVGPAITSAWAACKSGGLVYIPSGNYALNTWVTLTGGSATAIQLDGIIYRTGTASGNMIAVTDTTDFELFSSTSKGAVQGFGYVYHAEGTYGARILRLTDVTHFSVHDIILVDAPAFHFTMDTCSDGEVYNMAIRGGNEGGLDGIDVWGSNIWVHDVEVTNKDECVTVKSPANNILVESIYCNWSGGCAMGSLGADTDVTDIVYRNVYTWSSNQMYMIKSNGGSGTVSNVLLENFIGHGNAYSLDIDGYWSSMTAVAGDGVQLNNITVKNWKGTEANGATRPPIRVVCSDTAPCTDLTLEDIAIWTESGSSELYLCRSAYGSGYCLKDSSSHTSYTTTSTVTAAPSGYSATTMAADLATAFGLTASIPIPTIPTSFYPGLTPYSALAG

SEQ ID NO: 19726 - protein, 506 aa, Candida tropicalis
MIEQVLHYWYYVLPAFIIHWIVSAIHTNSLRRKLGAKPFTHTQLDGFYGFKFGRDFLKAKRIGRQVDLINSRFPDDIDTFSSYTFGNHVIFTRDPENIKALLATQFNDFSLGGRIKFFKPLLGYGIFTLDGEGWKHSRAMLRPQFAREQLPMSPSLEPHFNVKAYPQEQRWVFDIQELFFRFTVDSATEFLFGESVNSLKSASIGCDEETELEERKKFAEAFNKAQEYISTRVALQQLYWFVNNSEFKECNEIVHKFTNYYVQKALDATPEELEKQSGYVFLYELVKQTRDPNVLRDHHSISLLAGRDTTAGLLSFAVFELARNPHIWAKLREDVESQFGLGEESRIEEITFESLKRCEYLKAVMNETLRLHPSVPRNARFALKDTTLPRGGGPDGKDPILVRKMSCSIFISGTQIDPKHYGKDAKLFRPERWFESSTRNLGWAYLPFNGGPRICLGQQFALTEAGYILVRLAQSFDTLELKPDTEYLTKISHLTMCLFGAFVKMD

SEQ ID NO: 19727 - protein, 282 aa, Picea mariana
MAKEGSKEVEQQGFAAKDYKDPPPAALFDVSEFKLWAFYRAIIAEFIATLLFLYITVATVIGHKRNQAACGSVGLLGIAWAFGGMIFVLVYCTAGISGGHINPAVTFGLFLARKVSLPRAVLYMVAQCLGAICGCGLVKAFQKSYYDQYGGGANSVAHGYTKGVGLSAEIIGTFVLVYTVFSATDPKRNARDSHVPVLAPLPIGFAVFMVHLATIPITGTGINPARSFGAAVIYGHQKIWDEHWIFWVGPFLGAAGAAAYHQYILRAGAIKALGSFRSNPHV

SEQ ID NO: 19728 - protein, 163 aa, Picea mariana
EAITKFGKDPRSYEVLTKRFIADDNGNVKGLELITVKWEKDESGKFQLKEMEGTEEIIEAELVFLAMGFLGPEQNIAEKLDMERDNRSNFKANFGDFATSVDGVFAAGDCRRGQSLVVWAIAEGRQAAAQIDKFVMKEDQLITTCEDRVDDKDKRPMSLSKHK

SEQ ID NO: 19729 - protein, 269 aa, Picea mariana
SGVPPFWAETQQGIFDAVLRGYIDFDSEPWPSISESAKDLIRKMLTSNPAERLTAHGVLCHPWICKDGVAPDQALDPAVLSRLKQFSAMNKLKKMALMVIAESLSEEEIAGLREMFEAMDTDNSGSITFDELTAGLKRYGSNMKESEIRALMDAADVDNSGTIDYAEFIAATFHLNKLEREEHLFAAFSYFDKDASGYITVDELQQACLEHNLTDVRIDEIIREVDQNNDGRIDYNEFVAMMRKGNGAIGRRTMRNSLNFSRKDNLPIG

SEQ ID NO: 19730 - protein, 249 aa, Picea mariana
GMKGGAKVVIEPHRHEGVFIAKAKEDALVTKNMAAGESVYGEKRISVQNEDSTKTEYRVWNPFRSKLAAAILGGVDNIWIKPGTHVLYLGAASGTTVSHVSDIVGPTGIVYAVEMSHRSGRDLVNMAKKRTNVIPIIEDARYPVRYRMLVGMVDVIFADVAQPDQARIVALNAHYFLKNGGHFVLSIKANCIDSTVPAEAVFAQEVKKLQKEQFKPFEQVTLEPFERDHACVVGGYRMPKKQKAADAAA

SEQ ID NO: 19731 - protein, 198 aa, Picea mariana
MSTCKFIKCVTVGDGAVGKTCMLISYTSNTFPTDYVPTVFDNFSANVVVDGNTVNLGLWDTAGQEDYNRLRPLSYRGADVFILAFSLISKASYENIMKKWLLELRHFAPGVPIVLVGTKLDLRDDKQFFTDHPSAVPITTAQGEELKKQIGAAAYIECSSKTQQNIKAVFDSAIRVVLQPPKVKRKKKRKSHKTCSIL

SEQ ID NO: 19732 - protein, 232 aa, Picea mariana
SKGIDKAKNLFEEGGDWERKNRLKVYEGLYCMSTRNFKKAAELFLDSISTFTTYELFPYDNFIFYTVLTSIISLDRVSLKQKVVDAPEILAVISKIPHLSDFLNSLYGCQYKSFFVAFAGLTDQIRLDRYLHPHFRYYMREVRTVVYSQFLESYKSVTMEAMARAFGVSVDFIDRELSRFIAAGRLHCKIDKVVGVLETNRPDAKNALYQATIKQGDFLLNRIQKLSRVIDL

SEQ ID NO: 19733 - protein, 151 aa, Picea mariana
KKAKEKGVSLLLPTDVVIADKFAADANSKVVPASDIPDGWMGLDIGADSIKTFSEALDTTKTVIWNGPMGVFEFDKFSLGTTSIAKKLAELSGKGVTTIIGGGDSVAAVEKVGVAEKMSHISTGGGASLELLEGKTLPGVLALDEAVPVTV

SEQ ID NO: 19734 - protein, 117 aa, Picea mariana
QGNFFKSMSSFLQEAEEDIARIQSEENRAFSLVRETTEYFHGDAAKEEGRPLRFFVVVKDFLGVLDQVCREIGKTRTRMAQSSPRPPQVVAHAISMPLFPKALQRRPDSSDDESSSP

SEQ ID NO: 19735 - protein, 244 aa, Zantedeschia aethiopica
MASSAAFTAAPSPVRPLHGLADGGRRALRPALASATFSIRAPSGLSEFSSSLRRRFSLSSSTIRVSESKPRRTSGVVYATAATEKSIHDFTVKDIDGKDVSLSKFKGKVLLIVNVASRCGLTTSNYMELSHIYEKYKTQGFEILAFPCNQFGSQEPGTNSEIKQFACTRFKAEFPIFDKVDVNGPKTAPVYQFLKSSAGGFLGDLIKWNFEKFLVDKNGKVVERYPPTTSPFQIEKDIRKLVAA

SEQ ID NO: 19736 - protein, 481 aa, Helicobacter pylori
MIVRTQNSESKIKEFFEFCKENEVEFVDFRFSDIKGTWNHIAYSFGALTHGMFKEGIPFDASCFKGWQGIEHSDMILTPDLVRYFIDPFSADVSVVVFCDVYDVYKNQPYEKCPRSIAKKALQHLKDSGLGDVAYFGAESEFFIFDSIKIKDASNSQYYEVDSEEGEWNRDRSFENGVNFGHRPGKQGGYMPVPPTDTMMDIRTEIVKVLNQVGLETFVAHHEVAQAQGEVGVKFGDLVEAADNVQKLKYVVKMVAHLNGKTATFMPKPLYGDNGSGMHTHVSVWKNNENLFSGETYKGLSGLALHFLGGVLRHARGLAAFTNASTNSYKRLIPGYEAPSILTYSANNRSASVRIPYGISKNSARFEFRFPDSSSNPYLAFGAILMAGIDGIKNKMDPGEAMDINLFKLTLDEIIEQGIIQMPHTLRRSLEEMLADKQYLKQGQVFSEQFIHAYQSLKFHSEVFPWESKPHPFEFITTYSC

SEQ ID NO: 19737 - protein, 318 aa, Arabidopsis thaliana
MAKETVCVTGANGFIGSWIIRTLIEKGYTKIHASIYPGSDPTHLLQLPGSDSKIKIFEADLLDSDAISRAIDGCAGVFHVASPCTLDPPVDPEKELVEPAVKGTINVLEAAKRFNVRRVVITSSISALVPNPNWPEKVPVDESSWSDLDFCKSRQKWYPISKTLAEKAAWEFSEKHGTNIVTIHPSTCLGPLLQPNLNASCAVLLQLLQGSTETQEHHWLGVVHVKDVAKGHVMLFETPDASGRFLCTNGIYQFSEFAALVSKLFPEFAVHKFDKETQPGLTSCNDAAKRLIELGLVFTAVEDAVKETVQSLRDKGFL

SEQ ID NO: 19738 - protein, 510 aa, Arabidopsis thaliana
MLTVDSQHCFSFILLCFFSLLCYSLLFKKLKDSHVGRDLLQSPPSLPIIGHLHHLLSSLAHKSLQQLSSKYGPLLHLSIFNFPVVLVSSASVAYEIFKAHDLNISSRDNPPINESLLVGSSVFVGAPYGDYWKFMKKLLVTKLLGPQALERSRSIRADELERFYRSLLDKAMKKESVEIGKEATKLSINSICRMSMGRSFSEESGEAERVRGLVTELDGLTKKVLLVNILRWPLEKLRISLFKKEIMYVSNSFDELLERIIVEREKKPNEHQGTYLMDVLLEAYEDEKAEHKITRNHIKSLFVELLLGGTDTSAQTIQWTMAELINNRNVLKRLREEIDSVVGETRLIQEKDLPKLPYLQSVVKEGLRLHPPLPLMVRTFQRSCEMKGFYIAEKTTLVVNAYAVMRDPTTWEDPDEFKPERFLRQEEERRALKHIAFGSGRRGCPGSNLATIFIGTAIGTMVQCFDLSIKGDKVKMDEVGGLNLTMAHPLECILVPRTQPFISNQQIPSL

SEQ ID NO: 19739 - protein, 435 aa, Arabidopsis thaliana
MSVTAGVSESAIAVREKLKGGIGQTKVRRYWPGKAPEWAEEAEEDDDVRMQKVSVLDRAFPKNDDLGVARKDDPRLRRLAKTKVENRDEVRADHRRIRQAEIIYTEEEESRNQENRDEDDDEDALEERRRRIREKNLRRAQEEAALLPLEEEDEIQEEEEEEEESEYETDSEDDMPGIAMIKPVFVPKAERDTIAERERLEAEEEALEELAKRKLEQRKLETKQIVVEEVRKDEEIRKNILLEEANIGDVETDDELNEAEEYEVWKTREIGRIKRERDAREAMLREREEIEKLRNMTEQERRDWERKNPKPLSAQPKKKWNFMQKYYHKGAFFQADPDDEAGSAGTDGIFQRDFSAPTGEDRLDKSILPKVMQVKHFGRSGRTKWTHLVNEDTTDWSNPWTSNDPLREKYNKKMAGMDAPIAKPKGSKKMKDWES

SEQ ID NO: 19740 - protein, 471 aa, Arabidopsis thaliana
MWRRSNLPGNPDSDQSISEEEEENDISPKENAKEQERGLLLQTKLEKLIGCGELNYARETGDVTLEATLRKISSSLEDVVEVPDSPEESYISSSRRTGLACISAQENGSDDEITHDEQVATWSAISKETKSLIHLNGVASVASSHLSGFRAKKSSNGLKDHGRPKFSFNSHTHGETSSKISDMAEIFEPDVEDQAIEEDPIIECPNSFDERSENRQGVSVAESREVLHECTKDAVPKLQEIPLDKIRLIKRSSELDSRHEAKSRKFTHKGNSSNFQDSDTDDELPGPMDSGSSSDDEPSYQSSVPNISNQKKQFVGDRFDEAIKASSLSKEGLLFGSPKLSGGSSLYGKLQQIMKQEKETEMEIMRKLQSGIGEADSSGYVDVKVMSRHLEGKLVVCKCSVIDLSGDSLLLKNTQALAAKETETTIIFSPKVCADVDIEIGNFIRVYAPWKELEVQKTNDVIILSSYFSSL

SEQ ID NO: 19741 - protein, 387 aa, Corynebacterium glutamicum
MSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 19742 - protein, 448 aa, Corynebacterium glutamicum
MEDLSYRIPQSRTVAEQVPGPKSKALDERRQAAVARALAPGLPGYVVDADGGILADADGNRFIDLASGIAVTTVGGSNAAVAKAVGAAAARFTHTCFMVSPYETYVAMAERLNALTPGDHDKKSALFNSGAEAVENAVKVARAYTGKGAVVVFDNAYHGRTNLTMAMTAKNRPYKSGFGPLAADVYRAPMSYPLRDGLSGPEAAERAISVIESQVGAENLACVVIEPIQGEGGFIVPAPGFLAAISTWCRENDVVFIADEIQSGFLRTGDWFASDAEGVIPDVITTAKGIAGGMPLSAVTGRAEIMDAPGPGALGGTYGGNPVACAAALAAIEVMEQADLKTRAQEIETIIRDEFAQLSAFPEVAEIRGRGAMMAIELIDATGRPNAALTAAVAARAKAEGVLLLTCGTDGNVIRLLPPLVIAEDTLRDGLQVLVAALERETAHQKVG

SEQ ID NO: 19743 - protein, 437 aa, Corynebacterium glutamicum
MTHMTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGVDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADIFRFAPFFHTLLDNGVYAPPSVFETWFVSSALTDDDFSKIEQALKPAARAAAEAKAS

SEQ ID NO: 19744 - protein, 456 aa, Corynebacterium glutamicum
MALKGYTNFDGEFIEFGSVQAKEEEKRAFDNDRAHVFHSWSAQDKISPKVWAAAEGSTLYDFDGNAFIDMGSQLVSANLGHNNPRLVEAIQRQAARLTNINPAFGNDVRSDVAAKIVSMARGEFSHVFFTNGGADAIEHSIRMARLHTGRNKILSAYRSYHGATGSAMMLTGEHRRLGNPTTDPDIYHFWAPFLHHSSFFATTQEEECERALKHLEDVIAFEGAGMIAAIVLEPVVGSSGIILPPAGYLNGVRELCNKHGILFIADEVMVGFGRTGKLFAYEHAGDDFQPDMITFAKGVNAGYAPLGGIVMTQSIRDTFGSEAYSGGLTYSGHPLAVAPAKAALEIYAEGEIIPRVARLGAELIEPRLRELAEENVAIADVRGIGFFWAVEFNADATAMAAGAAEFKERGVWPMISGNRFHIAPPLTTTDDELVALLDAVEAAAQAVELTFAGALF

SEQ ID NO: 19745 - protein, 417 aa, Penicillium citrinum
MSLSNKLPVTDVDLKGKRVLIRVDFNVPLDENKNVTNPQRIVGALPTIKYAIDNGAKAVVLMSHLGRPDGKVNPKYSLKPVVPVLEKLLGKSVTFAEDCVGPQTEETVNKASDGQVILLENLRFHAEEEGSSKDAEGKKVKADKADVDAFRKGLTALGDVYVNDAFGTAHRAHSSMVGVDLPQKAAGFLVKKELEYFAKALESPARPFLAILGGAKVSDKIQLIDNLLPKVNSLIITGGMAFTFKKTLENVKIGNSLFDEAGSKIVGEIVEKAKKYNVEIVLPVDYVTADKFSADATVGAATDATGIPDGYMGLDVGPESVKLYQKTIAEAKTILWNGPPGVFELKPFASATEATLDAAVKAAESGSIVIIGGGDTATVAAKYKVEDKISHVSTGGGASLELLEGKELPGVAALSSK

SEQ ID NO: 19746 - protein, 403 aa, Chlamydophila caviae GPIC
MDRLTVRELSPEENKVLVRVDFNVPIKDGKILDDIRIRSAMPTINYLLQKRAAVILMSHLGRPKGTGFEEKYSLQPVVEVLEGYLGHHVPLAPDCIGEVARQAVAQLSPGRVLLLENLRFHRGEEHPEEDPTFAAELSSYGDFYVNDAFGTSHRKHASVYHVPQAFPGRSAAGLLMEKELEFLGQHLLHSPKRPFTAILGGAKVSSKIGVIEALLSQVNNLLLAGGMGFTFLKALGKSVGNSLVEESGIELARRVLKLAEQRNVRIVLPIDVKVAKACEPGVSWSETLIDQGIPADLEGLDIGTKTIQEFCKIIDASATVFWNGPVGVYEVPPFDQGSMAIANCLARHSSATTVVGGGDAAAVVALAGCTSQVSHVSTGGGASLEFLENGFLPGTEVLSPAQD

SEQ ID NO: 19747 - protein, 455 aa, Chlamydophila caviae GPIC
MNIWTRFFQPPKHIKELDDPELVKKQYKYWRIRIFYSMFIGYVFYYFTRKSFTFAMPTLMTDLGFDKAQLGIIGSTLYISYGISKFVSGVISDQSNPRYFMALGLIITGLTNIFFGMSSSILLFALWWGLNGWFQGWGWPPCARLLTHWYSKSERGTWWSVWSTSHNIGGALIPILTGFAIDCCGWRGAMFIPGALCIMMGFVLINRLRDTPQSLGLPAIEKYRKAQKAKKHEKTTADILEEEAEKELSTREILFTYVLKNKWIWLLSFASFFIYVVRMAVNDWSALFLIETKRYVAVKANFCVSLFEIGGLFGMLIAGWLSDKISKGKRGPMNVVFSLGLLFAILGMWYGRDQDMWWLDGTLLFVIGFFLFGPQMMIGLAAAELSHKKAAGTASGFAGWFAYFGAAFAGYPLGKIAQDWGWKGFFIALLSCALIALVLFLPTWNASERSLQTKK

SEQ ID NO: 19748 - protein, 351 aa, Chlamydophila caviae GPIC
MAMHLLEKFKAQRVSLLSRELVSCCDSSIASSDAGHVYQLFFNTTNSNLSYKVGDSLGIFPKNSLSVVGKILECLGYSPKQLVQTRESSHITFYDFLRCHANIDKIPAKLKSFFPDVEDSTSLYDAIQKYQPTISLELFTQSVLPLLPRFYSIASAPHPTEGKIELLVRLVSYSGEYEQRHGVCSFFLCKELEIGEECYAFVQPTKHFTIGDHVQNKPIVMIGSGTGIAPYKGFVQQRIYNNDPGMNLLFFGERFEKANFYYQNFWKKAIKNELLKLFLAFSRDGDQKIYVQDLLRKERELVLRACEEGAHFFVCGSKTLGSEVKKTLEDILGKDKLSQLKEERRYVIDVY

SEQ ID NO: 19749 - protein, 395 aa, Chlamydophila caviae GPIC
MQRNNNFSKLETSYLFSSIRQKIRAFREAHPDVSIIDLSIGDTTQPLHTAVMDTFTKSVQKLGNPETYRGYGPELGLSTLREKLSEVFYQGKVSPEEIFISDGAKMDIFRLLSLFGPGKTIAVQDPSYPVYIDTALLAGAKKVIKLPCRKETDFFPVIPQGEEIDIFCLCSPNNPTGTVLTKEQLEELITYANSHGSIILFDAAYSAFISDPSLPKSIFEIPEARSCAIEINSFSKSLGFSGVRLGWNVVPKDLRYSNGLPIIDDWKRFLHTTFNGASLPVQEAAITGASLFPNLEAIAHYRHNSSLLREALQKAEFSVYGGEHAPYLWVEVPKILPDEDFFDFFLTQYHIAITPGKGFGACGKGYVRFSSLGKIEDIMAACQRLTLTSVYDRMV

SEQ ID NO: 19750 - protein, 254 aa, Chlamydophila caviae GPIC
MERKSYVFGNWKMHKTAKEAKDFLSIFCPFVKEISPASLVGIAPAFTTLSACCESIKEMDSSIWLGAQNVHQDSSGAFTGEVSLPMLQEFHVNFVLLGHSECRHIFHEEDATIALKVGAAARSGVVPVLCIGETLEARENGTTKEVLSNQLMLGLAQLPETAPVIIAYEPVWAIGTGKVASTADVQEVHAFCREVLSRIFSKEKSEIISILYGGSVKADNAEGFARCPDVDGLLVGGASLDPQGFANVLRNFNL

SEQ ID NO: 19751 - protein, 392 aa, Chlamydophila caviae GPIC
MDYYDVLGVSKTASPEEIKKSYRKLAVKYHPDKNPGDAEAEKRFKEVSEAYEVLSDPQKRESYDRYGKNGPFAGAGGFGGMGGMGNMEDALRTFMGAFGGEFGGGGSFFEGLFGGLGEAFGMRGDPAGARQGASKKVHITLTFEEAARGVEKELLVSGYKTCETCLGSGAASEQGIKCCDRCKGSGQIVQSRGFFSMASTCPECGGEGRVITDPCSNCRGQGRIKDKRNVHVQIPAGVDSGMRLKMEGYGDAGQNGAPSGDLYVFIDVEAHPVFERRGDDLILELPIGFVDAALGMKKEIPTLLKEGMCRLTVPEGIQSGTILKVKNQGFPNVHGRGRGDLLVRVSVETPQNLSEEQKELLRKFATTEKAENFPKKRGFLDKIKGFFSDFAV

SEQ ID NO: 19752 - protein, 453 aa, Chlamydophila caviae GPIC
MTTKIKTQWTCNECGTNTPKWLGQCPGCLQWNTFIEEHISPSQSGRRSRTQATAVSLNTVELCEEERLCIGEPGWDRILGGGAVRGSLTLLGGDPGIGKSTLLLQTAAKFAHRGLKVLYVCGEESVTQTSLRARRLHISNANIYLFPETNLDDIKQQIATLHPDILIIDSIQIVFNPALHSSPGSVAQVREVTSELMHIAKQSQITTFVIGHVTKSGEIAGPRVLEHLVDTVLYFEGNSHANYRMIRSVKNRFGPTNELLILSMHADGLKEVTNPSGLFLQEKITETTGSVIIPIIEGSETLLIEMQALASSSPFANPIRKTSGFDQNRFLLLLAVLEKRAQIKFHTADVFLSIAGGLKVTEPAADLGAGLSVVSSLYNRLSPQNYTFTGEIGLGGEIRHVTHLERRLKESKLMGFEGAVIPEGQISGLSSEIKNQLDIRGVKTIKDAIRLLH

SEQ ID NO: 19753 - protein, 308 aa, Chlamydophila caviae GPIC
MRLFSYDKPKIKVQKIKADGFSGWLKCTHCHEMIHANELGQNFNCCPKCSYHYRITAAERIKLLADKDSWRPLYTNLKSQDPLKFVDTDTYPNRLAKARKDNTKSEGVLVGVCTIGEHPVALAVMDFNFMAGSMGSVVGEKLTLLIEKAIESKLPVIIVCASGGARMQESVLSLMQMAKTSAALAKLHEAGLPYISVLTNPTSGGVTASFASLGDVIIAEPKALICFAGPRVVAQVIGEDLPEGAQKSEFLLEHGMIDKVVERKQLKTTLQSLLDYFCAQEYTGGQDKAPRDLSKTLKEIFLLTDDGE

SEQ ID NO: 19754 - protein, 481 aa, Chlamydophila caviae GPIC
MTEQADIGLIGLAVMGKNLVLNMIDHGFSISVYNRSPEKTREFLQEHSQNTLLQGHENLEDFVRSLKRPRKVMLMIKAGAPVDQSIESLLPYLEPGDIIIDGGNSYYKDSERRCRDLKEKGILFVGMGISGGEEGARKGPSIMPGGNSEAWPAIAPIFQGISAKVHGNPCCCWVGSGGAGHYVKTVHNGIEYGDIQLICEAYGLLRTRLGISPEGISEIFAEWNSRELESYLMRISVEVLSLKGPDGSPVIDTILDVAGQKGTGRWTAIDAIDSGVPLSLIIESVLARFLSSWKTVREQAASELPGIPIVFEKPRDPHLFIEDVFQALYASKIISYAQGFMLLKQASEEHQWNLNFGELALLWRGGCIIQSAFLDAIHKGFENEPEAPSLILQTYFKSTLQNSESGWRRTVAYAVGSGYPVPCLAAALTFYDGYRTKDSSIALAQGLRDYFGAHSYERKDRPRGEFYHTDWIGTKTTTAVK

SEQ ID NO: 19755 - protein, 214 aa, Chlamydophila caviae GPIC
MVNSIFYIIMGPPGSGKGTQSQRLANHLGLPHISSGDLFRSAIKSATPLGSKAAEYINKGLLVPDNLVWEIVQETLNKPGCKSGCIIDGFPRTLDQAVLLNDFLVKSNAADYRVIQLDVSAEEIISRIHSRFICPACNYVYNQSQGFKECPTCHVALIRRSDDSLEVIHQRLESYEKATVPVINYYEDLGKLIHIPSETSPDEVFQSILACTEA

SEQ ID NO: 19756 - protein, 231 aa, Chlamydophila caviae GPIC
MNKKQRQKTLIAPSIMGGDLACIGAEAKKIEESGADLIHIDVMDGHFVPNLTFGPGVIAAINRSTDLFLEVHAMIYTPFDFIEAFVKAGADRVIVHFEASEDLKELLAYIKKCGIQAGLAFSPETSIEFIPPFLPFCDVLLLMSVHPGFCGQGFIPDVPDKIRFTRQALKTMGLEDSCLIEVDGGINEASAKECREAGADILVAASYMFQKDALTMEEKVLLLRGENHGIK

SEQ ID NO: 19757 - protein, 257 aa, Chlamydophila caviae GPIC
MNRIETAFKNTKPFIGYLTGGDGGFDYSVACAHALIRGGVDILEIGFPFSDPVADGPIIQKAHTRALEEKTDSTTILEIAKALRETSNIPLVLFSYYNPLLQKGPQYLHQLKAAGFDAVLIVDLPIPQHANESEPFFQALIEAKLFPIVLATPSTREERLLQIRKLAKGFLYYVSQKGTTGIRSKLSDDFSTQIARLRCYFQIPIVAGFGIANRASAAAALKHADGIVVGSAFVEKLEKKISPEELTTFAQSIDPRQ

SEQ ID NO: 19758 - protein, 357 aa, Chlamydophila caviae GPIC
MREALTFDDVLLVPQYSEVLPQDTCLASSVSESLSLTIPILSAAMDSVTELSMATAMSVAGGLGIVHKNMDVNAQVAVVKQIKSQSASSVVGGAVGIGQQGLERAEALVEAGIDALVVDTAHGHSKLVLDTAFTLKKNYPVTLIVGNIVSKAAALCLAEIGVDAVKVGIGPGSICTTRIISGVGLPQLTAIMDVSEALRDSSVRVIADGGMRYSGDIVKALAAGAHCVMLGSMLAGTDEAPGEIVQINERAYKMYRGMGSLGAMKKGSAERYFQESNAKKFVPEGVEGLVPYKGSLHDVLYQILGGIRSGMGYLGARNLEELRQNAVFSRITHSGRSESHIHNLQHIQHAPNYLISK

SEQ ID NO: 19759 - protein, 248 aa, Chlamydophila caviae GPIC
MVEPWICVDRVYKSYCNTEGQGHTVLQGISLEVFPDELLVILGKSGTGKSVLLRHIMGLEIPDSGEVRYAEELTHKGRLKDLTIGMVFQGGALFDFLSVRENIAFGLHAYNERYRVFSKGEINAKVDQALANVGLSYAAEFMPNKLSGGMVKRVALARSLVYSPKLVLYDEPTAGLDPMTSREMTHLIFRLRKEQGIGGIVITHDITLALTLADRIAIHHEGTIPLIYTKEEFIQTNDVLARQFFASE

SEQ ID NO: 19760 - protein, 437 aa, Chlamydophila caviae GPIC
MPVIDETPMTYTEACRYFPGGVNSPIRACIPVGIVPPIVSSASRDVFIDSFGKNFIDFCGSWGSLIHGHSHPKILDALCSAASQGTSYGLTSENEISLATTLFSCLGLQDHKLRFVSSGTEAAMTSVRLACGVTQRSVMIKFLGCYHGHADVLLKGMTIDENNLMEVPHLVDRYFSSDPCLPLTLILPYNDLKTFEEVMEKIGERVACVIFEPIAINMGVVLPEAGWIESIITTCRRYGALSIMDEVVTGFRMGSRGMRSILDVTPDITVYGKILGGGMPVAAVLAHQSIMEHLMPVGTVFQAGTLSGNPIAMAAGQASIELCQERDFYPKLENLTEGFLSPIEDFIRCKGFPIALVRAGSMFSFFFRETPPRNLRDVQECDQKTFGIFYRHAFSRGVYLSPASMEASFISSVHSRENLAYTQNVLIDSLVKTFEGI

SEQ ID NO: 19761 - protein, 481 aa, Chlamydophila caviae GPIC
MIARTKIICTIGPATNTPEMLEKLLDAGMNVARLNFSHGTHESHGETIRLLKELREKKGAPLAIMLDTKGPEIRLGNIPTPIQVSRGQKITLVGKEVEGSAEGGVTLHPQCVFPYVREGVDVLIDDGYIQAVVTSVGEDHLELEFINSGELKSHKSLSIREIDLALPFMTDKDINDLQFGVAQGVDVIAASFVRYAEDIESMRKCLADAGRPDMPIIAKIENRLGVENFSQIAKASDGIMIARGDLGIELSVVEVPNLQKFMAKMSREMGRFCITATQMLESMIRNVLPTRAEVSDVANAIYDGTSAVMLSGETASGSYPVAAVKIMRSVIQETEKNLNYKSFLELSDSECAVKVSPYLKSIGLSGIQIAEKADAKAIIVYTESGGSPIFLSKYRPRFPIIAVTPNLSVYYRLALEWGVYPMLTQESDRAVWRHQACIYGIERGILSNYDKILVLSRGAQMKDTNNLTLTTVNDIITASAK

SEQ ID NO: 19762 - protein, 227 aa, Chlamydophila caviae GPIC
MAFLILLRHGKSVWNEKNLFTGWVDIPLSQQGIDEAIHAGQVIKDLPIDCIFTSSLVRSLMTALLAMTHHSSKKIPYIIHDDEQQKLMSRIYSDEEKSMIPLYRSSALNERMYGELQGKNKKETAEEFGEEQVKLWRRSYKISPPGGESLYDTGLRTVPYFQETIFPLLKNSKNVFISAHGNSLRSLIMDIEKLSEEEVLSLELPTGKPIVYLWTGHTFERHPEPLG

SEQ ID NO: 19763 - protein, 462 aa, Chlamydophila caviae GPIC
MSTDFDCVVIGAGPGGYVAAITAAQQGLKTALIEEQQAGGTCLNRGCIPSKALLVGAGIVSQIKHAKQFGIHIDGYSVDYPTMVQRKNTVINGIRQGLEGLIRSNKITVLNGRGSLISSTEVRVKGQDTTVIKAKHIIIATGSESRPFPGVPFSSRVLCSTGILNLTELPKKLAIIGGGVIGCEFASLFNTLGVEVTIIEVADQILSVNNADISKTMLDKFSQRGIQVITRASINQLEDLGDRVKITVNDQPQEYEYVLVAIGRQFNTTDIGLDNAGVIRDERGVIPVDEMMRTNVANIFAIGDITGKWLLAHVASHQGIVAGRNAAGHNEIMDYSAVPAVIFTFPEVAMVGLSLEAAQKQNIPAKLTKFPFKAIGKAVAMAEADGFAAIISHETTQQILGAYVVGPHAASLIAEMTLAVRNELTLPCIYETIHAHPTLAEIWSESALLATNHPLHLPPPRL

SEQ ID NO: 19764 - protein, 424 aa, Chlamydophila caviae GPIC [sequence omitted]

SEQ ID NO: 19765 - protein, 276 aa, Gossypium herbaceum
WLFRKGREEEAKVILRKIYSADDVEKEIQDLKESVEAEIREEGSAKINMMKLLKTKTVRRGLIAGVGLQVFQQFVGINTVMYYSPTIVQLAGFASNKTALLLSLVTAGLNALGSIVSIYFIDRTGRKKLLLISLFGVAISLGLLAGVFHETTSHSPMVSRIQTSHFSNYTCPDYSSATNPGAWDCMKCLKASSPDCGFCASPTDKVKSHDISIFLQSLVFVFPSLIGFLLLLQILPGACLLSNDTVKDLCHDESRLWYTRGCPSKYGWLALVGLAL

SEQ ID NO: 19766 - protein, 276 aa, Gossypium raimondii
WLFRKGREEEAKVILRKIYPADDVEKEIQDLKESVEAEIREEGCAKINIMKLLKTKTVRRGLIAGVGLQVFQQFVGINTVMYYSPTIVQLAGFASNKTALLLSLVTAGLNALGSIVSIYFIDRTGRKKLLLISLFGEAISLGLLAGVFHETTSHTPMVSRIQTSHFSNYTCPDYSSATNPGAWDCMKCLKALSPDCGFCASPTDKVKSHDISIFLQSLVFVFPSLIGFLLLLQLLPGACLLSNDTVKDLCHDESRLWYTRGCPSKYGWLALVGLAL

SEQ ID NO: 19767 - protein, 276 aa, Gossypium barbadense
WLFRKGREEEAKVILRKIYSADDVEKEIQDLKESVEAEIREEGSAKINMMKLLKTKTVRRGLIAGVGLQVFQQFVGINTVMYYSPTIVQLAGFASNKTALLLSLVTAGLNALGSIVSIYFIDRTGRKKLLLISLFGVAISLGLLAGVFHETTSHSPMVSRIQTSHFSNYTCPDYSSATNPGAWDCMKCLKASSPDCGFCASPTDKVKSHDISIFLQSLVFVFPSLIGFLLLLQLLPGACLLSNDTVKDLCHDESRLWYTRGCPSKYGWLALVGLAL

SEQ ID NO: 19768 - protein, 276 aa, Gossypium barbadense
WLFRKGREEEAKVILRKIYPADDVEKEIQDLKESVEAEIREEGCAKINMMKLLKTKTVRRGLIAGVGLQVFQQFVGINTVMYYSPTIVQLAGFASNKTALLLSLVTAGLNALGSIVSIYFIDRTGRKKLLLISLFGVAISLGLLAGVFHETTSHTPMVSRIQTSHFSNYTCPDYSSATNPGAWDCMKCLKASSPDCGFCASPTDKVKSHDISIFLQSLVFVFPSLIGFLLLLQLLPGACLLSNDTVKDLCHDESRLWYTRGCPSKYGWLALVGLAL

SEQ ID NO: 19769 - protein, 458 aa, Lycopersicon esculentum
MAKTNGFMGHDMLAPFTAAWMIDMGPLVIDKAEGSYVYGVNGKKYLDSLSGLWCTVLGGSEPRLIEAASKQLNKSAFYHSFWNRTTKPSLDLAKELINMFTANKMGKVFFTSSGSEANDTQVKLVWYYNNAIGRPNKKKIISRKNAYHGSTYMTAGLSGLPSLHLKFDLPPPYILHTDCPHYWNYHLPGETEEEYSTRLANNLENLILKEGPETVAAFIAEPVMGGAGVIIPPATYFEKIQAVLKKYDILFIADEVICGFGRLGTMFGCDKYNIKPDLVSIAKALSGGYIPIGAVLVSEEISKVIMSQSNQLGVFCHGFTYSGHPVACAVALEALKIYKEKNITEVVNKLSPKLQEGLKAFIDSPIIGEIRGTGLVLSTEFVDNKSPNDPFPPEWGVGTYFGSQCQKHGMLVSFSGDHVNMAPPFTLSLEELDEMISIYGKALKDTEKRVEELKSQKK

SEQ ID NO: 19770 - protein, 440 aa, Schizosaccharomyces pombe [sequence omitted]

SEQ ID NO: 19771 - protein, 356 aa, Eucalyptus globulus
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCSPCNSDQEQYCNKKIWNYNDVYTDGKPTQGGFAGEIVVGERFVVKIPDGLESEQAAPLMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVVGSKLD

SEQ ID NO: 19772 - protein, 379 aa, Campylobacter jejuni
MEISYYEILEITQNADKETIKKAYRKMALKYHPDRNQGDKEAEDKFKLVNEAYEVLTNDEKRAIYDRYGKDALKGGGFGSSSSGFAGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNETKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRIGNQIVQISIKFPTFLNDEQKELLEKLSEVLVSKMVCIKTKKDFLKKSLIGLSLNFPKAF

SEQ ID NO: 19773 - protein, 232 aa, Flaveria trinervia
MSFTISTSFLQPLEISNLKSSPITSKSKVTSTSIVCSGSTDEKINNADGKSSLKALSAALALSSILVSSTVPALPASADISGLTPCKESKQFAKREKQSLKKLESSLKLYAPDSAPALAIKATMEKTKRRFDNYGKQGLLCGSDGLPHLIVSGDQRHWGEFITPGILFLYIAGWIGWVGRSYLIAIRDEKKPTQKEIIIDVPLATKLLFRGFSWPVAAYREYLNGELIDPTV

SEQ ID NO: 19774 - protein, 509 aa, Rhodococcus ruber
MTGTLSRDSGTTNQVDERLGAAAREFLGRPHQLFIDGQWVDAADGRTFGTYDPATGAEITQVAHGGPEDVDRAVAAARRAFDDGDWATMKPNKREQILWRIGDLLDARGEMLGQIEALDNGKSAAIATAVDVTFAADVFRYYAGWCTKIEGTTVDVSMPFAGDKQFHAYTQRVPVGVCGQIIPWNFPLLMAAWKLAPALATGNTLVLKPAEQTPLTALLLGEIMAEAGVPDGVVNIITGFGDAGAAISAHDDVDKVAFTGSTEVGKLIVDAAKGNLKKVSLELGGKSANIVFADCDFDAAVAGSVAAWMFNHGQACTAGTRLYVEDSIYEKFTQAVADAAAQATIGHGLDPATELGPLVDQDQFDKVSYYLRAGIEDGGRALTGGGRHGDTGYFIQPTVFVDVEPDHRVVTDEIFGPVVAALRFSDMDDAVRQANDSIYGLAAGVWTKDISKAHKVASRLHAGSVWVNQYNGFDTAMPFGGFKQSGWGRELGKGALDLYTQTRSVNIQL

SEQ ID NO: 19775 - protein, 369 aa, Rhodococcus ruber
MKTKAAVLFDLHKPFEIIELELDDPGPGEVLIKYTAAGLCHSDLHLSDGSLPPRFPIVGGHEGAGIIEAVGVGVTKVKPGDHVVCSFIPNCGTCRYCSTGRQNLCDMGATILEGHMPDGTFRFHAGGKDFGAMCMLGTFSERSVISQHSVVKVDDWLPLDKAVLVGCGVPSGWGTATYAGNVRQGDTVVIYGIGGLGINAVQGAVHSGARHVVVVDPVQFKRDEALKFGATHAFADAAEAHAEVEKLTWGQMADQALILVGTVDEPVVSSAFDVIGKGGTVVITGLGNMTDKTVQVSGTMMALFGKTITGTVFGSANPQYDIVKLLRLYDEGKLKLDELITTTYTLDQVNEGYQDLQDGKIMRGVIIHD

SEQ ID NO: 19776 - protein, 419 aa, Rhodococcus ruber
AAERERMIWRVGDLLTQRAEEFGQLEALDNGKSAVIAAAVDTAWSADIFRYYAGWATKIEGSTVNVTMPFVPGGEFHAYTLREPVGVCGLIVPWNFPLLMAAFKLAPALAAGNTVILKPAEQTPLTALLLAEIFEEAGFPPGVVNIVPGFGDAGAALAAHDDVDKIAFTGSTEVGKKVVDAAKGNLKKVSLELGGKSPNIVFADADFDAAVQGSLDAWLFNHGQCCVAGTRLFVERPIFERFTEAVAEAASKVKIGPGLDPATQLGPLVSQEQLDRVTGYLREGLIDGARALTGGKRWGDKGFFVEPTVLVDVQPDFSVVREEIFGPVVNAMPFDADDGISAAANDSIYGLAAGIWTRDLSKAHRTARRLKAGSVWINQYNGFDTAMPFGGFKQSGWGRELGAGALDLYTQTKAVNIAL

SEQ ID NO: 19777 - protein, 370 aa, Rhodococcus ruber
MKTKAAVLLETGKPFEIMELDLDGPGPGEVLIKYTAAGLCHSDLHLTDGDLPPRFPIVGGHEGSGIIEEVGPGVTKVKPGDHVVCSFIPNCGTCRYCSTGRQNLCDMGATILEGCMPDGSFRFHSGSTDFGAMCMLGTFAERATISQHSVVKVDDWLPLETAVLVGCGVPSGWGTAVYAGDVRAGDIVVIYGIGGLGINAVQGAVHAGAKYVVVVDPVEFKRDTALKFGATHAFATAAEAAEKVNELSWGQGADAALILVGTVDEEVVSAATSIVGKGGTVVITGLANPEKLTVHVSGTELTLFQKTIKGSLFGSANPQYDIVRLLRLYDAGQLKLDELVTHRYSLEEVNQGYQDLRDGKNIRGVILHDA

SEQ ID NO: 19778 - protein, 375 aa, Rhodococcus ruber
MKTKGAILWGLNEPWSVEEIEIGDPVAGEVQIRMEAAGMCHSDHHIVTGATPMPSFPVMGGHEGSGVITKVGDGVVGLEVGDHVVLSFIPACGRCPSCATGHSNLCDLGAGLLSGMAISDGTYRIQARGQHVIPMCLLGTFSPYMTVNQTQVVKIDKDVPFELAALVGCGVPTGWGSATHVADVKPGEAVAVIGVGGVGISALQGAVASGARQIFAIDPVPWKREQALKFGATHALPRRWRALMPIMETTWGRMADKTIITVGEMRGEYVEEALQLTAKNGRCVVTAMGHMTDMDVKLNAFLFAMLQKDLQGNIFGGCNARVDIPNLLAMYKAGQLNLADMVTRTYTLEQVNDGYQDMLDGKNIRGVIRYTDADR

SEQ ID NO: 19779 - protein, 303 aa, Rhodococcus sp. DS7
MKTKAAVLLEPGKPFEIMELDLDGPGVGEVLIKYTAAGLCHSDLHLTDGDLPPRYPIVGGHEGSGIIEEVGPGVTKVKPGDHVVCSFIPNCGTCRYCSTGRQNLCDMGATILEGSMPDGSFRFHGNGMDFGGMCMLGTFSERATISQHSVVKIDDWLPLETAVVVGCGVPSGWGTAVNAGNLRAGDTAVIYGIGGLGINAVQGAVSAGCKYVVVVDPVALKRETALKFGATHAFADAESAAAKVNELTWGQGADAALILVGTVDEDVVSAATAVIGKGGTVVITGLADPAKLTVHVSGTDLTL

SEQ ID NO: 19780 - protein, 464 aa, Paracoccus denitrificans
MSTYDLIVIGAGPGGYVCAIRAAQLGLKVACVEGRETLGGTCLNVGCIPSKALLHASHMLHETHENFEKMGLMGAKPKVDWGKMQGYKAETVGGNTKGIEFLFKKNKIDWLKGWASIEAPGKVKVGDTTHETKNIVIATGSEPASLKGVEVDNDAGIVVDSTGALSLPKIPKSMVVIGAGVIGLELGSAYARLGAEVTVVEFLDAITPGMDGEVQKQFQRILAKQGLKFVLGAAVSGVEVEKGKAEVKYKLRKDDSEHEIKAECVLVATGRRPYVAGLGLDKVGVALTDRGFVQIDDHWQTSVKGIYAIGDAVPGPMLAHKAENEGMAVAEVIAGKHGHVNYDVIPGVIYTTPEVASVGLTEEAAKESGRKIKVGKFPFMGNARAKALFQAEGFVKMIADAETDRVLGCHIIGPNAGEMIHEVCVAMEFGASAQDIALTCHAHPTCSEAVREAALACGDGAIHA

SEQ ID NO: 19781 - protein, 487 aa, Bacillus cereus ATCC 14579
MWESKFVKEGLTFDDVLLVPARSDILPREVSVKTVLSESLQLNIPLISAGMDTVTEADMAIAMARQGGLGIIHKNMSIEQQAEQVDKVKRSESGVISDPFFLTPEHQVYDAEHLMGKYRISGVPVVNNLDERKLVGIITNRDMRFIQDYSIKISDVMTKEQLITAPVGTTLEEAEKILQKYKIEKLPLVDNNGVLQGLITIKDIEKVIEFPNSAKDKQGRLLVGAAVGVTADAMLRIDALVKASVDAIVLDTAHGHSKGVIDKVKEVRAKYPSLNIIAGNVATAEATKALIEAGANVVKVGIGPGSICTTRVVAGVGVPQLTAVYDCATEARKHGIPVIADGGIKYSGDMVKALAAGAHVVMLGSMFAGVAESPGETEIYQGRQFKVYRGMGSVGAMEKGSKDRYFQEGNKKLVPEGIEGRVPYKGPLADTVHQLVGGLRAGMGYCGAQDLEFLRENAQFIRMSGAGLRESHPHHVQITKEAPNYSL

SEQ ID NO: 19782 - protein, 180 aa, Bacillus cereus ATCC 14579
MMNQDIEKVLISEEQIQEKVRELGAIIAEDYKNTVPLAIGVLKGAMPFMADLLKRTDTYLEMDFMAVSSYGHSTVSTAEVKILKDLDTSVEGRDILIVEDIIDSGLTLSYLVDLFKYRKAKSVKIVTFLDKPTGRKVDLKADYVGFTVPHEFVVGYGLDYKEQYRNLPYVGVLKPSVYSN

SEQ ID NO: 19783 - protein, 307 aa, Bacillus cereus ATCC 14579
MRVAQSVSELIGKTPIVKLNRIVESDSADIYLKLEFMNPGSSVKDRIALAMIEDAEKKGLLKEGDTIIEPTSGNTGIGLAMVAAAKGYNAILVMPETMSIERRNLLRAYGAELVLTPGPEGMGGAIRKATELAKEHGYFIPQQFKNQSNPEIHRLTTGPEIIEQMGDQLDAFIAGIGTGGTITGAGEVLKEAYKDIKIYAVEPADSPVLSGGKPGPHKIQGIGAGFVPETLDVEVYDEIIQVKTEQAFEYARRVAKEEGILVGISSGAVIYAATEVAKKLGKGKKVLVIIPSNGERYLSTPLYQFES

SEQ ID NO: 19784 - protein, 458 aa, Bacillus cereus ATCC 14579
MAKKKTKFTCQECGYQSPKYMGKCPGCGQWNSLVEEMEPVVSSRRLNYANAIQTEVTKPRRLTEVETKSEARIETKFQEFNRVLGGGIVDGSLVLIGGDPGIGKSTLLLQISSQLADASYDVLYISGEESAKQIKLRADRLHVNGSNLFVVSETDLQRIAAHIEEMNPAFVVIDSIQTIHLPEVTSAPGSVAQVRECTAELMKLAKTKGIPIFIVGHVTKEGAIAGPRMLEHMVDAVLYFEGDRHHTYRILRAVKNRFGSTNEMGIFEMKELGLAEVLNPSEIFLEERPVGVAGSTVVASMEGTRPVLVEIQALISPTSFGNPRRMATGIDHNRVSLIMAVLEKRTGLLLQNQDAYLKVAGGLKLDEPAIDLAVALSIASSFRDKSTAPTDAVIGEVGLTGEIRRVSRIEQRVQEAAKLGFQRAIIPRKNLGGWTIPEGIEVVGVSNLGEALRLTLGG

SEQ ID NO: 19785 - protein, 135 aa, Bacillus cereus ATCC 14579
MIDAKQLNSLALAYMGDAVYEQYIRYHLLQKGKVRPNQLHRLGTSFVSAKAQAKVVYHLLETAFLTEEEEAVLRRGRNANSGTVPKNTDVQTYRHSTAFEALIGYHHLLNNRERLDEIVYKAIAVLEEQEGGTSS

SEQ ID NO: 19786 - protein, 216 aa, Bacillus cereus ATCC 14579
MNLILMGLPGAGKGTQAEQIVAKYNIPHISTGDMFRAAMKAETEMGLQAKSFIDKGALVPDEVTIGIVRERLSQDDCVRGFLLDGFPRTVAQASALEEIMKDLGKKIDYVLNINVDSGLLLKRLTGRRICKECGATYHLEFNPPAKADVCDKCGGELYQRSDDNEETVANRLDVNIKQTKPLLDFYEELGYLQSINGEQDINKVFADIDVLIGGLA

SEQ ID NO: 19787 - protein, 297 aa, Bacillus cereus ATCC 14579
MKKEISVIGVPMDLGQMRRGVDMGPSAIRYAGVIERIEEIGYDVKDMGDICIEREKEIDENTKLRNLTQVATVCNELASKVDHIIEEGRFPLVLGGDHSIAIGTLAGVAKHYKNLGVIWYDAHGDLNTEETSPSGNIHGMSLAASLGYGHSSLVDLYGAYPKVKKENVVIIGARALDEGEKDFIRNEGIKVFSMHEIDRMGMTAVMEETIAYLSHTDGVHLSLDLDGLDPHDAPGVGTPVIGGLSYRESHLAMEMLAEADIITSAEFVEVNTILDERNRTATTAVALMGSLFGEKLK

SEQ ID NO: 19788 - protein, 471 aa, Bacillus cereus ATCC 14579
MVIVAYTVLLATSVHTYKKQIDHPIMSDVGKLLPTKIKRVESATEEHSLIKLVRDAKVSGEKISIAGMQHSQGGQTYYPNGTMLDMKGYNKILEFDPEKKQITVQSGVTWNDIQKKINPYGLAVQVMQSQNIFTVGGSLSVNVHGRDIRHEALIDTVDSFRLLMADGTVRNVSREENAELFPYVIGGYGLFGVILDVTLKLTDDELYEMHTRMIDYKEYVSYFKEKVKRDENVRMHLARISVAPNSFLKEMYVTDYTLAQNQNMREEYSELKEENIIAVPKFLLGLSRYSDWGKNTFWDIQRGYFERTDGKYETRNNVMRSDSAFMEYENPNRTEVLQEYFVPIDAFTEYIDDLRNVLNEEEFNLLNITIRYVEKNENAVLSYAKDDMFALVLLINQGRSESEIKKTEDVIRKMIDVTLKHNGSYYLPYYSYPTKEQLKRAYPRIEEFLKKKKEVDSEERFVNLFYREYTK

SEQ ID NO: 19789 - protein, 441 aa, Bacillus cereus ATCC 14579
MKRYFQFDELGTNYKTEFIAGLTTFLSMAYVLFVNPATLSLGNVKGLPAGTGMDPGAVFVATALAAAIGSLIMGIFAKYPIALAPGMGINAFFAYTAVLTMGIPWQTAIAGTLMSGIIFIILTASGIREKIINAIPSELKFAVAAGIGLFIAFLGFQNAGIIVKNDAVLVGLGDLTKGTTLLAIFGVVTTIIFMIKKINGAVFYGMILTAILGVATGLIDTPKAVVGAIPSLEPTFGVALTHFGDIFTVQMGIVIITFFFIDFFDTAGTLVAVANQAGLMKNNKLPRAGKALFADAIATVIGAILGTSTTTSYIESSAGVAAGGRSGFTAVVTAGFFLLALFFSPLLSVVTPAVTAPALIIVGILMVSSLGEIDWKKFEIAVPAFFTIISMPLTYSIATGIAIGFIFYPITMVVSGRRKEVHPIMYVMGVLFVLYFIYVRK

SEQ ID NO: 19790 - protein, 511 aa, Bacillus cereus ATCC 14579
MKKRALVSVSDKTGVVEFVKGLLEQGIEVISTGGTKKLLEENGLQVIGISEVTGFPEIMDGRVKTLHPNIHGGLLAVRDNETHVTQMNELGMEPIDFVVVNLYPFKETIAKPDVTFADAIENIDIGGPTMIRSAAKNHKFVSVIVDPVDYDIVLAELKENGEVAEETKRKLAAKVFRHTAAYDALISNYLTEQMGEESPETLTVTFEKKQDLRYGENPHQKATFYKAPFAATSSVAYAEQLHGKELSYNNINDADAALSIVKEFTEPAVVAVKHMNPCGVGVGTDIHEAYTRAYEADPVSIFGGIIAANREIDKATAEKLHEIFLEIVIAPSFSQEALEVLQSKKNLRLLTINIEKATSASKKLTSVQGGLLVQEEDTLSLDESTISIPTKREPSEQEWKDLKLAWKVVKHVKSNAIVLAKDDMTIGVGAGQMNRVGSAKIAITQAGEKAQGSALASDAFFPMPDTLEEAAKAGITAIIQPGGSIRDEDSIKVADTYGIAMVFTGVRHFKH

SEQ ID NO: 19791 - protein, 339 aa, Bacillus cereus ATCC 14579
MISFNNVSKLYESAGQSVHAVEDVTLSVEKGEIFGIIGFSGAGKSTLLRLVNMLERPTAGTISIDDKDITSLSTKELRKLRQRIGMIFQSFNLFNSRTVFGNIAYPLKLAKVPKNEIKERVNELLKFVGLEDKANYYPEQLSGGQKQRVGIARALATSPDILICDEATSALDPETTTEILNLLKKVNREYNLTILLITHEMHVVKEICHRVAVMEKGKVIEEGKLFDVFTQPKTKTTQNFVRSVINDHLPESVLAKIQNGGQIYRLTFTGEETGQPVLSYIAKNYNVDVNVLYGNIIELQNVLFGNLLVELQGEQREIQKALQHLRLQVQLKEVEAHAS

SEQ ID NO: 19792 - protein, 479 aa, Bacillus cereus ATCC 14579
MLEKKVGIYFAIKRENNVKKRMGYAMNTKKFAKVNEQIPGPKAASLLERRQNIVPKGVSNGIPTFVRSANGALVTDVDGNQYIDFAGAIGTINVGHCHPTVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFIIEEFKNFFISEVAPETIAAVVMEPVQGEGGFIVPSKKFVQEVRRICSENGILFVADEIQTGFSRTGKYFAIDHYDVVPDLITVSKSLGAGVPISGVIGRKEIMNESAPGELGGTYAGSPLGCAAALAVLDVIENEKLNDRAIELGKVVMNRFEEMKNKYHCIGDVRGLGAMCAFEVVQDRKTKAPDKTLTANLCAEANKRGLLLLSAGTYGNVIRVLMPLVITDEQLEEGLTIIEESLQACYEQTNIARV

SEQ ID NO: 19793 - protein, 483 aa, Bacillus cereus ATCC 14579
MDKKATFVSIDKKAMYINGEWITLQEQIEVNNPATKEIFATVPKGGVTEAKQAVDAAHEAFKTWSKLTAADRATKLKKWFTLIDENKEEIAAIMTKEQGKPFAEALGEVNYANSFVEWYAEEGKRVYGEMIPAAHPNKRILVMKQPVGVMAAITPWNFPAAMITRKVAPALAAGCTAVVKPASQTPLTALKLAELAHEADIPKGVINIITGSAKAIADTWMEDGRVRKVSFTGSTEIGKELMASAAQTMKKVSLELGGHAPFIVMNDADLDKAVEAVIGSKFRNAGQTCICTNRVFVQEEVYEVFVEKFQKAVGQLKVGDGFGDGTTVGPLIDENAVSKVQEHIEDAIQKGGTVLYGGQKVAELEGHFIQPTVIGLANDTMLCMNEETFGPVAPVAKFKTVDEVIERANNTPYGLAAYIFTKDISQAFQISEALEYGIIGLNDGLPSVAQAPFGGFKESGIGREGGHFGIEEYLEIKYISLGL

SEQ ID NO: 19794 - protein, 436 aa, Bacillus cereus ATCC 14579
MNIMQPSAPPHLESTETIFPSSITKLVVFICWLAILADGYDLGIYGAVLPKLLEDKSWALSPAHAGTIASYALLGMFIGAILVGTITDLIGRKWTLICCLALFSITMGLAAIAPSPELFGLSRFIGGIGLGGVIPTASALTVEYSPKKRQSFIYALMFTGYPLGIVLGAILSMLMLEDFGWRIMFGIGMIPLLLIPFIIRYLPESIQFLLSRNRQEEVNQILNRFQIEFHVKDKTHQDPSTIRKKNGFFTLFSKEYIKATLLFWITYIMGMFLIYGLNTWLPQMMRQAGYPLGSSLSFLLMLNITAAIGALFAGAIADRIGAKIVISISYLMAAICIGLLTIKPSVTIIYLLIGLAGIGSVGITQILNAYVTQYFPSHIRATSLGWGLGLGRVGAIAGPILVGIIMTMQYDLAWNFYLFSFAGLIAAISVFFIPTK

SEQ ID NO: 19795 - protein, 240 aa, Bacillus cereus ATCC 14579
MIQVRNLVKSFGSLDVLKGIDLEVKEKEVVVLIGASGSGKSTLLRCLNFLEMYDEGEIHLQGERIDPKHSNLNKVRENVGMVFQHFNLFPHMTSLENIIEAPIHVKKLEKANAQDIGNQLLQKVGLQDKADVTPHLLSGGQKQRIAIARALAMSPKIMLFDEPTSALDPELVGEVLQVMKELAEEGMTMVIVTHEMNFAKDVADRVIFMDDGKIVEDAPPVQFFSAPSHERAKQFLRNVL

SEQ ID NO: 19796 - protein, 340 aa, Bacillus cereus ATCC 14579
MTKIFILASTLSLSFFSGLNIGNTTTENFQPLTNAIVQNSDHFAEGNSKDNNIPPGNNGSQDDTGSGDNGSGGNGSGGNGSGGSGSGGNGSGGNGSGDNGSGGNGSGDNGSGGNGSGDNGSGGNGSGDNGSGGNGSGDNGSGGNGSGDNGSGGNGSGGSGSDGSGSGGNGSGGNGSGGNGSGDNGSGGNGSGGNGSGGNGSGGNDSGGNGSSGNGSGGNGSGGNGSGGNGSGGNGSGGNGSGGNGSGGNGSGGNGSQGGNRVKGDSSSQGGNGSQGGNRVKGDSNSQEGTGSQGGNVKDNTKKQGDKLPNTATHYPISILMGLSTFLIGMLLFIRRKNVK

SEQ ID NO: 19797 - protein, 309 aa, Bacillus cereus ATCC 14579
MQCIETNNLQQLLEQVKPYTKKGKLATYIPELGNANPDDLGIAIFHKETEYIHAGNSQTLFTLQSISKVITLALALLDRGEEYVFSKVGMEPTGDPFNSIIKLETTSPSKPLNPMINAGALAITSMLEGKDNEEKMERILHFVREITDNPTINYSSKVADSELETAYLNRSLCYYMKQNGIIDCDIEELMDLYTRQCAVEVNCIDLARIGLIFAMDGYDPYKKKQIIPKHITKICKTFMVTCGMYNESGEFAIRVGIPAKSGVAGGIFGCVKGDMGIGIFGPALDANGNSIAGFKILELLSAQEGWSIF

SEQ ID NO: 19798 - protein, 432 aa, Bacillus cereus ATCC 14579
MNFTKSEALHKEALEHIVGGVNSPSRSFKAVGGGAPVAMERGKGAYFWDVDGNKYIDYLAAYGPIITGHAHPHITKAITTAAENGVLYGTPTALEVKFAKMLKEAMPALDKVRFVNSGTEAVMTTIRVARAYTGRTKIMKFAGCYHGHSDLVLVAAGSGPSTLGTPDSAGVPQSIAQEVITVPFNNVETLKEALDKWGHEVAAILVEPIVGNFGIVEPKPGFLEKVNELVHEAGALVIYDEVITAFRFMYGGAQDLLGVTPDLTALGKVIGGGLPIGAYGGKKEIMEQVAPLGPAYQAGTMAGNPASMASGIACLEVLQQEGLYEKLDELGAMLEKGILEQAAKHNIDITLNRLKGALTVYFTTNTIEDYDAAQDTDGEMFGKFFKLMLQEGVNLAPSKYEAWFLTTEHTKEDIEYTIEAVGRAFAALADNK

SEQ ID NO: 19799 - protein, 487 aa, Bacillus cereus ATCC 14579
MTHYKDDSYALHTDLYQINMAYTYWKDGIHNRRSVFDLYFRKLPFENGYAVFAGLEKIVEYIENFSFTESDIAYLAELQFEEEFLHYLQNMKFTGTIRSMQEGEVVFNNEPLLRVDAPLGEAQIIETALLNIVNYQTLIATKAARMKHAASNDELLEFGTRRAHEFDAALWGTRAAFIGGFSSTSNVRAGKRFGIPVAGTHAHSFVQAYRDEYVAFKKYAETHKKCVFLVDTYDTLKSGVPNAIRVAKEFGDRIDFYGIRLDSGDMAYLSKKARKLLDEAGFTNTKIIASSDLDEYTIMHLKSQGAKIDVWGVGTKLITSFEQPALGAVYKLVAIEDTDGKLNDTIKISSNPEKITTPGLKRIYRIINRVNDHAEGDYIALDSEEPGKEERLKMFHPVHTYISKFVTNFEARELHKDIFVNGERTYELPSILDIQKYNEQSLSLFWEEYMRTLNPEEYPVDLSQECWDHKMNYIQTVREQVEKNIQK

SEQ ID NO: 19800 - protein, 262 aa, Bacillus cereus ATCC 14579
MPIFEYKKNVHALLGEGGSMLIEFRNVNKYYGNFQVLKDINVQVKKGEVVVVVGPSGSGKSTLLRCINQLESITDGELIVQNTEVHNAKTDMNELRRNIGMVFQHFYLYPHKTVLQNITLAPIKVNKISKEEAEKTAMFYLEKVGIPEKASVYPHQLSGGQQQRVAIARGLAMQPEIMLFDEPTSALDPEMIGEVLDVMKTLAKEGMTMVVVTHEMGFAREVADRILFMDDGQIIEDTTPANFFANPEQERARLFLSRVLNH

SEQ ID NO: 19801 - protein, 475 aa, Bacillus cereus ATCC 14579
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSNGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 19802 - protein, 449 aa, Bacillus cereus ATCC 14579
MFFTQLFKPAPHAERLPADRVDSEYRKLRLQVFLGIFIGYAGYYFVRKNFSLAMPYLIEQGFSKGELGVILSAVSIAYGLSKFLMGIVSDRCNPRYFLAAGLFLSGIINIIFGSFSFITTSIILMFVLQFLNGWVQGMGWPPCGRTMVHWFSISERGTKMSIWNVAHNVGGALMPSLVTLGLYFFADDWKSIFYFPGILSILVGIYVLITMKDTPQSCGLPSIEEHTGEYPPDEKVKDRERELSVKEILFKYVLNNKFLWYIAIANVFVYFVRYGVVDWAPTYLVEEKSFTHSSSRTAYALYEWAGIPGTLLCGWMSDKLFKGRRAPAGILFMVGVFIAVLVYWLNPPGNPMVDSIALVAIGFLIYGPVMLIGLHALDLAPKKAAGTAAGLTGFFGYLGGAAFASAAMGFIVDAFGWDGGFILLLASCVLAMFFLALTLNTGSVKSKQA

SEQ ID NO: 19803 - protein, 438 aa, Bacillus cereus ATCC 14579
MLSIKGKKWRNWTGNVEGTPHYTMYPESIQDVVEVVGLARKKGKKIRVVGSGHSFTPLVQTEEVLVSLDELKGIVNIDAEKMVAEVWAGTKLYDLGKLLEEKGYAQENLGDIDSQSIAGAISTGTHGTGITFGSLSTQVIEITAVLSNGESIVCSETENVEYWRAFQLSLGMLGIIVKIKLKVIPAYSLVYESEKQSLSTVMNKLEEYKKHRHFEFFVFPYSDEVQVKLTNETTNTGSDLKWHKLKVELLENRMFSLLSKGCKWFPSISKGVSRLSAKAVPNTKIIGPSYEVFATSRTVPFYEMEYSIPSKYMRTVVEEISNLIEKKKYKVHFPIECRYVKGDDIWLSPAYGRDSAYIAVHMYKGMKYAAYFGEVEKIFLKYEGRPHWGKMHTLSYEQLQDIYPEFHSFLQARKSLDELGMFFNPYAEKLFIPLFAGQ

SEQ ID NO: 19804 - protein, 463 aa, Bacillus cereus ATCC 14579
MQHTNKSGTLNRGLKERHITLMSLGSAIGVGLFLGSASAIKLAGPSILLGYMIAGLVIFFIMRALGEMAIEQPVAGSFSKYAYDYIGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNKQKLSYKMPLYPLSSYFSLVFLVLVLGIMAYSEDTRIALIVGPIWLIGLAIVYYMKGFHKIDETPNSKIS

SEQ ID NO: 19805 - protein, 430 aa, Bacillus cereus ATCC 14579
MFQLQKYNTSVKQEFLAGITTFFTFAYILVINPKILSDAGVPFDQAFTATIIATVVGTVGMAIFANYPIVIAPAMGMNAYFAYSVVQKAEGITYVVAFSAVFVTGIIFLLLSFTSFRQKLILAIPDSLKHAIAGGIGLFIAFIGLRLSGIIVDHPSNLVTIGDFHSPAVILTLIGLILAAVLMTLRVSGALFISMIVTGIIAFFTGQLKFADKIVAMPHLPEGIIVSNPINAFSDVIEYGLYGVVFSFLLVLLFDTTGALLGLIKQAGLITDNTEKRFGKAFIADAIGGTTGSIFGTSPTAATIESSAGIAAGGKTGLTGIVVVGLTIITAFFSPVIASLSSVAAITAPSLIIVGSLMAQSIRDINWNEFEDALPAFLIFIGIPLTSSIANGIAIGFLVYPVLKIVKGKGMEVHPLLYLFTILFGCHLFL

SEQ ID NO: 19806 - protein, 471 aa, Bacillus cereus ATCC 14579
MNQQIEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGNINDLKYRTPLYPLVPIVAFSLNFITFVSLAFIPDQRIALYCGIPFMIICYILYQVKYKKIVTLEQPRTVIREIN

SEQ ID NO: 19807 - protein, 433 aa, Bacillus cereus ATCC 14579
MFNLSKHKTSIKTEIMAGIITFLTMAYIIVVNPVILGDAGVPFEQAFTATIIAAVVGTLFMAIFTNLPIAIAPGMGLNAYFSYSVVKAHEGMTFAIAFSAVFVAGMILILLSFTSFRTKLMEAIPENLKHAITAGIGLFIAFIGLRLTGIVTKNDANLVGLGDLHSAPVLLALAGLGITIVLMSLNVNGALFIGMLLTGIIAFFTGQLSFSNGVTSMPGLPEGIIVSNPITAVSDVINYGLYGVVFSFFLVTLFDTTGTLLGVAQQGGFMKDGKLPKAGRALLSDSFSATIGSMFGTTPSTAYIESSAGVAAGGRTGLTTVTVAVLFALAAFFGPLVSAVSGVSAITAPSLIIVGSLMMGSVRHIDWDAFDEAFPAFLVILSMPLTSSIATGIALGFISYPLMKVAKGKFRAVHPLVYVFGILFAYQLIFLPH

SEQ ID NO: 19808 - protein, 313 aa, Bacillus cereus ATCC 14579
MRNVFCIGELLIDFVCRNTNVSLVNGSDFEKKAGGAPANVAAAITKLGGHATFMGQVGNDPFGEFLEQTLQRAQVDTSMLIKDKQTTLAFVSIDQDGERDFTFMRGADGEYQFNSIDLSKIQTNDLIHFGSATALLSSPLKETYFQLLQYAKDKGHFISFDPNYRSALITNTEQFSQDCLTFIKHAHFVKVSQEEATMLSKESDLQQAALKLLNYGAKVVAITLGKDGTLLATNEGQTIVSSISIQQVDTTGAGDAFVGAMLYQIAQSEHTLSYHFKDLTAFISFANKVGAITCTNYGAIASLPSLTDIKAYD

SEQ ID NO: 19809 - protein, 479 aa, Bacillus cereus ATCC 14579
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVSLLKAQVAELSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 19810 - protein, 244 aa, Bacillus cereus ATCC 14579
MISIQHLQKSFGDNTVLKHIDLTVEKGEVVVIIGPSGSGKTTFLRCLNVLETPNAGNIRIGNKELNFSQKVTKKDIVNLRTQTGMVFQHHNLFPHLTALQNVMEGLVTVKKMGKEEAKKKANYFLEKVGLADKVDLYPFQLSGGQQQRVGIARALAMEPEVLLFDEPTSALDPELVQEVLKVMKELAKEGMTMVIVTHEMRFAHQIANRVIFMDGGVVVEQGTPEEVFTNPKEERTKKFLQMLQ

SEQ ID NO: 19811 - protein, 278 aa, Bacillus cereus ATCC 14579
MWRDTMSAFLGELIGTALLIVLGGGVCAGVSLKKSFAKDSGWIVITMGWGLAVAVAAYAVGSISGAHLNPALTIGLAFKGAFPWSDVPGYIVAQMIGAIIGAVIVYLHYLPHWKETEDPGTKLGVFATGPAIPNTFANLLSEMIGTFVLVFGILAIGANKFADGLNPFIVGFLIVSIGLSLGGTTGYAINPARDLGPRIAHFFLPIAGKGGSNWKYAWIPVVGPILGGSLAGLFHQVVFEGKQNSALIYVIIATVIVLAISYMTSKKSGSNTNSRKVA

SEQ ID NO: 19812 - protein, 510 aa, Bacillus cereus ATCC 14579
MNLVQSLAETAKKKGDKPAYIFMDQSVSYDQLNKMVTRFSSNLAEMGIGKGDNVALVVGNSPHFLVGLYGTMKAGATVIPVNPIYTADEMHYILQNGDVKTIIVLDVLLPVIQSLTTRLPSLENIIICETSSDFNHTETEKMKTFTSFVGIGDTTYEGPELDEEDVAVILYTSGTTGKPKGAMLTHKNLYSNASDVASYLQYTADDRVVAALPMFHVFCLTVAVNAPIVNGATILMLPKFSPKEVFRICRTYEPTIFAGVPTMYNYLYLFEEASAEDVKTLRLCISGGASMPVALLQNFEKRFNVIVSEGYGLSEASPVTCFNPLDRPRKPGSIGTNIWHVENKIVNELGEEVPVGAVGELIVRGPNVMKGYYNAPEDTAATLKDGWLYTGDLAKMDEEGYFYIVDRKKDIVLVGGYNVYPREVEEVLYTHESVAEVVVIGVPDENLGEAVRAYVVLKQTNVTEEELMHYCTLHLAKYKVPKSIEFLIELPKNTTGKLLRRALREKAMQV

SEQ ID NO: 19813 - protein, 357 aa, Bacillus cereus ATCC 14579
MSIQIQGVSKQYGTFQALTDIHLDIPKGELVALLGPSGSGKTTLLRIIAGLEEADGGSISFDGEDLTDIHVKNRQVGFVFQHYALFKHMNVFENVAFGLKVRKKSLRPSAEAIEEKVTELLKLVKMDGFAKRYPAQLSGGQRQRIALARALAVEPKILLLDEPFGALDAKVRKELRRWLRKLHDEFQITSVFVTHDQEEALDVADRIVVMNEGCIEQMGTPEEVYENPASPFVYDFLGNVNLFHGRVHKGKLNVGSVELEAPEHKHVSNVDGIAYVRPHDLSISHTKQSIDAIPAKVSYSHAVGNIVYVELKRDGTDEYLEAEITKEQFKQLNIQAGDFVYVQPKEVKVFIPEDFVI

SEQ ID NO: 19814 - protein, 396 aa, Bacillus cereus ATCC 14579
MIQTKDIIELTDTYGANNYHPLPIVISKAEGVWVEDPEGNRYMDLLSAYSAVNQGHRHPKIINALIDQANRVTLTSRAFHSDQLGPWYEKVAKLTNKEMVLPMNTGAEAVETAIKTVRRWAYDVKKVEANRAEIIVCEDNFHGRTMGSVSMSSNEEYKRGFGPMLPGIVVIPYGDLEALKAAITPNTAAFILEPIQGEAGINIPPAGYLKEAFEVCKKENVLFVADEIQTGLSRTGKVFACDWDNVTPDMYILGKALGGGVFPISCVAANRDILGVFEPGSHGSTFGGNPLACAVSIAALEVLEEEKLTERSLQLGEKLVGQLKEIDNPMITEVRGKGLFIGIELNEPARPYCEQLKAAGLLCKETHENVIRIAPPLVISEEDLEWAFQKIKAVLS

SEQ ID NO: 19815 - protein, 431 aa, Bacillus cereus ATCC 14579
MGKIRTRKLFICFCLAFVLFVPIHTFADEKREWKDEVIYSIMIDRFNNGEPKNDKQLEVGNLEGYQGGDIRGIIKRLDYIKEMGFTTVMLSPLFESGKYDGLDVRNFKKVNEHFGTDNDVKELVKEAHAKGMKVVFQFPLGENERQVIDAMKWWIKEVDLDGSYVIHSEKKPRSFWDNAQKDMQVIKKDFRIMTKEDSEYNEKIVESFSEADVSVKSLYDVSKKEGEFVTFLDDQETKRYARIAKENMYYPPSRLKLALTYLLTSPGIPNFYYGTEIALDGGSVPDNRRLMDFKSDEKFMQHITKLGELRQARPSLRRGTFELLYDKSGMSILKRKYKDEVTLVAINNTKETQKVSLPASAIGEKQELRGLLQDEIIREENGKFYLVLKREESNVYKVNGETGVNWLFISLIVGVNVLFIAFLIAVKRKRR

SEQ ID NO: 19816 - protein, 481 aa, Bacillus cereus ATCC 14579
MLRYILLKIDIGKEGTDMAAIQAKNGPTEKLSLFLLTWPIFLEVFLFMLMGIADTFMLSALSDDAVSGVGAANQYLHIAILVLEVIGNGAAIVVSQYLGSKRFMEASKISALAVTLNLIVGLVISTGFLLFSKHMMLAMNLQGDVLTYAQNYLSIVGGAIFLQAIINSLAAIIRVHGFTKQAMFISLGMNMIHIAGNYVLIFGKFGFPELGVQGAAISSAVSRLIALIVFFWLLYRVMEYRVKLQYYFTLSKEYIGKILKIGIPSAFEQVMYQACQIVFLYYATYLGTESLAARQYATNISMFTYLFAIAIGMGTAIIIGRLVGGGEKDEAYERLWKSVKWAIGVTLCMVALVITFRTQLMGLFTDNPYIIGLGASVLLLSVLLETGRTMNIVIINSLRAAGDAKYPVLIGAFSMVLMSLPLGYFFAFHLDMGLVGIWLAIAIDEWTRAIIMFFRWKSRAWERYALVKPEEQEENVSVQVQ

SEQ ID NO: 19817 - protein, 258 aa, Bacillus cereus ATCC 14579
MGVEKIKAAFENGKKAFIPYVMGGDGGLEKLKERIRFLDEAGASIVEIGIPFSDPVADGPTIQRAGKRALDSGVTLKGIFQALAEVRKEVQMPFVLMTYLNPVLAFGKERFIENCIEAGVDGIIVPDLPYEEQNIIAPLLREVNIALIPLVTVTSPIERIEKITSESEGFVYAVTVAGVTGVRQNFKEEIHSYLEKVKSHVNLPVVAGFGISTKEHVEEMVTICDGVVVGSKVIELLENEKREEICELIYATKQKEEA

SEQ ID NO: 19818 - protein, 444 aa, Bacillus cereus ATCC 14579
MNYVIIGGDAAGMSATMQIVTNDENANVVTLEKGEIYSYAQCGLPYVISGAIASTEKLIAHNVKTFRDKYGIDAKVRHEVTKVDTEKKMVYAEHTKTKDVFEFPYDRLLIATGVRPVMPEWEGRELQGVHLLKTIPDAERILKTLETNKVEDVTIIGGGAIGLEMAETFVELGKKVRMIERNDHIGTIYDADMAEYIHKEADKHHIEILTNENVKAFKGNERVEAIETDKGTYKADLVLVSVGVKPNTDFLEGTNIRKNHKGAIEVNAYMQTNVQDVYAAGDCATHYHVIKEIHDHIPLGTTANKQGRLAGLNMLDKRRAFKGTLGTGIIKFMDLTLARTGLNEKEAKGLHIPYKTVKVDSTNMAGYYPNAKPLYLKLLYRSDTKQLLGGQVIGEEGVDKRIDVIAMALFNKMSIHDLEDVDLSYAPPYNSVWDPIQQAARRAE

SEQ ID NO: 19819 - protein, 455 aa, Bacillus cereus ATCC 14579
MSISSIVSRQKEYFLKGHTRSIEMRKNNLKKLYEGIQHFEEEIFQALKLDLNKSVHESFTTEVGYVLKEISFQLKHISSWSKPKRVRTALTHLGSKGKVVPEPYGVTLIIAPWNYPFQLAIAPLVGALAAGNTIVLKPSELTPSVSKVLKRMLDELFPEELVAVVEGGVEESTSLLREPFDYIFFTGSVGVGKVVMEAAAKQLTPLTLELGGKSPCIVHKDAKIEMTARRIVWGKFLNAGQTCVAPDYMYVHSSVKEKLIEALRHEIIEQYSKEPLQNENYVRIVSERHFERLCGFLQDGQVVIGGNYKKDTLHIEPTVLADITWKDTVMEDEIFGPILPIIEYDNIEDVIGTIQQHPKPLALYVFSEDKEVQKKVTSNISYGGGCINDVVYHLATPYLPFGGVGSSGLGGYHGKESFRTFSHYKSILAQSTAFDMKIRYSSTKSALKFIRKLLK

SEQ ID NO: 19820 - protein, 452 aa, Bacillus cereus ATCC 14579
MKETTSFSQKLKQFVLLFFPIFVTQMSLFAMSFFDTTMSGHASPTDLSGVAIGTSIWIPVSTGLTGILMATTPIVAQLVGSKKKEDVPHVVIQAVYLAICASFVVILIGFFVVSPILNGMRLEEPVERIAAQFLSIIAIGIIPLFTYTVLRGFIDALGKTRTTMIITLLSLPINVILNYLLIFGNFGFPKLGGVGAAIASTATYWCILIITVIIIQTKEPFASFNIFKQLYRPSLSSWIAFLKLGVPIGFAIFFETSIFAAVTLMMSNFSTTTIAAHQAAMNFASLLYMTPLSLAMAMTIAVGFEVGAKRYDNAKQYGLIGIGLALAFALLYSILLYFFDDQIASIYTTDAKVHHLAKEFLIFAILFQISDAIATPVQGALRGYKDVNVALIMTLIAYWIIGLPLGYILATYTEWAAKGYWIGLIIGLAFGAAFLLIRLFQVQRKYTTQNSR

SEQ ID NO: 19821 - protein, 101 aa, Bacillus cereus ATCC 14579
MKPNFSKGLIPAIVIEEGTKDVLMLAYMNEEAYKKTLETKRTWFYSRSRQSLWNKGETSGNVQYVQSLYLDCDQDSIVVNVKQVGPACHTGEKTCFYYQII

SEQ ID NO: 19822 - protein, 323 aa, Bacillus cereus ATCC 14579
MAKILVAGKIPEIGLELLKDHNVEMYNKEELISIDELTERVKDKDALLSLLSTKVPKEVIDAAPHLKIVANYGAGYDNIDYTYAGEKGIAVTNTPKVSTEATAELTFALLLAAARRIPEGDTLCRTTGFNGWAPLFFLGREVHGKTIGIIGLGEIGKAVAKRAKAFGMDVLYTGPNRKLEAESELGATYVTLEELLQTADFITINCAYNPKLHHMIDEEQFKMMKKTAYIVNASRGPIMNEAALAHALKTNEIEGAALDVFEFEPKITEELKELKNVVLAPHVGNATFETRDAMAEMAVRNILAVLNGEEPVTPVNQKVLVTK

SEQ ID NO: 19823 - protein, 266 aa, Bacillus cereus ATCC 14579
MKEIKVIIAGPRGRMGHEAVLLMERTEHFNLVAAVDYKHGGEKISDLPGMPALHAPIYADLHTCLDEVEADVLLDLTTPEVGKQHVTLAVERGLRSVIGTTGFTEEELTRLTENAKEKAVGTIIAPNFAIGAVLMMKFSQMAAKYFQDVEVIELHHDQKLDAPSGTAVKTVELIRQNRESKQQGHPNEVEQLAGARGANVDGIHIHSVRLPGLIAHQEVMFGGDGQMLTVRHDSFNRASFMSGVKLSIETVMNLDHLVYGLENIID

SEQ ID NO: 19824 - protein, 450 aa, Bacillus cereus ATCC 14579
MMKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPEIEGQHIYDVECVKEVDRVMTWELSETIAAFIMEPIITGGGILMPPQDYMKAVHEMCQKHGALLISDEVICGFGRTGKAFGFMNYDVKPDIITMAKGITSAYLPLSATAVKKEIYEAFKGKGEYEFFRHINTFGGNPAACALALKNLEIMENENLIERSAQMGSLLLEQLKDEIGEHPLVGNIRGKGLLVGIELVNDKETKEPIDNDKIASVVNACKEKGLIIGRNGMTTAGYNNVLTLAPPLVISSEEIAFVVGTLKTAMERI

SEQ ID NO: 19825 - protein, 451 aa, Bacillus cereus ATCC 14579
MEATEKLREKPIKSLFISYLIPAVLGMVLMSVNIVIDAVMISRGVGANGLAGVNVAIPAFSIFFSISLWIGMGGATLYSIALGENKRERARSIFTQSMTVAVVIVGILAAICLWRIEDLAYLFGANEVILPYALDYLHVLLTFGMIYVLENILSTFIRNDGNPNLAMAGLVVTAVLNIVFDYIFIFIFGWGVTGAASATILSAAIGFLVLLTHFFRKSSILKWTKFHFEWDTVKQIMVIGFPSFTAESTVAIVTIGFNIAFVQYAGEVGVASYAMVNSIHAMTLLLFFGVGAALQPIASFHYGANLSERLREGLKFAVKIAVVLGGIAIIVGLFFGKYIIGLFDVQSPELLELTLTGISLFFIQYVFLGYNIVYGEYFQSVRQTKKSVLIIMSRGLLFIIPLLWIMPKLFGINGIWLVMPVAEVMTAIIVFTMNRMKHPVPLNMAGEKEAI

SEQ ID NO: 19826 - protein, 330 aa, Bacillus cereus ATCC 14579
MDIKISGLEKTFGKTQALKPLQIVMKQGEFTTLLGPSGCGKTTLLRMIAGLEEPDKGEIYFGDQCMYSAAKKIKTSPHERNIGMVFQDFALWPHMTVFENVAFGLRATKQTNHLREKVEDAIKRVRLQGMEKRYPHELSGGQQQRVAFARAIVTKPHFILFDEPLSALDAILREEMRIELMDIVHSIGLTALYVTHDQTEAMSMSDQIIVMKQGEVLQKGTPEDIYVKPSHEFVAKFVGKANWLVEGEKMIRPEHVSWTKNDVCEMYTGEIQHVTYVGERYEVKVNMGTLGIWTAYHNSKLSIGKPVSLYVPKKCIHHIGGESYEEIQFA

SEQ ID NO: 19827 - protein, 469 aa, Bacillus cereus ATCC 14579
MKPPADNNKEGAESHKLESESKPIWKSMSMFLVPLLLSNVLQSVGQLFGMVVVGRWLGVNDLAAISAFFPLFFLLVSFVIGIGSGSSILIGQAFGAKNEDRLKAIVGTTLTFTFIIGVLLAIIGSIFAMDIMRLMGTPENIIEISVHYARILFISMPVLFLYFAYTTFMRGTGDSKTPFYFLIVSTALNMILLPILIFGWLGAPKLDVYGAAYASVISTVITFIVMLVYLKKKNHPLQLDGTVRKYLRMDGELLKLLLRLGIPASINMILVSLSEIAVIAFVNRYGSDATAAYGVVNQVASYVQMPAVSLGITVSIFAAQSIGANQFDRLQKVVKAGIIMNYVIGGVLISLIYVFSRDILSLFLTSQTTIEIAHSLVMITLWSYLIFGHAQIISATMRASGTVLWPTVIGVVSIWLVEVPVAYYLSYHTSLGIEGIWIGYPAAFIVSLILQYAYYKLSWQKKRITRLVS

SEQ ID NO: 19828 - protein, 303 aa, Bacillus cereus ATCC 14579
MCENVTELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGVGKKVLCIAPDTGERYLSMGLFE

SEQ ID NO: 19829 - protein, 311 aa, Bacillus cereus ATCC 14579
MKYTKLQKAGLNISKLGLGTNAVGGHNLYADVNEEEGKRLVEEAIQQGITFFDTADSYGFGRSEELVGEVLKGKRHEFILATKGGIQPLLNGETYINNEPSYLRNAVENSLRRLQTEYIDLYYLHFTNPETSYIDSIGELTHLKEEGKIRSIGILNVNIEQLKEANQHGHIDVVQSPYNMLERTAEEELLPYCIEAGISFIPYGPLAFGILGGKYTEDFKLNEVDWRQNVNLFEENTYKSNFKKVNKLKGLAKENDIEVSHLALAWLLNKEGIDTVIPGGKRAEQVRESVKAVDVALNERVMKEIQSILED

SEQ ID NO: 19830 - protein, 300 aa, Bacillus cereus ATCC 14579
MERVQMAETLEFSRIIQGFWRLAEWNMTKQELLSFIEDCMDMGITTFDHADIYGAYTCEGLFGEALQLKPSLRENMQIITKCGIAPPSPKFPERYVAHYNTSTEHIMQSVEASLKNLHTDYIDVLLIHRPDPFMDPNEVAKAFSQLKQEGKVRHFGVSNFLPSQFNMLNSYLDFPLITNQIEVSALQLEHFEKGTIDLCQEKRINPMIWSPLAGGEIFTGQSERAVRVRETVQKVATELGVSNIDTVMYAWLLAHPANMMPIVGSGKLDRVKTAALATKVNLDRQQWFTIFESSNGHPVP

SEQ ID NO: 19831 - protein, 346 aa, Bacillus cereus ATCC 14579
MMNSKLFSPYTIKNVTLKNRIVMSPMCMYSSGNEDGRVTNFHLIHYGTRAAGQVGLVMVEATAVLAEGRISNNDLGIWDDNLIEGLHKTTTFIHDNGAKAAIQLAHAGRKAELDTNAFAPSAIPFNDKMKIPVEMNIQQIKETILAFQRAALRSKQAGFDVIELHGAHGYLINEFLSPLTNKRTDKYGGSPENRYRFLREIIDSVNEVWDGPIFVRISANDYHPDGLTVQDYVQYTKWMKEQGIDLIDCSSGAVVPAHIDVYPGYQVQYAKHIKEHTNIATGAVGLITTGSQAEQILNNNEADLIFIGRELLRNPYFPRIAANELGFELQEPHQYKRAPGKIHTNK

SEQ ID NO: 19832 - protein, 328 aa, Bacillus cereus ATCC 14579
MKAIVVTSFGGPEVMKYTDFDIPAISEDQVLIRVVATSVNFADIKSRYGKKGNKALPFILGIDATGIVERVGSHVKNIHPGQRVIAFPQNGSYAEYVVANENLTFVLPHEVDFQTAAACPIVSFTSYNLLANVARLQQGESVLIHAAAGGIGTTAIQLAKLLEAGTVIGTVGSEAKKEIALDAGADYVICHQDEDFVEKVNELTNGEGVDVILDSISGTVSERSLNCLAYYGRLVHFGNASGEIGNFQTKDLHASCRSILGFSFGTTRKKRPELLQETANEVFRYLRDGRLQIKATKSFPLQDAGKAHEWVESRKSTGKVILTVQSSS

SEQ ID NO: 19833 - protein, 160 aa, Bacillus cereus ATCC 14579
MTVYDFSAKTITGEEKSLKDYKGKALLIVNVASKCGFTPQYKGLQEVYDKYKDQGLEILGFPCNQFGGQEPGTEADITSFCELNYGVNFPMFAKVDVKGDKAHPLYTYMTEQAPGLLGMKAVKWNFTKFLIGKDGKVVGRFAPQTKPVDLEVEIEKVLGE

SEQ ID NO: 19834 - protein, 389 aa, Bacillus cereus ATCC 14579
MKSPNFQLSLQTSNLIIGFMVWVILSSLMPYIKADIPLTAGQISMVTAVPVILGSILRIPIGYWTNRFGARKLFFISFILLLFPVFYISVANSMMDLIIGGLFVGIGGAVFSVGVTSLPKYFPKESHGFVNGIYGVGNAGTAITSFLAPVIATSVGWRTTVQCYLVLLAAFALMNFLLGDRKEKKVNTPLMEQIKGVYKNEKLWFLCIFYFLTFGSFVAFTVYLPNFLVSHFGLEKVDAGMRTAGFIVLATIMRPIGGWLGDKFNPFKILIFVFIGLTLSGIILSFMPSMNVYTFGCLLVAFCAGIGNGTIFKLVPMYFSEQAGIVNGLVSALGGLGGFFPPLILTLLFQLTGHYAIGFMALSEVALACLIITVWMYSQEKLLVMLKNH

SEQ ID NO: 19835 - protein, 345 aa, Bacillus cereus ATCC 14579
MKAVVVNKNSKANIEVIEKELRPLHSGEALVDVEYCGVCHTDLHVANHDFGNTDGRILGHEGVGIVTKIADDVTSLKIGDRVSIAWMFQSCGRCEYCVTGRETFCREVKNAGYSVDGGMAEQCIVTADYAVKVPEGLDPAQASSITCAGVTTYKAIKVSDIKPSQPIVIYGCGGLGNLAIQYAKNVFGAKVIAVDINDDKLALAKEVGADMTINPISQGPADKIVQEKFGGAYAAVVTAVSKVAFNSAVDAVRACGKVVAVGLPVETMDLNIPRLVLDGIEVVGSLVGTRKDLEEAFMFGAEGKVVPVVQTCSLDKVQNVFEEMEQGRIQGRMVIDFKKHNCDCK

SEQ ID NO: 19836 - protein, 298 aa, Bacillus cereus ATCC 14579
MKLGLIGLGKMGFPLAEHLYEDKHEVVVYDVNKELVEKAGKLGITARHTLKEMIAELEAPRTIWVMVPAGEVVESVLKDVYPLLDEGDIVIEGGNSFYKDTLRRAEEAKSFGLHYVDIGTSGGVEGARYGACLMVGGEKEIYDQLEPLFKDLAVENGYSYAGRVGSGHFLKMVHNGIEYGMMQAIAEGFEVLDKSDFDFNYEDVAKVWANGSVIRGWLMDLTEKAFAEDPKLDGIKGVMNSSGEGKWTVETALELQAAAPVIAMSLFMRYRSQEDDTFHGKVVSALRNQFGGHEVVKK

SEQ ID NO: 19837 - protein, 474 aa, Bacillus cereus ATCC 14579
MKKHLYINGSWKSVNTYKPLYAPYSEETLAEIAQGTEEDVKEAVTAAKNAMTKMNKLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALVELFEEAGLPNGALNIISGPGPTVGEAIVKNDYVASITFTGSPKVGIGIKQKAGLKRVTLELGSNAAVIIDEDVELTDEIIERVKWGAFVNNGQVCISVQRVFVHETKIHEFLSKLKKAMESVVVGDPSLEETDVSALISKKDVERIDMWVQEAIKEGATVLCGGKKQDARIFEPTVLTNVPDHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 19838 - protein, 436 aa, Bacillus cereus ATCC 14579
MRDYLIKPLVGQPYPMISHGKGVYLYDQNGNKYFDGSSGAITAGIGHGVKEIADVIKKQAEEIAFVYRSQFTSEPAEKLAKKLSDLSVGDLNWSFFVNSGTEANETAMKIAIQHFQERGIQGKHKILSRWMSYHGIPMGALSMSGHPLRRQRFVSILEDYPTIPAPYCFRCPVQKVYPTCQLACATELERSIERIGAEHIAAFIAEPIIGAAGGAVVPPKDYYKVIKEICDHYDILFIADEVMTGLGRTGAWFAMEHWGVEPDIMTLGKGLGAGYTPMAATVVSDRVMEPILRGSRSVMSGHTLSANPLSAATALAVIEYMEKHNLPEKTAEKGEYLIKGLQKVQQQSTIIADVRGKGLLIGVELQPFTKASELISVAAKNGLLLYQAVSGQAGKEDSALLVAPPMTTTYSELDELLSIFSKSVEEMMQKGGHSIA

SEQ ID NO: 19839 - protein, 232 aa, Bacillus cereus ATCC 14579
MTTITNTFGKLKEIEEVISLFHDDMTLMFGGFGGIGSPPSLIQAILEKGVTNLNLIGNDTGFPDVGIGRLVTNERVKSIITSHIGSNPNAGRQLNEGRLQIEFSPQGTLAERIRAGGVGLGGVLVDVGVDTIVEEGKRTVEMNGKTYLVETALTAEVSIVYAKKADPFGNLVFDKSARNMNPHVAMAGDITIVEAEEIVPLGSLDPEEIVVPGVFVNYIVPSEGVNWKWVWA

SEQ ID NO: 19840 - protein, 296 aa, Bacillus cereus ATCC 14579
MKKIGFIGLGNMGLPMSKNLVKSGYTVYGVDLNKEAEASFEKEGGIIGLSISKLAETCDVVFTSLPSPRAVEAVYFGAEGLFENGHSNVVFIDTSTVSPQLNKQLEEAAKEKKVDFLAAPVSGGVIGAENRTLTFMVGGSKDVYEKTESIMGVLGANIFHVSEQIDSGTTVKLINNLLIGFYTAGVSEALTLAKKNNMDLDKMFDILNVSYGQSRIYERNYKSFIAPENYEPGFTVNLLKKDLGFAVDLAKESELHLPVSEMLLNVYDEASQAGYGENDMAALYKKVSEQLISNQK

SEQ ID NO: 19841 - protein, 486 aa, Bacillus cereus ATCC 14579
MITTEIKRVKNHINGEWVESTGTEVEAVPNPATGKIIAYVPLSPKEDVEKAVEAAKAAFETWSKVPVPNRSRNLYKYLQLLQENKDELAKIITLENGKTLTDATGEVQRGIEAVELATSTPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFNEDNYVGPLIRESHKERVLGYINSGVADGATLLVDGRKINEEVGEGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLSTNGTDGVQFYTRKKVVTERWF

SEQ ID NO: 19842 - protein, 245 aa, Bacillus cereus ATCC 14579
MIKLVLIRHGQSLWNLENRFTGWTDVDLSENGLSEAREAGAILKKNGYTFDVAYTSVLKRAIRTLWIVLHEMDLTWVPIHKSWKLNERHYGALQGLNKDETAQKYGEEQVHIWRRSVDVRPPALTEDDPRYEATDPRYKTLKKGEFPLTECLEDTEKRVLAYWHSEIAPTLKSGNKVIISSHGNTIRSLVKYLDNLSSDGVVSLNIPTSIPLVYELDENLRPIRHYYLSMDGEVPEGEIPKHISF

SEQ ID NO: 19843 - protein, 513 aa, Bacillus cereus ATCC 14579
MLDQKQQSNSFEERVETIKQGGAPKYHEQNKAKGKLFVRDRLALLFDNGEYVEDALFANCEQTGLPADGVVTATGKIHGRTACVMANDSTVKAGSWGSRTVEKILRIQETAEKLRVPLFYLVDSAGARITDQVEMFPGRRGAGRIFYNQVKLSGKVPQVCLLFGPSAAGGAYIPAFCDVVMMVEGNASMYLGSPRMAEMVIGEKVTLEEMGGARMHCSVSGCGDVLCKTEEDAITQARQYISYFPNNYLEKTPLVTPQEPKQFDKTLEQIIPENQNAPFNMKDLINRVIDEGSFYEVKKLFAQELITGLARIDGKPVGIIANQPRMKGGVLFHDSADKAAKFINLCDAYHIPLLFLADVPGFMIGTKVERAGIIRHGAKMISAMSEATVPKISIVVRKAYGAGLYAMAGPAFEPDCCLALPTASIAVMGPEAAVNAVYANKIAALPEEERASFIAEKREEYKKDIDIYHLASEMVIDGIVHPNNLREELKGRFEMYMSKYQVFTDRKHPVYPV

SEQ ID NO: 19844 - protein, 459 aa, Bacillus cereus ATCC 14579
MSKLVVIGGGPAGYVAAITAAQNGKGVTLIDEAELGGTCLNVGCMPTKSLLESAEIHDIVRKANDYGVTLNTGSISIDWNQIQARKSQIVMQLVQGIQYLMKKNKIKVVKGKAKFETDHRVRVVQGNKEEVVDGESFIIASGSEPTELPFAPFDGKWILNSSHAMSLESVPSSLLIVGGGVIGCEFASIYSRLGTKVSIVEMAPQLLPGEDEDIANILREKLEKDGVKIFTGAVLKGLNNYKKQASFEYEGITHEVTPEFVLVSVGRKPRVQQLGLEKAGVQFSNKGISVNEHMQTNVSHIYAAGDVIGGIQLAHVAFHEGTTAALHASGEDVKVNYHAVPRCIYTAPEIASVGLSEKGAREQYGDILIGEFPFTANGKALILGEQVGKVKVIVEPKYQEIVGISIIGPYATELIGQGTVMIHTEVTADIMRDYIAAHPTLSEAIHEALMQAVGHAVHA

SEQ ID NO: 19845 - protein, 494 aa, Bacillus cereus ATCC 14579
MLKTNIELKPKVEAFLNEEIKMFINGEFVAAIGGKTFETYNPATEDVLAVVCEAQEEDIDAAVKAARSAFESGPWAEMTTAERAHLIYKLADLIEEHREELAQLEALDNGKPYQVALDDDISATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAEMIKHVTLELGGKSPNIILEDADLEEAINGAFQGIMYNHGQNCSAGSRVFVHRKHYETVVDALVKMANNVKLGAGMEKGTEMGPLVSKKQQERVLHYIEQGKKEGATVAAGGERALEKGYFVKPTVFTDVTDDMTIVKEEIFGPVVVVLPFDSTEEVIERANNSSYGLAAGVWTQNIKTGHQVANKLKAGTVWINDYNLENAAAPFGGYKQSGIGRELGSYALDNYTEVKSVWVNIK

SEQ ID NO: 19846 - protein, 219 aa, Bacillus cereus ATCC 14579
MHYRTLGKTGITVSEIGFGAWAIGGDEWGPANDKQSITAIKKAIECGVNFIDTADVYGLGHSEKLVATAIKGHRNDIILSTKGGLIGHHYDPNGVPVYDTPEKIIAVFETSLQRLQTDYIDLYFCHIWWHNRRETEAFLRAFDILKRDGKVRAVGVSTHDLQYIHHFNNNNEIDIVQLDYNILNRKPEKDILPFLQEKNLGAVIRGPLKMGILTGKIHK

SEQ ID NO: 19847 - protein, 400 aa, Bacillus cereus ATCC 14579
MMTYTLATRMKAFQSSIFSELGAYKKEKIAAGHNMIDLSIGNPDMPPADFVRETMVHTASEKESYGYTLSGIQEFHEAVTEYYNNTHNVLLNADKEVLLLMGSQDGLVHLPMVYANPGDIILVPDPGYTAYETGIQMAGAISYYMPLKKENDFLPDLEVIPEEIADLAKMMILNFPGNPVPAMAHEDFFKEVIAFAKKHNIIVVHDFAYAEFYFDGNKPISFLSVPGAKEVGVEINSLSKSYSLAGSRIGYMIGNEEIVRALTQFKSNTDYGVFLPIQKAACAALRNGATFCEKNREIYQERRDTLIDGFRTFGWNVDKPAGSMFVWAEIPQGWTSLDFAYALMDRANVVVTPGHAFGPHGEGFVRIALVQDKEVLQQVVENIRNSGIFVLEKVNELVKN

SEQ ID NO: 19848 - protein, 474 aa, Bacillus cereus ATCC 14579
MAQVSNTNNELKRTMKSRHLFMIALGGVIGTGLFNGSGFIISQAGPGGSVLAFIAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFILLGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGKLEDLKFKTPLYPLVPILGFGLYGIILISLIFIPEQRLGIYCTVPFIIFCYTYYHFKVKKRNSTNTHSETKISETS

SEQ ID NO: 19849 - protein, 405 aa, Bacillus cereus ATCC 14579
MLDWFQLDKEYMMSTYCRTEVAMERGEGCKLYDVDGKEYLDLFSGVGVNVLGYNHPKIVQTTMEQVVKSLHLPFHFLNPVAIEYAKKLVECTLKSGKVFFTNSGTEATETTLKLIDKYRSIANEERDGVVVLKDSFHGRTLGALHFTRQEKVYQNFPKTSIPVYEVERENIDQLEETIIKEKPIAIMLEPVLGSGGIYPLSSKYLHGVQNLCEKYNVLLVVDEVQSGMGRTGKLFAYQNFNITPDIIQIGKGAGGGIPLGGIIVGEKLCDVFSPGDHGTTFAHSSMGTALGLTVLNTLLDDGLMQEAYETSLYLNDKLQDIQKENSYYIQEVRHAGMMFGISLNDTNENVKKLQVELMNKGMLVDVTKGNIIRLLPPYIITKEEIDAFINQFIICLDKVAAVVSA

SEQ ID NO: 19850 - protein, 491 aa, Bacillus cereus ATCC 14579
MLNMNSATNQATSKTETTQGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFTLCIIVILGQNYGAFMGESIDWNGVLVSYIGLPLFLVLWLGYKFTKKTKVIPLDKCELK

SEQ ID NO: 19851 - protein, 326 aa, Bacillus cereus ATCC 14579
MIKDSSVQVEGQEKVCLDQWVAHYRAYAAKGRSASYIPALGEINVSQLGICIVKPDGTMIKSGDWEIPFTLQSISKVIGFIAACLSRGISYVLERVDVEPTGDAFNSIIRLEIHKPGKPFNPMINAGAITIASLLPGTSVQEKLESLYVLIEKMIEKRPAINEIVFQSEWETAHRNRALAYYLKENGFLESDVEETLEVYLKQCSIEINTEDIALIGLILAHDGYHPIRKEQVLPKEVARLTKALMLTCGMYNASGKFAAFIGLPAKSGVSGGIMTLVPSKSRKDLSFQDGCGIGIYGPAIDEYGNSLPGIMLLEHIAKEWDLSIF

SEQ ID NO: 19852 - protein, 1065 aa, Bacillus cereus ATCC 14579
MEKKVSAIPQPKTYGPLGNLPLIDKDKPTLSFIKIAEEYGPIFQIQTLSDTIIVVSGHELVAEVCDETRFDKSIEGALAKVRAFAGDGLFTSETHEPNWKKAHNILMPTFSQRAMKDYHAMMVDIAVQLVQKWARLNPNENVDVPEDMTRLTLDTIGLCGFNYRFNSFYRETPHPFITSMTRALDEAMHQLQRLDIEDKLMWRTKRQFQHDIQSMFSLVDNIIAERKSSGDQEENDLLSRMLNVPDPETGEKLDDENIRFQIITFLIAGHETTSGLLSFAIYFLLKNPDKLKKAYEEVDRVLTDPTPTYQQVMKLKYMRMILNESLRLWPTAPAFSLYAKEDTVIGGKYPIKKGEDRISVLIPQLHRDKDAWGDNVEEFQPERFEELDKVPHHAYKPFGNGQRACIGMQFALHEATLVMGMLLQHFELIDYQNYQLDVKQTLTLKPGDFKIRILPRKQTISHPTVLAPTEDKLKNDEIKQHVQKTPSIIGADNLSLLVLYGSDTGVAEGIARELADTASLEGVQTEVVALNDRIGSLPKEGAVLIVTSSYNGKPPSNAGQFVQWLEELKPDELKGVQYAVFGCGDHNWASTYQRIPRYIDEQMAQKGATRFSKRGEADASGDFEEQLEQWKQNMWSDAMKAFGLELNKNMEKERSTLSLQFVSRLGGSPLARTYEAVYASILENRELQSSSSDRSTRHIEVSLPEGATYKEGDHLGVLPVNSEKNINRILKRFGLNGKDQVILSASGRSINHIPLDSPVSLLALLSYSVEVQEAATRAQIREMVTFTACPPHKKELEALLEEGVYHEQILKKRISMLDLLEKYEACEIRFERFLELLPALKPRYYSISSSPLVAHNRLSITVGVVNAPAWSGEGTYEGVASNYLAQRHNKDEIICFIRTPQSNFELPKDPETPIIMVGPGTGIAPFRGFLQARRVQKQKGMNLGQAHLYFGCRHPEKDYLYRTELENDERDGLISLHTAFSRLEGHPKTYVQHLIKQDRINLISLLDNGAHLYICGDGSKMAPDVEDTLCQAYQEIHEVSEQEARNWLDRVQDEGRYGKDVWAGI

SEQ ID NO: 19853 - protein, 331 aa, Bacillus cereus ATCC 14579
MNLAKFPRKKYTESYTPIEKLNNFSEALGGPTIYFKRDDLLGLTAGGNKTRKLEFLVADAQENGADTLITAGGIQSNHCRLTLAAAVKEKMKCILVLEEGLETEEKRDFNGNYFLYHLLGAENVIVVPNGADLMEEMHKVAKEVSEKGNTPYVIPVGGSNPTGAMGYVACAQEIMAQSFEQGIDFSSVVCVSGSGGMHAGLITGFSGTQSHIPVIGINVSRGKAEQEEKVAKLVDETSAHVGIPNFISRDAVTCFDEYVGPGYALPTPEMVEAVQLLAKTEGILLDPVYTGKAVAGLIDLIRKGNFNKEDNILFVHSGGSPALYANTSLFV

SEQ ID NO: 19854 - protein, 223 aa, Bacillus cereus ATCC 14579
MTSLLKLDKVSKVYGEGNTEVTALHPMSLDVKAGEFIGIVGPSGSGKSTLLSIAGALLSPSKGDIYIREQNITQLSEKEMTDIRLKKIGFIFQFANLVPYLNVKEQLLYIAKLKKESKQESEKRADHLLAAFGLGERKNHYPNQLSGGEKQRVAIARAFMNNPDLILADEPTASLDSKRAREVVEMMKREVKESQKAAIMITHDERMLDVCDRILTLRDGQLI

SEQ ID NO: 19855 - protein, 356 aa, Bacillus cereus ATCC 14579
MVTKMTIDRICTIGPASNNKETLAQLIKNGMKIVRLNLSHGTHESHKDIIRLVKSLDDSIKFLGDVQGPKIRLGEVKGEQITLQAGDSFILHTQPVTGSNTEASVDYEGIANDVKVGSRILINDGEVELIVEKISTDKIETKVKTGGNISSHKGVNLPDAAVRLPAITEKDKKDIQFLLEENVDFIACSFVRKPSHIKEIRDFIQQYKETSPNVIAKIETMEAIENFQDICKEADGIMIARGDLGVELPYQCIPLLQKMMIQECNRTNTYVITATQMLQSMVDHSIPTRAEVTDVFQAVLDGTNAVMLSAESASGEHPIESVRTLRLVSEFAEHVKKDGPFAMKDVLQLLRESLDE

SEQ ID NO: 19856 - protein, 297 aa, Bacillus cereus ATCC 14579
MQVGLIGLGKMGLNLGKNLMDHKHEVVAFDLNTSAVEEMKEYGATGTSSLSELVQSLQSPRILWVMVPHAVVDSVIDEVTPLLSKGDILIEAGNSHYKESIRRYEQLKEDGIHFMDAGTSGGMEGARNGACYMIGGDQEAWDIVEPIFRDTAVENGFLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 19857 - protein, 458 aa, Bacillus cereus ATCC 14579
MKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGIIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIIFLAIVTISFYAFGIGKRAPLDVQNNKEISSK

SEQ ID NO: 19858 - protein, 329 aa, Bacillus cereus ATCC 14579
MIIDRYGKVPMRMAEVPTPEINEYEVLAEIHAASINPIDFKIRDGKVKMLLKYEMPLILGNDFAGVITKVGSKVTRFKVGDEIYARPRKNKIGTFAEYIAIHEDDIALKPKNLSFEEAASIPLVGLTSYQALHDIMQLQKGQKILIHAGSGGVGTFAIQLAKIMGAIVTTTASEAGANLVTSLGADEIINYKTEKFEDILKNYDAVFDTIGGATLEKSFNIIKRGGNIVSVSGMPNARFGKEFGSGFFKTLLFSLASKKLTALEKKHNAQYSFLFMKPSGDQLRTIANYIEAGEIKPVIDRVFPFEDAQKAMEYSEAGRAKGKIIVKIK

SEQ ID NO: 19859 - protein, 494 aa, Bacillus cereus ATCC 14579
MSQLAVNLHEKVEKFLQGTKKLYVNGSFIESASGKTFKTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGVGLNPETTIGPLVSEEQQKRVMGYIEKGIEEGAEVLCGGSNPFDQGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 19860 - protein, 375 aa, Bacillus cereus ATCC 14579
MTSSRNKATSFYEGTNVNAGGFFENVEETKLFYPIQVGGWSLRNRIAMAPMTRCFADNETGVVGADVVEYYRKRAADGIGLIITEGIVISPRAKGNPGVPGIYTQEQIDSWKPVTEAVHKEGGTIIAQIWHVGRMSHHEIIGGQMPQAPSAIAAEGNVPRFRKPFDMPEAMTLEEIQEVIDQYAQAAKNAIEAGFDGVEIHGAHGYLIDQFTYEFANKRTDKYGGDLKQRLTFMKEVTAAVIEAVGANKTLLRFSAFKGDNPTYMWENPEFAIETFINMFKEVGLTMIHPSTMNYTQEIADGKNFHQLVRKYWDGTIVGVGNLNPKEAEEALQEGTIDVAAFGRPLIANPDFVHRIKHAESLVEYDAKEHLVTLV

SEQ ID NO: 19861 - protein, 464 aa, Bacillus cereus ATCC 14579
MDKNLKKDLKIRHITMISIGGVIGAGLFVGSGAVVHSAGPGSIVSYALAGLLVIFVMRMLGEMAAVNPTSGSFATYAREAIGPWAGYTIGWLYWFFWVIVIAIEATAGAGIIQYWIPQIPLWLLSLILTILLTLTNVFSVKSFGEFEYWFSFIKVISIVLFLCLGLAVILGFVPGTEAPGTSNLIGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKSFLKLNSSGVPVRAVLFGTFFAYIGVVFSYISPDKVFLFLVNASGGIALLVYLVIAVSHLKMRKKMGKVEQQNLKVKMWLFPYVTYVTIAAIIAVLVAMFAIDTLRSQALLTMFVTVLIILSYFIFNRNKNSTVLNPKSKNEESVRF

SEQ ID NO: 19862 - protein, 428 aa, Bacillus cereus ATCC 14579
MEVYTMKFPHDFLFGAASASYQVEGAWNEDGKGVTNWDEFSKIPGKTYNGTNGDVAVDHYHRYKEDVRLMAEMGLESYRFSISWARILPTGDGKVNEKGIEFYNNLIDECLKYGIVPFVTLYHWDLPLPLEKDGGWTNKRTAEAFVKYAETCFKAFGDRVKHWITFNETVMFCGLGYLKGAHPPGIQNDVPKYFQATHYVFYAHAKTVAVYKQLKQYGEIGITHVFLPAYSVDDQKENIQAANHANEYETYWYYDPILKGEYPSYVVQQLKEKGWTPNWTVEELEIIKQNAEENDFIGLNYYQPIRVERYDMDIKSEEHSRENSTLAPGNPSFDGFYRTVKMDDKTYTKWGWEISPEGFLEGLHMLKARYGDIKMYVTENGLGDEDPIIDGEIVDVPRIKFIEAHLKVMKRAIEEGINLKRLLCMVSD

SEQ ID NO: 19863 - protein, 214 aa, Bacillus cereus ATCC 14579
MIKIAPSILSADFSKLGEEIKDVEKGGADYIHVDVMDGHFVPNITIGPLIVEAIRPITSLPLDVHLMIENPDNYILTFAQAGADIITVHVEACPHLHRTIQLIKSHGIKAGVVLNPHTPVSVIEHVLEDIDMVLLMTVNPGFGGQKFIHSVLPKIKQVADMVKERNLEVEIEVDGGVNAETARLCVEAGANVLVAGSAVYNQKDRGEAIRVIRG

SEQ ID NO: 19864 - protein, 470 aa, Bacillus cereus ATCC 14579
MVVGDFPIELDTVVVGAGPGGYVAAIRAAQLGQKVAIIEKANLGGVCLNVGCIPSKALINAGHRYENAMHSDDMGITAENVKVDFTKVQEWKNGVVKKLTGGVEGLLKGNKVEIIRGEAYFVDANTLRVMTEDAAQTYTFKNAVLATGSTPIEIPGFKYSKRVINSTGALSLPEIPKKLVVIGGGYIGMELGTAYANFGTEVTVVEAGDEILAGFEKAMSSVVKRALQKKGNVNIHTKAMAKGVEETETGVKVSFEVKGEIQTVEADYVLVTVGRRPNTQEIGLEQVGVKMTDRGIIEIDEQCRTNVPNIYAIGDIVPGPPLAHKASYEGKVAVEAISGHASAIDYIGIPAVCFTDPELASVGYTKKQAEEAGMTVTVSKFPFAANGRALSLNSTDGFLQLVTRKEDGLLVGAQVAGAGASDIISEIGLAIEAGMTAEDIAQTIHAHPTLGEITMEAAEVALGMPIHIVK

SEQ ID NO: 19865 - protein, 392 aa, Bacillus cereus ATCC 14579
MKLFQPSEIVTSLPTQFFASLVAKVNKVVAAGHDVINLGQGNPDQPTPQHIVKALQDAAEKTIHHKYPPFRGHESLKEAVATFYKREYGVELNPKTEVAILFGGKAGLVELPICFTNPGDTILVPDPGYPDYLSGVALAKAHFERMPLIAENNFLPDYTNIDASIAERAKLMFLNYPNNPTGATASKDFFDETIYFANKHNILVVHDFAYGAIGFDGQKPVSFLQADGAKDIGIEIYTLSKTFNMAGWRIAFAVGNESVIETINLLQDHMYVSIFGAVQDAAREALLSSQSCVIDLVNSYESRRNALISACHSIGWNVDIPTGSFFAWLPVPKGYTSEQFSDILLEKAHVAVAPGVGFGEHGEGYVRVGLLHTEDRLREAINRIDKLNFFKK

SEQ ID NO: 19866 - protein, 170 aa, Bacillus cereus ATCC 14579
MAQIRIHEVNTRIENEVEVSKFLQEEGVLYEKWNISKLPTHLNENYSLTDENKAEILAIFSKEIADVSARRGYKAHDVISLSSSTPNLDELLINFQKEHHHTDDEVRFIVSGHGIFAIEGKDGKFFDVELEPGDLISVPENARHYFTLQDDRQVVAIRIFVTTEGWVPIY

SEQ ID NO: 19867 - protein, 292 aa, Bacillus cereus ATCC 14579
MEHKTLSIGFIGIGVMGKSMVYHLMQDGHKVYVYNRTKAKTDSLVQDGANWCNTPKELVKQVDIVMTMVGYPHDVEEVYFGIEGIIEHAKEGTIAIDFTTSTPTLAKRINEVAKRKNIYTLDAPVSGGDVGAKEAKLAIMVGGEKEIYDRCLPLLEKLGTNIQLQGPAGSGQHTKMCNQIAIASNMIGVCEAVAYAKKAGLNPDKVLESISTGAAGSWSLSNLAPRMLKGDFEPGFYVKHFMKDMKIALEEAERLQLPVPGLSLAKELYEELIKDGEENSGTQVLYKKYIRG

SEQ ID NO: 19868 - protein, 429 aa, Bacillus cereus ATCC 14579
MKAILERTFKLGLHETSPKQEVLAGVTSFFTIVYIMIVNASILSDAGIPLEAGILATVFSSFVGCLLMAFWANAPAILVPGMGVNAFFTYTAVHTLGLTWQEALAAVFISGIIFAIAAFTPIARVLSVSIPKSLKEAITVGIGLFLAFIGLQKGGLVVSNPNTAVAMGKLSNPVVLATVLTLIIALVLFIRNVRGNFLWTIAIGTGIAWLFGLVDTSQIGNSSFSFANYGDVFGAMSFGKLSSLPFWIATFSLSMVLIFENMGLLHGLLEDDRKFPRAYQANAISAMTCGLFGTSPTVSTVESAAGITAGGKTGLTSIVTGLLFFASLFALPFVKLIPDSAIAPILIIIGGLMITSIQQIPLNDFSEGFPAFLIIVMIPLTYSIADGIAFGFIAYPILKVALGKRKEVAPSMYIITCLFLAMFVLHAIG

SEQ ID NO: 19869 - protein, 304 aa, Bacillus cereus ATCC 14579
MKKRQLGNSDLFVTEMGLGCMSLGTSETEAMHIIDEAIDLGINFFDTADLYDYGLNEEFVGKALKGRRDQIVLTTKVGNRWTEEKNGWSWDPSKAYIKTEVKESLRRLQTDYIDLYQLHGGTIEDPIDETIEAFEELKKEGIIRHYGISSIRPNVVREYAKRSNIVSVLMEYNLLNRRPEEWFPLLNEHQISVIARGPLAKGILTDNNARKIERVKEKDYLSYSYDELHATLASVKEMIGERSLTGTAIQYCLHNKTVAAVIPGASSLQQLQENIRASQQLPLTKEEYIQLQKIVKYDTYALHR

SEQ ID NO: 19870 - protein, 308 aa, Bacillus cereus ATCC 14579
MKRFFAALFTILGAITALGIFFTNKVMYLKKKTEEEVLERETKKHFRIEDFDALHKEEIHIPSQFGYDLHGYYIPAGHSTNKFMVFCHGVTVNKINSVKYANLFLKRGYNVLIYDHRRHGKTGGKTTSYGYYEKHDLKSVVDWLKNRFGTNITLGIHGESMGAATLLQYAGLVEDGADFYIADCPFSDFHGQLQHRLKVEFHLPKWPLLPLANAFLKVRDGYTIREVSPIDCIKNINNPVLFIHSKDDDYILADMTKALYEAKENNKQLYIAEHGAHACSYNENKEEYEAAVDQFLNTYVKETKNRLA

SEQ ID NO: 19871 - protein, 462 aa, Bacillus cereus ATCC 14579
MTINSKTIEKSSYTYEELAEKNKAYVWHPFTQMKDYLEEDPVIIERGEGRKLYDVNGNEYWDGVSSIWLNVHGHQVPELDEAIREQLNKIAHSTMLGLANVPSILLAEKISEVVPDGLKKVFYSDSGSTAVEIAIKMAFQYWQHKGKPKKQRFVTLKEAYHGDTIGAVSVGAIDLFHQVYSSLLFDAIKMPYPYTYRSPYGNNKEEIVKSHLEEMEELLKEKHEEVAAIIVEPLMQGAGGMITMPKGYLKGLRDLCTKYNVLFITDEVATGFGRTGKMFACEHENVTPDILTAGKGLTGGYLPIAVTVTTDEIYNAFLGEYEEQKTFFHGHSYTGNPLGCAVAIANLELYEKTNLIEEVARKTDYVAAQLEKLFAYKHVGDIRQCGLMVGIELVKNKETKEAFDWTERVGVQVCKRSRELGMILRPLGNTIVFMPPLASTFEEIDDMLRILYKAISDVTEGE

SEQ ID NO: 19872 - protein, 399 aa, Bacillus cereus ATCC 14579
MYWNDGNERCEYCMTSHLFQTYGRRTIEFVKGTGTKVIDNKGKEYLDFTSGIGVCNLGHCHPTVLKGVQEQLDDIWHISNLFTNSLQEEVASLLTENRALDYVFFCNSGAEANEAALKLARKHTGKSLVVTCQQSFHGRTFGTMSATGQDKVKEGFGPLLPSFLHIPFNDIKALEEVMNEEVAAVMVEVVQGEGGVIPVDLSFLKEIETLCNKFGSLFIIDEVQTGIGRTGTLFAYEQVGIEPDIVTVAKALGNGIPVGAMIGGKELGTSFTAGSHGSTFGGNYIAMAAAKEVLQVSKKPSFLKEVQEKGEYVLEKLQEELQHVECIQNIRGKGLMIGIECKHEVASFIEQLENEGLLVLQAGPNVIRLLPPLIVTNEELEQAVYIIKKVVCTKNVSII

SEQ ID NO: 19873 - protein, 240 aa, Bacillus cereus ATCC 14579
MIKIENLHKSFGKNEVLKGITTTIEKGEVVAIIGPSGSGKSTFLRCMNMLEAPTDGHIWIGTEEVTNPKTNVMHVRENVGMVFQHFHLFPHMTVLENITYAPTNVKGVTKQEAEKKAEKLLEKVGLVDKKDTYPNRLSGGQKQRVAIARALAMEPEVMLFDEPTSALDPEMVKEVLEVMKSLVTTGMTMAIVTHEMGFAKEVADRVLFLDGGKLVEDSAPEEFFAAPKSERAQQFLQKIL

SEQ ID NO: 19874 - protein, 473 aa, Bacillus cereus ATCC 14579
MAKEYDLVIVGGGTGGYVAAIRASQLGLKTALVEKENLGGTCLHKGCIPSKALLRSAEVYATAKKSEEFGVIASNVELNFAKVQERKEKIVTQLHKGVQHLMKQGKIDVFEGIGRILGPSIFSPMPGTISVELASGEENEMLIPKNVLIATGSRPNSLPGLELDGEYVMSSDHALKMETLPSSIIIVGGGVIGIEWASMLADFGVEVTVLEYAKTILPLEDQDVSKEMQRLFKKKGIKVVTGAKVLPETLVKDNGVTIQAEHNGENKEFKAEKMLVSVGRQANTQNIGLENTDIVVEKGYIQTNEFYQTKESHIYAIGDVIGGLQLAHVASHEGIAAVEHIAGKEVTPIDYSMVSKCVYSSPEVASVGLTEQEAKEKGYKLKVGKFSFRAIGKALVYGESDGFVKLVVDEETNDILGVHMIGPHVTDMISEAGLARVLDATPWEVAHTIHPHPSLSEAIGEAALAVDGRALHA

SEQ ID NO: 19875 - protein, 371 aa, Bacillus cereus ATCC 14579
MSKRDYYEVLGLSKGASTDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLDFEEAIFGKELNVEIPVEDPCDTCKGSGAKPGTSKETCKHCSGSGQVSVEQNTPFGRIVNRQACGHCSGTGQIIKEKCTTCHGSSKVRKRKKINVKIPAGIDNGQQIRVSGKGEAGVNGGPARDLYVVVHVRNHEFFEREGDHIICEMPLTFAQMALGDEVEVPTVHGKVKLKIPAGTQTGTEFRLKGKGAPNVRGYGQGDQYVVVRVVVPTKLTSQQKDLLREFAGQEEQDDSLFGKLKRAFKGE

SEQ ID NO: 19876 - protein, 307 aa, Bacillus cereus ATCC 14579
MNVYRGVHELIGHTPIVEITRFSLPIGVRLFAKLEFYNPGGSVKDRLGRELIEDALEKGLVTQGGTIIEPTAGNTGIGLALAALEHDLRVIVCVPEKFSIEKQELMKALGATVVHTPTEQGMTGAIAKAKELVNEIPNSYSPSQFANEANPRAYFKTLGPELWDALNGEINIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 19877 - protein, 283 aa, Bacillus cereus ATCC 14579
MIRVGYLGPEATFTNMAVSRFFPEAEHVPYRTIPDCIDAAANENVDFAVVPLENAIEGSVNITVDYLVHEQPLSIVGEITVPIQQHLLVHPQYAEVWEEVYAVHSHPHAIAQCHKFLNEELKGVTVRDMTSTSAAAQYVKEHPEEKIAAIANEAAAEKYGLTIVRRSIHTHKNNHTRFLVLHKKKKAVLPNNGENRGEKTTLMITLPADYAGALYQVLSAFAWRKLNLSKIESRPMKTGLGNYFFLIDVDKAYDDVLLPGVTMELEALGFSVTVLGSYSSYWL

SEQ ID NO: 19878 - protein, 429 aa, Bacillus cereus ATCC 14579
MKKFDKSIAAFEEAQDLMPGGVNSPVRAFKSVGMNPLFMERGKGSKVYDIDGNEYIDYVLSWGPLIHGHANDRVVEALKSVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLEFFAAYYREMVEQGVFLPPSQFEGLFLSTAHSDADIEATIAAAEIAMSKLKA

SEQ ID NO: 19879 - protein, 221 aa, Bacillus cereus ATCC 14579
MLKKAIAEFIGTFVLVLFGTGVAVTGGGIEGIGILGIAMAFGLSIVAMAYSIGTISGCHINPAVSVAMFINKRMNAMELCYYVLAQILGGLLGTATLVTILKSAKTPLDNLGQNGFGTLGLSGAFLVEFILTFVFILVIVAVTGKKGSSSLAGLVIGFTLVLIHLLGIPLTGTSVNPARSIAPALFVGGEALSQLWVFIVAPILGGIFAAIVGKFILNTEK

SEQ ID NO: 19880 - protein, 289 aa, Bacillus cereus ATCC 14579
MLRDLFVKKKKYAAIPSEQVRKDVPDGVMTKCPECKKIMYTKELLKNLKVCVNCGYHHPMNAWERLDSILDEGSFREYDKEMVSLNPLEFPGYEEKLESDRKKTELNEAVVTGEGTIDDMLVVVAVMDSRFRMGSMGSVVGEKIARAVEKAYDLQVPFIIFTASGGARMQEGILSLMQMAKTSVALKKHSNAGGLFISVMTHPTTGGVSASFASLGDYNLAEPGALIGFAGRRVIEQTVREKLPEDFQTAEFLLDHGQLDAVVHRDDMRESLRKILEVHQGGEMAVWQS

SEQ ID NO: 19881 - protein, 175 aa, Bacillus cereus ATCC 14579
MNIEIKDTLISEEQLQAKVKELALQIERDFEGEEIVVIAVLKGSFVFAADLIRHIKNDVTIDFISASSYGNQTETTGKVKLLKDIDVNITGKNVIVVEDIIDSGLTLHFLKDHFFMHKPKALKFCTLLDKPERRKVDLTAEYVGFQIPDEFIVGYGIDCAEKYRNLPFIASVVTE

SEQ ID NO: 19882 - protein, 450 aa, Bacillus cereus ATCC 14579
MSTHVTFDYSKALSFIGEHEITYLRDAVKVTHHAIHEKTGAGNDFLGWVDLPLQYDKEEFARIQKCAEKIKNDSDILLVVGIGGSYLGARAAIEMLNHSFYNTLSKEQRKTPQVLFVGQNISSTYMKDLMDVLEGKDFSINVISKSGTTTEPALAFRIFRKLLEEKYGKEEARKRIYATTDKARGALKTLADNEGYETFVIPDDVGGRFSVLTPVGLLPIAVSGLNIEEMMKGAAAGHDDFGTSELEENPAYQYAVVRNALYNKGKTIEMLVNYEPALQYFAEWWKQLFGESEGKDQKGIFPSSANFSTDLHSLGQYVQEGRRDLFETVLKVGKSTHELTIESEENDLDGLNYLAGETVDFVNTKAYEGTLLAHSDGGVPNLIVNIPELNEYTFGYLVYFFEKACAMSGYLLGVNPFDQPGVEAYKKNMFALLGKPGFEELKAELEERLK

SEQ ID NO: 19883 - protein, 320 aa, Bacillus cereus ATCC 14579
MKPKIYIAEPVPTFVENYLSEHFDYEKWDQNEKVPRDVLLEKIQDKDGLLNFGSAINEELLTVAPNLKVVSNISVGYDNFDLQAMKNRKVIGTNTPYVLDDTVADLVFALMLSAGRRVCELDSYVKNGEWNAEIGKEHFGLDVHHSTIGIIGMGRIGEAVAKRAKFGFDMNVLYYNRRRKEEAEQKFDATYCDLQTLLKQSDFIVLLTPLTDETYHLIGEKEFSLMKETAIFINASRGKTVDEEALIHALTEKKIFAAGIDTFTQEPIQKDNPLLSLQNVVTLPHIGSATLKTRQQMAMTAAENLVAGLQGKTPPNIVRG

SEQ ID NO: 19884 - protein, 431 aa, Bacillus cereus ATCC 14579
MSTIIDVYAREVLDSRGNPTVEVEVYTESGAFGRAIVPSGASTGEHEAVELRDGDKSRYLGKGVVNAVNNVNEIIAPEIAGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERIGDKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEVAVYDGVKSFYNIKR

SEQ ID NO: 19885 - protein, 509 aa, Bacillus cereus ATCC 14579
MRKPTALIILDGFGLREETYGNAVAQAKKPNFDGYWNKFPHTTLTACGEAVGLPEGQMGNSEVGHLNIGAGRIVYQSLTRVNVAIREGEFDKNETFQSAIKSVKEKGTALHLFGLLSDGGVHSHMNHMFALLRLAAKEGVEKVYIHAFLDGRDVGPKTAQSYIDATNEVIKETGVGQFATISGRYYSMDRDKRWDRVEKCYRAMVNGEGPTYKSAEECVEDSYANGIYDEFVLPSVIVNEDNTPVATINDDDAVIFYNFRPDRAIQIARVFTNEDFREFDRGEKVPHIPEFVCMTHFSETVDGYVAFKPMNLDNTLGEVVAQAGLKQLRIAETEKYPHVTFFFSGGREAEFPGEERILINSPKVATYDLKPEMSIYEVTDALVNEIENDKHDVIILNFANCDMVGHSGMMEPTIKAVEATDECLGKVVEAILAKDGVALITADHGNADEELTSEGEPMTAHTTNPVPFIVTKNDVELREDGILGDIAPTMLTLLGVEQPKEMTGKTIIK

SEQ ID NO: 19886 - protein, 444 aa, Bacillus cereus ATCC 14579
MFKWLKPAPAIERLPADMIDHVYRLLRIRVLIGISVGYAAYYLVRSNFTLSSTYLVQEYGFSTAEIGLLGSVMAIVYGFSKFFMGNLSDKAFAQRFIAVGLFLSGLVNICFGFASSFGMIVTLLVVNGIVQGMGAPPCSIVMTKWFSKKERGTKTGLWNISHNVGGMLVPPLVGIGVGIFGENHWQGGVFIFPAIIAMVIAVLVWINAKDTPESEGLPPIDEYRNDYENLEKADNANKMSPKEILMKYVVKNKFVWFLCIANAFVYLIRFGVINWVPLYLTTVKGFSKAEAHAAYAIFEGMAIPSSLIVGFLSDKLFKGKRMPLCIISMVGVVIGTFIYWQATSVLVVSIAVSIIGCLIYVPQFLIGLSAMELVPKFAVGTTVGMCGLFGYVGGSLVANAAIGVIVDSSGWDGCFILLLTGAILSTVFLFIVQRGHERKDPKVA

SEQ ID NO: 19887 - protein, 290 aa, Bacillus cereus ATCC 14579
MRFDEAYSGKVFIKSHPSFEESKVVIYGMPMDWTVSYRPGSRFGPARIREVSIGLEEYSPYLDRELEEVKYFDAGDIPLPFGNAQRSLDMIEEYVSKLLDADKFPLGLGGEHLVSWPIFKAMAKKYPDLAIIHMDAHTDLRESYEGEPLSHSTPIRKVCDLIGPENVYSFGIRSGMKEEFEWAKEVGMNLYKFDVLEPLKEVLPKLAGRPVYVTIDIDVLDPAHAPGTGTLEAGGITSKELLDSIVAIANSNINVVGADLVEVAPVYDHSDQTPVAASKFVREMLLGWVK

SEQ ID NO: 19888 - protein, 275 aa, Bacillus cereus ATCC 14579
MELWFTEKQTKHFGITARINRTLHTEQTEFQKLDMVETEEFGNMLILDGMVMTTEKDEFVYHEMVAHVPLFTHPNPENVLIVGGGDGGVIREVLKHPSVKKATLVEIDGKVIEYSKQYLPSIAGALDNERVEVKVGDGFLHIAESENEYDVIMVDSTEPVGPAVNLFTKGFYAGISKALKEDGIFVAQTDNPWFTPELITTVFKDVKEIFPITRLYTANIPTYPSGLWTFTIGSKKHDPLEVIEERFHEIETKYYTKELHNAAFALPKFVGDLIK

SEQ ID NO: 19889 - protein, 399 aa, Bacillus cereus ATCC 14579
MGKVKEISKRKLLGIAGLGWLFDAMDVGMLSFVMVALQKDWGLSTQEMGWIGSINSIGMAVGALIFGILSDKIGRKSVFIITLLLFSIGSGLTALTTTLAMFLVLRFLIGMGLGGELPVASTLVSESVEAHERGKIVVLLESFWAGGWLIAALISYFVIPKYGWEVAMVLSAIPALYALYLRWNLPDSPRFQKVEKRPSVIENIKSVWSGEYRKATIMLWILWFCVVFSYYGMFLWLPSVMVLKGFSLIKSFQYVLIMTLAQLPGYFTAAWFIERLGRKFVLVTYLIGTACSAYLFGVADSLTVLIVAGMLLSFFNLGAWGALYAYTPEQYPTVIRGTGAGMAAAFGRIGGILGPLLVGYLVASEASLSLIFTIFCGSILIGVFAVIILGQETKQRELV

SEQ ID NO: 19890 - protein, 432 aa, Bacillus cereus ATCC 14579
MNVTTDVQQTTEETKAKRYKTLFGSALGYAAEGLDMLLLSFVLVYILKEFHLSPVEGGNLTLATTIGMLIGSYLFGFIADLFGRIRTMAFTILLFSLATALIYFATDYWQLLILRFLVGMGVGGEFGIGMAIVTETWSKEMRAKATSVVALGWQFGVLIASLLPAFIVPHFGWRAVFLFGLIPALLAVYVRKSLSEPKIWEQKQRYKKELLQKEAAGKLTTTEAEQLKHIKKFPLRKLFANKKVTITTIGLIIMSFIQNFGYYGIFTWMPTILANKYNYTLAKASGWMFISTIGMLIGIAIFGILADKIGRRKTFAIYYIGGTVYCLIYFFLFTDSTLLLWGSALLGFFANGMMGGFGAILAENYPAEARSTAENFIFGTGRGLAGFGPVIIGLLATGGNLLGALSLIFIIYPIGLITMLLCVPETKGKVLD

SEQ ID NO: 19891 - protein, 328 aa, Bacillus cereus ATCC 14579
MMENVFDYEDIQLIPAKCIVNSRSECDTTVTLGKHKFKLPVVPANMQTIIDERIATYLAENNYFYIMHRFQPEKRISFIRDMQSRGLIASISVGVKEDEYEFVQQLAAEQLTPEYITIDIAHGHSNAVINMIQHIKKHLPESFVIAGNVGTPEAVRELENAGADATKVGIGPGKVCITKIKTGFGTGGWQLAALRWCAKAASKPIIADGGIRTHGDVAKSIRFGATMVMIGSLFAGHEESPGETIERDGKLYKEYFGSASEFQKGEKKNVEGKKMFVEHKGSLEDTLIEMEQDLQSSISYAGGTKLDAIRTVDYVVVKNSIFNGDKVY

SEQ ID NO: 19892 - protein, 376 aa, Arabidopsis thaliana
MAIRKEEESREEQSNSFLLDALYCEEEKWDDEGEEVEENSSLSSSSSPFVVLQQDLFWEDEDLVTLFSKEEEQGLSCLDDVYLSTDRKEAVGWILRVNAHYGFSTLAAVLAITYLDKFICSYSLQRDKPWMLQLVSVACLSLAAKVEETQVPLLLDFQVEETKYVFEAKTIQRMELLILSTLEWKMHLITPISFVDHIIRRLGLKNNAHWDFLNKCHRLLLSVISDSRFVGYLPSVVAAATMMRIIEQVDPFDPLSYQTNLLGVLNLTKEKVKTCYDLILQLPVDRICLQIQIQSSKKRKSHDSSSSLNSPSCVIDANPFNSDESSNDSWSASSCNPPTSSSSPQQQPPLKKMRGAEENEKKKPILHLPWAIVATP

SEQ ID NO: 19893 - protein, 284 aa, Ricinus communis
AIAQIGWIAGPAVMFLFSLVTYYTSTLLSACYRSGDPVNGKRNYTYMDAVRTNLGGAKVKLCGFVQYLNLFGVAIGYTIASSISMMAIKRSNCFHKSGGKNPCHINANPYMIAFGIAEIIFSQIPDFDQLWWLSILAAVMSFTYSTIGLGLGIAQVVENGKAMGSVTGISIGANVTPTQKIWRSFQALGDIAFAYSYSIILIEIQDTVRSPPSESKTMKKATLISVAVTTLFYMLCGCFGYAAFGDMSPGNLLTGFGFYNPYWLLDIANVAIVVHLVGAYQVFA

SEQ ID NO: 19894 - protein, 505 aa, Schizosaccharomyces pombe
MVDGSIHVPVQSHEGQHDNSSSLNEEIQTSQDPLGIVESYQESSTSDFDKSHYTHNSSIAAADSEYGSAFIQGQSSNGSEIKSERPSIDKKLDVNIDSHPIEPPPFEHDIGLPASQVPAAEEEVESTPKAKPLYFLLDKRFWIVFFLGQVLSLCITATNTFNGYMSGISNIPAFQTFLVYALLTLVYTPYTVFRMGFKKYFEMIFRHGWKYIIFAFFDVEGNYFVVLAYQYTNMLSASLLDSWATVAVVILSFIFLKVRYHWSQILGVVACIGGLVLLVVSDVISRGDYSAVNPGLGDGYMIIGATCYGVSNTLEEYFASKLPLYVVIGQLSLYGSIISIIQTFIFDRHHLYTLHWTSEMGGYLAGFILVMFLLYSLAPILFRMSSATFYNISLLTSDFWSLVIGIHVFGYHVYWLYPIAFVLIILGLFVYHVFVDATRESIKPWLKKGQGVDGVGTVRRPPSLVSSNDELNKKNDIVVAHHDNEVKERIYDAYLSVKNVFVRKS

SEQ ID NO: 19895 - protein, 466 aa, Zymomonas mobilis
MADHFDLIVLGGGPGGYVAAIRAAQLNLKVALVERVHLGGICLNWGCIPTKSLLRSAEVYHEMQNAEAYGLTSFKPDFDLDKIIARSREVAARLASGVKTLLRKNKVEVISGVGQLTGNQQMRVETTEGEEKILEAKDIIIATGARARQLPNVHSDGKHIWTYHHALKPPAMPKKLLVIGSGAIGIEFASLYADFGAEVSIVEHAPQILPMEDAEVSAYVAKAFKKRGIRILTQSALQNLTPDDEGVTAEIAGADGKVTKERFSHAIVAIGVVANVENIGLDKLGIKLDRGFIAVDGFGRTNVDHVWAIGDVAGAPCLAHKASHQGVIAAEDIAGCDHVHPLNTQNIPGCTYARPQVASVGLTEEKARQQGYNVKIGNFPFIANGKAIAQGATDGFVKTVFDADSGALLGAHMVGAEVTEMIHGYTVARTLETTEAEIMETIFPHPTLSEAMHESVLAAYGRALHF

SEQ ID NO: 19896 - protein, 496 aa, Vigna unguiculata
MASLDKNMLLNYVPVYVMLPLGVVSVNNVFEDPEGLKEQLVQLREAGVDGVMVDVWWGIIEQKGPKQYDWSAYKSLFQLVQECGLKLQAIMSFHQCGGNVGDVVNIPIPQWVLDIGESDPDIFYTNRSGTRDKEYLTIGVDNKPIFHGRTAIEVYSDYMKSFRENMSDFLKSEVIIDIEVGLGPAGELRYPSYPQNQGWVFPGIGEFQCYDKYLKAEFKAAAARAGHSEWELPDDAGTYNDVPESTEFFKTNGTYLTEKGKFFLTWYSNQLLNHGDEILDEANKAFLGCKVNLAIKVSGIHWWYKAQNHAAELTAGYYNLDDRDGYRPIAKMVSRHHASLNFTCLEMRDSEQSSDAQSGPQELVQQVLSGGWRENIEVAGENALSRYDATAYNQIILNARPQGVNKDGPPKHRMYGVTYLRLSDELLQQSNFDIFKKFVVKMHADQDYCEDPQEYNHGIPPLKRSEPKIPVDVLNEATKPIPPFPWDSETDMKVDG

SEQ ID NO: 19897 - protein, 266 aa, Bacillus sphaericus
LENMGATGIEVDFRRGEAVFELPNALGVETAKKAISDAKYQPGKAEEVQSQEMVQLGNEGDYDYIIIGSGGAAFSSAIEAVKYGAKVAMIERGTIGGTCVNIGCVPSKTLLRAGEINHLAKNNPFVGLHTSAGEVDLAPLIKQKNELVTELRNSKYVDLIDDYGFELIEGEAKFVDEKTVEVNGAPISAKRFLIATGASPAKPNIPGLNEVDYLTSTSLLELKKVPKRLVVIGSGYIGMELGQLFHNLGSEVTLIQRSERLLKEYD

SEQ ID NO: 19898 - protein, 117 aa, Bacillus sphaericus
PAIATVGLTEQQAKENGYEVKTSVLPLDAVPRALVNRETTGVFKLVADSKTMKVLGAHVVAENAGDVIYAATLAVKFGLTVDDIRETLAPYLTMAEGLKLAALTFDKDISKLSCCAG

SEQ ID NO: 19899 - protein, 331 aa, Glomerella cingulata
MKFTGSPLLWPSWLPLPAPPPPLPSVTRRRDPRTVGKRAAITDACDVGYGAGTTGGSGGTTTTVSTPAQFTAAATSDEKAVIVVKGAITGATKVKVGSNKSIIGRAGSSLTGVGLYINKQENVIVRNMKISKVLADNGDRIGIQASSKVWVDHCDLSSDKKNNGKDYYDGLLDITHASMAVTVSNTYIHDHYKGSLVGHSDSNSAEDTGKLYVTYANNHWYNVASRNPSVRFGNVHIFNNYAEKLETSGVNTRMGAQLLIESSVFSDTKKAVTFLDSKSTGYAVVNDVDLGGSTNDRPQGTFTKPDYSYTLLGSSKVKAAVVGTAGQTLTF

SEQ ID NO: 19900 - protein, 222 aa, Nicotiana tabacum
MSLTIPTNLSKPISTLNSQFTKKPRFATIVCSSSSSCDEQSSCNLKAFSAALALSSVLLSVPVLPASADISGLTPCKESKQFAKREKQQIKKLESSLKLYAPDSAPALAIQATVEKTKRRFDNYGKQGLLCGSDGLPHLIVSGDQRHWGEFITPGILFLYIAGWIGWVGRSYLIAVRDDKKPTMKEIIIDVPLANKLIWRGFSWPVAAYREYLNGELIDPNF

SEQ ID NO: 19901 - protein, 180 aa, Nicotiana tabacum
MASSVLSSAAVATRTNVAQANMVAPFTGLKSAASFPVSRKQNLDITSIASNGGRVQCMQVWPPYGKKKYETLSYLPDLSEEQLLSEIEYLLKNGWVPCLEFETERGFVYRENNKSPGYYDGRYWTMWKLPMFGCTDATQVLAEVGEAKKAYPEAWIRIIGFDNVRQVQCISFIAYKPEGY

SEQ ID NO: 19902 - protein, 413 aa, Nicotiana tabacum
MPEKPLFGKYELGKLLGCGASAKVYHAREINNGQSVAIKMINKNNKDNIPNENIEREISILRQLRHPYIVKLYEVLATKSKIYFVMEYVKGGELFTKIADHGRFSEDLSRKYFQQLISALNYCHSRGIYHRDLKPENILIDENGDLKISDFGLSATTDQIQKFDGLLHTVCGSPAYVAPEILTIKGYDGAKTDIWSCGIILYVMIAGYLPFYDQNLMLMYKKIYKGEFKCPKWMSPDVIRILSRLLDTNPATRITIDEIIKDPWFRKGLKFIKFAGEEEDKYSLSSNCLNAFDLISFSQGLDISGLFKSNNPANDLERTVVEQSPESVIERVEEMAKKENFRLRKKKEWGIEMKVQNGKLTMSVDIYRLTERFVIVEVKREAGNGDLYTDLWRNKLKAVILGQQIAEIQDSGS

SEQ ID NO: 19903 - protein, 445 aa, Nicotiana tabacum
MISTWRKRRTEKRVAKRGLVEDITNMELVIPRHFTCPISLDLMKDPVTLSTGITYDRENIEKWIEAGNQTCPITNQTLRNGEPIPNHSIRKMIQQWCVENKDHGIERIPTPRIPVTSSEVVELLAKISKEIHDLELCGELVSKVKKLVNESERNKRCFVTNGTAQVLSAAFVAFSEEINMRNASTGEVILSTLTTILPLDGESKLNLGSISSLRCMVWFLKNGSLSSRRNAVFVLKDILKMEEQDKVEILLGMEGALEGLVKLVKEPICPTTTKASLLAIYHMVNSSHLSSSFANKKAQSRFVDLGLVELLVEMLVDCEKSICEKALGVLDGICSSIEGRKRAYSYALTVPVLVKKLLRVSDLATEFSVSILWKIGKNEKRENGGDVLVEALKLGAFQKLLLLLQVGCSETTKEKASELLKLLNVHRDRAECVDSLDFKSLKRPF

SEQ ID NO: 19904 - protein, 451 aa, Lactococcus lactis subsp. lactis Il1403
MKWLKKQAELYPQKQFLNDSTFAQINQEVNKMAEHLAPLIDNQSRVALLSENSVEMAVVLFALLGLSKEVLLLNRHLTEYELADQIKELKIDKVFTSDLLTEKVTDSISFSEIWTSNPCPVSLSADFPDEKIAVIMNTSATTGKFKSVPITWGMISNHVKASKETLGAYDNDNWLVILPMFHVSGLSIIMRTLYNATSATVVDKFDENQLLEMINSGKINMVSLVPTLLTRIADKLHSNNLRLILLGGEFIPQPLIKKCQELGLPIYKTYGMTESFSQSVTFNILDFPDKTSSVGRPLPGVEIEIRQADLAGVGEIWLKSPMLMKAYLGQKPYGTAFETGDIGYLDTDGFLYLLNRRKDIIISGGENIYPKEIEDLVYSLPEIKECALVAKPDAKWGQVPILFVSGNISQEKLENFLTEKLAKYKRPQSITFMDELPKNASGKILRKELKG

SEQ ID NO: 19905 - protein, 157 aa, Lactococcus lactis subsp. lactis Il1403
MNFYDFSAFKMNGETVSMSDFKGKVVIVVNTASKCGFTPQFEGLEKLYENYKDQGLEILGFPCNQFVNQDAGENSEINEFCQLNYGVTFPMFQKIKVNGKEAHPLYQFLKKEAKGALSGTIKWNFTKFLIDREGNVIERFAPKTEPKEMEEEIQKLL

SEQ ID NO: 19906 - protein, 139 aa, Pinus pinaster
MSGKGAKGLLMGKSSAPVNNNNNKDKDKKKPVSRSSRAGLQFPVGRIHRLLKSRISANGRVGATAAVYSAAILEYLTAEVLELAGNASKDLKVKRITPRHLQLAIRGDEELDTLIKGTIAVGGVVFHIHKSLINKSSKD

SEQ ID NO: 19907 - protein, 420 aa, Candida boidinii
MKFTIPFSVAFSILAATTLVDAKVHSIPIKKHSLEETFKDISYNDYLASLKNKYISLYNKHHSNNAGESIEGDQQHPFIPFVEVVDGEFKDSKTDAPLTNYMNAQYFTEIQLGTPGQVFKVILDTGSSNLWVPGKDCSSLACYLHSKYDHDESSTYKKNGTEFAIRYGTGSLEGFVSSDTLTIGDLVIPDQGFAEATSEPGLTFAFGKFDGILGLAYDTISVQKVVPPVYKAIDSGLLDKPQFSFYLGDTAKSETDGGVATFGGIDESKFNGKLTWLPVRRKAYWEVAFDGVGLGSEYAPLLNTGAAIDTGTSLIALPSGLAEILNSEIGATKSWSGQYTIDCAARDSLPDLTFTLAGYNFTIGPYDYTLEVSGSCISSFTPMDIPAPIGPMATVGDAFLRKFYSVYDLGKDAVGLAPAI

SEQ ID NO: 19908 - protein, 112 aa, Arabidopsis lyrata subsp. petraea
LVEKFGIDPNNAFAFWDWVGGRYSVCSAVGVLPLSLQYGFSVVEKFLKGASSVDQHFQSTPIEKNIPVLLGLLSVWNVSFLGYPARAILPYSQALEKFAPHIQQVSMESNGK

SEQ ID NO: 19909 - protein, 112 aa, Arabidopsis lyrata subsp. lyrata
LVEKFGIDPNNAFAFWDWVGGRYSVCSAVGVLPLSLQYGFSVVEKFLKGASSIDQHFQSTPFEKNMPVLLGLLSVWNVSFLGYPARAILPYSQALEKFAPHIQQVSMESNGK

SEQ ID NO: 19910 - protein, 112 aa, Arabidopsis lyrata subsp. lyrata
LVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQVSMESNGK

SEQ ID NO: 19911 - protein, 191 aa, Blumeria graminis
MSLRCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQTDLRDDLSVREKLNKQKMQPVKREDGERMAKDLGAVRYVECSALTQYKLKDVFDEAIVAALEPPAPKKKHRNCLIL

SEQ ID NO: 19912 - protein, 414 aa, Clostridium saccharobutylicum
MTCNDIQLLDEADRCLLCKKPRCKENCPIQTSIPEIISLYKENRLREAGEILFNNNPLSAVCSLVCIHEDQCKGNCIKGIKGEPIRFHDIEYEISMKYLEEVRFENLPKDKDRIAIIGGGPAGITIAFILANKGYDVTIFDAHVKIGGVLRYGIPEYRLPKKILDTIEDRLVELGIKIRPNTLIGPVITLDRLYEDGYKAIFIGTGVWNPKTLNIKGETRGNAHFAIDYLKSPEAYRLGEKVAVIGAGNVAMDAARSAKRNGAKEVTVLYRKGFDEMSATKQEIMEAKEDGVIFNLFKSPIEITEKGIRLSSTENVTDENGKIVTKVIEGKEEFFECDSIIIAVSQTPKTNIVSNTKELNTNKWGLIITDEKGNTTRKGTFASGDVVTGAKTVVEAVVQAKTVANTIEEYCKNN

SEQ ID NO: 19913 - protein, 493 aa, Delftia acidovorans
MSQKFIDRHGLWSDAQKAAAVEVLKKIEQDGIQMIRLSWPDQYGLLRGKMLSVAALRSAFGSGSEITMAPFFFDTASAIVFNPFSSDGGLGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDEWGPSQMETTFDVMSGLDMADTMVLFRNAVKQICRRRGYLASFMCKPKIEGFCASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 19914 - protein, 445 aa, Arabidopsis thaliana
MVGSHKASGVLLVLLVVMATTIANGTPVVDTAKNAATAVEDTAKNVATAVGGAAASVGAKVTGAKPGGASLDVKASGAKGDGKTDDSAAFAAAWKEACAAGSTITVPKGEYLVESLEFKGPCKGPVTLELNGNFKAPATVKTTKPHAGWIDFENLADFTLNGNKAIFDGQGSLAWKANDCAKTGKCNSLPINIRFTGLTNSKINSITSTNSKLFHMNILNCKNITLTDIGIDAPPESLNTDGIHIGRSNGVNLIGAKIKTGDDCVSIGDGTENLIVENVECGPGHGISIGSLGRYPNEQPVKGVTVRKCLIKNTDNGVRIKTWPGSPPGIASNILFEDITMDNVSLPVLIDQEYCPYGHCKAGVPSKVKLSDVTIKNIKGTSATKVAVKLMCSKGVPCTNIALSDINLVHNGKEGPAVSACSNIKPILSGKLVPAACTEVAKPGP

SEQ ID NO: 19915 - protein, 267 aa, Candida albicans
MANEEYVTDSSSDFTEYWIDLFLGIKGNEYFCDIDDEYIRDRFNLTGLNSEVSKLPTLIDIITDVIDIELQPEEHKDSLEHNARILYGLIHARYILTTRGLNKMFEKFRSGDFGYCPRVHCQLNPLLPIGLNDQPRMASVKLYCSKCEDLYNPKSGRHSAIDGAYFGTSFPAMFFQNFPNTVPIHAKETYVPRVFGFKLHEYSKLNRWRELQRLKLENRLKKNGIQIDNVVGGFITNGDEEEKQDNNNNKQLQSVSSQFKSLSPNQK

SEQ ID NO: 19916 - protein, 360 aa, Gypsophila elegans
MVIATKVAPSRVETLASSGIECIPKEYVRPEEELTSIGDVFEEEKKDGGPQVPTMDLKDIASEDPEVRDKAIQELKKAAMEWGVMHIVNHGISEELITRVKVAGETFFEFPIEEKEKYANDQDSGNVQGYGSKLANNASGQLEWEDYFFHLAFPEAKRDMSIWPKAPADYIPAVSDYSKELRGLATRILSALSVGLGLEEGRLEKEVGGLEDLNLQMKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKPLPDLVSDSDPARYPPRTFAQHIQHKLFRKAQDVQSPVTN

SEQ ID NO: 19917 - protein, 353 aa, Gypsophila elegans
MVSSNNTTETLDGKHDTKPVQGETVCVTGASGFIGSWLIMRLLERGYTVRGTVRDPDNTKKVQHLLDLPQAKTNLTLWKADLNEEGSFDKAVDGCSGVFHIATPMDFESKDPENEMIKPTINGMLDIMKSCAKAKVKRVVFTSSGGTVNVEETQKAEYDETCWSDLDFIRSVKMTGWMYFVSKILAEQAAWKYAAENNLDFISIIPPLVVGPFIMPSMPPSLITALSPITRTESHYTIIKQGQFVHLDDLCMAHIFLYENPKAQGRYIASACDATIYDIAKMLREEYPEYNVPTKFKDYKEDMDLVHFSSKKLTELGFEFKYGLKDMYTGAVETCRAKGLLPLSLENHENVYA

SEQ ID NO: 19918 - protein, 159 aa, Haemophilus influenzae
MFRAAIKAGTELGKQAKALMDEGKLVPDELTVALVKDRIAQADCTNGFLLDGFPRTIPQADALKDSGVKIDFVLEFDVPDEVIVERMSGRRVHQTSGRSYHIVYNPPKVEGKDDVTGEDLIIRADDKPETVLDRLAVYHKQTSPLIDYYQAEAKAGNTQ

SEQ ID NO: 19919 - protein, 159 aa, Haemophilus influenzae
MFRAAIKAGTELGKQAKALMDEGKLVPDELTVALVKDRIAQADCTNGFLLDGFPRTIPQADALKDSGVKIDFVLEFDVPDEVIVERMSGRRVHQASGRSYHIVYNPPKVEGKDDVTGEDLIIRADDKPETVLARLAVYHKQTSPLIDYYQAEAKAGNTQ

SEQ ID NO: 19920 - protein, 156 aa, Haemophilus influenzae
NRTNTPVLVDGKDVMPEVNAVLAKMKDFCQRIISGEWKGYTGKAITDVVNIGIGGSDLGPYTVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 19921 - protein, 156 aa, Haemophilus influenzae
NRANTPVLVDGKDVMPEINAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKNESAVAKHFAALSTNAKDVEKFGIDTN

SEQ ID NO: 19922 - protein, 417 aa, Schizosaccharomyces pombe
MALLPFFDLTNFESDASEELGWLKYVGRVQTRVFPQHFKDNLEKVRKISETIDVIVDTTAELGPEACVNLLNAGALAILVNEEMLNELADISPNRLVLKTDTTDIGKIEKLSQVAGSIQWIGSAENYPPDFFERASKIIHKAVMPEGGGRTLYLEFPEQPSMEVLKSFSVHSVVPVLSSSFLTVKPAEEPKKLSLADLILISANTDREDGLFSTLVVNELGIALGLVYSSKESVAESLKTGTGVYQSRKRGLWYKGASSGAVQHLIHIDVDCDEDCLRFVVYQTGKGFCHLDTLHCFGQASGLCQLEKTLIDRKNNAPEGSYTARLFSDPKLLRAKIMEEAEELCDATTKENVIWEMADLMYFAITRCVGSGVSLNDISRHLDLKHRKVTRRKGDAKVAWQEKLKDKGGVANTSYTA

SEQ ID NO: 19923 - protein, 376 aa, Shigella flexneri 2a str. 2457T
MAKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETPVGLNEKQKQLLQELQESFGGPTGEHNSPRSKSFFDGVKKFFDDLTR

SEQ ID NO: 19924 - protein, 377 aa, Schizosaccharomyces pombe
MATSQVLHILPKPSYEHAFNSQRTEFVTTTATNQVELYEQDGNGWKHARTFSDHDKIVTCVDWAPKSNRIVTCSQDRNAYVYEKRPDGTWKQTLVLLRLNRAATFVRWSPNEDKFAVGSGARVISVCYFEQENDWWVSKHLKRPLRSTILSLDWHPNNVLLAAGCADRKAYVLSAYVRDVDAKPEASVWGSRLPFNTVCAEYPSGGWVHAVGFSPSGNALAYAGHDSSVTIAYPSAPEQPPRALITVKLSQLPLRSLLWANESAIVAAGYNYSPILLQGNESGWAHTRDLDAGTSKTSFTHTGNTGEGREEEGPVSFTALRSTFRNMDLKGSSQSISSLPTVHQNMIATLRPYAGTPGNITAFTSSGTDGRVVLWTL

SEQ ID NO: 19925 - protein, 398 aa, Schizosaccharomyces pombe
MAGSKWETEETNQFAIENQKLEEEWRKKRRLEKKRKRKILEEEEKAEERNIDACRLYLMGNTPELKSCNSIDDYEILEKIEEGSYGIVYRGLDKSTNTLVALKKIKFDPNGIGFPITSLREIESLSSIRHDNIVELEKVVVGKDLKDVYLVMEFMEHDLKTLLDNMPEDFLQSEVKTLMLQLLAATAFMHHHWYLHRDLKPSNLLMNNTGEIKLADFGLARPVSEPKSSLTRLVVTLWYRAPELLLGAPSYGKEIDMWSIGCIFAEMITRTPLFSGKSELDQLYKIFNLLGYPTREEWPQYFLLPYANKIKHPTVPTHSKIRTSIPNLTGNAYDLLNRLLSLNPAKRISAKEALEHPYFYESPRPKDPKFFPTFPSKAKGESKEKNVFQSFRSASPKK

SEQ ID NO: 19926 - protein, 472 aa, Shigella flexneri 2a str. 2457T
METNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGDLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDTEGEDSPLLKKMLAGMIDLMPSSMALLAPNVNSYRRFQPGMYVPTQASWGHNNRTVALRIPCGDRHNHRVEYHVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 19927 - protein, 495 aa, Shigella flexneri 2a str. 2457T
MNFHHLAYWQDKALSLAIENRLFINGEYTAAAENETFETVEPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQKAASATAAGIFYNQGQVRIAGTRLLLEESIADEFLALLKQQAQNWQPGHPLDPATTMGTLIDSAHADSVHTFIREGEGKGQLLLDGRNAGLAAAIGPTIFVDVDPNASLSREEIFGPVLVVTRFTSEDQALQLANDSQYGLGAAVWTRDLSRAHRMSRRLKAGSVFVNNYNDGDMTVPFGGYKQSGNGRDKSLHALEKFTELKTIWISLEA

SEQ ID NO: 19928 - protein, 421 aa, Shigella flexneri 2a str. 2457T
MSNNEFHQRRLSATPRGVGVMCNFFAQSAENATLKDVEGNEYIDFAAGIAVLNTGHRHPDLVAAVEQQLQQFTHTAYQIVPYESYVTLAEKINTLAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGECGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAAEFNDPQTGEPSAAIAQKIQQRALAQGLLLLTCGAYGNVIRFLYPLTIPDAQFDAAMKILQDALSD

SEQ ID NO: 19929 - protein, 457 aa, Shigella flexneri 2a str. 2457T
MQKYISEARLLLALAIPVILAQIAQTAMGFVDTVMAGGYSATDMAAVAIGTSIWLPAILFGHGLLLALTPVIAQLNGSGRRERIAHQVRQGFWLAGFVSVLIMLVLWNAGYIIRYMENIDPALADKAVGYLRALLWGAPGYLFFQVARNQCEGLAKTKPGMVMGFIGLLVNIPVNYIFIYGHFGMPELGGVGCGVATAAVYWVMFLAMVSYIKRARSMRDIRNEKGTAKPEPAVMKRLIQLGLPIALALFFEVTLFAVVALLVSPLGIVDVAGHQIALNFSSLMFVLPMSLAAAVTIRVGYRLGQGSTLDAQTAARTGLMVGVCMATLTAIFTVSLREQIALLYNDNPEVVTLAAHLMLLAAVYQISDSIQVIGSGILRGYKDTRSIFYITFTAYWVLGLPSGYILALTDLVVEPMGPAGFWIGFIIGLTSAAIMMMLRMRFLQRMPSAIILQRASR

SEQ ID NO: 19930 - protein, 412 aa, Shigella flexneri 2a str. 2457T
MPQQNYLDELTPAFTPLLAIKEASRCLLCHDAPCSQACPAQTDPGKFIRSIYFRNFKGAAETIRENNALGAVCARVCPTEKLCQSGCTRAGVDAPIDIGRLQRFVTDFEQQTGMEIYQPGTKTLGKVAIIGAGPAGLQASVTLTNQGYDVTIYEKEAHPGGWLRNGIPQFRLPQSVLDAEIARIEKMGVTIKCNNEIGKTLTLEQLKAENRAVLVTVGLSSGSGLPLFEHSDVEIAVDFLQRVRQAQGDISIPQSALIIGGGDVAMDVASTLKVLGCQAVTCVAREELDEFPASEKEFASARELGVSIIDGFTPVAVEGNKVTFKHVRLSGELTMAADKIILAVGQHARLDAFAELEQQRNTIKTQNYQIRDPQVFAAGDIVEGDKTVVYAVKTGKEAAEAIHHYLEGACSC

SEQ ID NO: 19931 - protein, 452 aa, Shigella flexneri 2a str. 2457T
MLSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFFYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQKRNGG

SEQ ID NO: 19932 - protein, 323 aa, Shigella flexneri 2a str. 2457T
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQVLAGEEIKPGPHKIQGIGAGFIPANLDLKLVDKVIGITNEEAISTARRLMEEEGILAGISSGAAVAAALKLQEDESLTNKNIVVILPSSGERYLSTALFADLFTEKELQQ

SEQ ID NO: 19933 - protein, 365 aa, Shigella flexneri 2a str. 2457T
MSIEIANIKKSFGRTQVLNDISLDIPSGQMVALLGPSGSGKTTLLRIIAGLEHQTSGHIRFHGTDVSRLHARDRKVGFVFQHYALFRHMTVFDNITFGLTVLPRRERPNAAAIKAKVTKLLEMVQLAHLADRYPAQLSGGQKQRVALARALAVEPQILLLDEPFGALDAQVRKELRRWLRQLHEELKFTSVFVTHDQEEATEVADRVVVMSQGNIEQADAPNQVWREPATRFVLEFMGEVNRLQGTIRGGQFHVGAHRWPLGYTPAYQGPVDLFLRPWEVDISRRTSLDSPLPVQVLEASPKGHYTQLVVQPLGWYNEPLTVVMHGDDAPQHGERLFVGLQHARLYNGDERIETRDEELALAQSA

SEQ ID NO: 19934 - protein, 466 aa, Shigella flexneri 2a str. 2457T
MGQSSQPHELGGGLKSRHVTMLSIAGVIGASLFVGSSVAIAEADPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDMPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLDPWLTWLVIGFITFVLVVMLFRPAQQLEVISTGLLAIGIICTVPIMARWKKLVLWQKTPVHNTR

SEQ ID NO: 19935 - protein, 445 aa, Shigella flexneri 2a str. 2457T
MSNRKYFGTDGIRGRVGDAPITPDFVLKLGWAAGKVLARHGSRKIIIGKDTRISGYMLESALEAGLAAAGLSALFTGPMPTPAVAYLTRTFRAEAGIVISASHNPFYDNGIKFFSIDGTKLPDAVEEAIEAEMEKEISCVDSAELGKASRIVDAAGRYIEFCKATFPNELSLSELKIVVDCANGATYHIAPNVLRELGANVIAIGCEPNGVNINAEVGATDVRALQARVLAEKADLGIAFDGDGDRVIMVDHEGNKVDGDQIMYIIAREGLRQGQLRGGAVGTLMSNMGLELALKQLGIPFARAKVGDRYVLEKMQEKGWRIGAENSGHVILLDKTTTGDGIVAGLQVLAAMARNHMSLHDLCSGMKMFPQILVNVRYTAGSGDPLEHESVKAVTAEVEAALGNRGRVLLRKSGTEPLIRVMVEGEDEAQVTEFAHRIADAVKAV

SEQ ID NO: 19936 - protein, 461 aa, Shigella flexneri 2a str. 2457T
MADNKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWSPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIGSCLNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 19937 - protein, 349 aa, Shigella flexneri 2a str. 2457T
MKAFPETFLWGGATAANQVEGAWLEDGKGITTSDLQPHGVMGKMEPRILGKENIKDVAIDFYYRYPEDIALFAEMGFTCLRISIAWARIFPQGDEAEPNEAGLAFYDRLFDEMAQAGIKPLVTLSHYEMLYGLVKNYGGWANRAVIDHFEHYARTVFTRYQHKVALWLTFNEINMSLHAPFTGVGLAEESGEAEVYQAIHHQLVASARAVKAYHSLIPEAKIGNMLLGGLVYPLTCQPQDMLQAMEENRRWMFFGDVQARGQYPGYMQRFFRDHNITIEMTESDAEDLKHTVDFISFSYYMTGCVSHDESINKNAQGNILNMIPNPHLKSSEWGWQIDPVGLRVMLPTY

SEQ ID NO: 19938 - protein, 206 aa, Cordyceps bassiana
AEANAKIPCLSTNMPTNIILLTCDARGVLPPISKLDRNQTMFHFISGYTSKMAGTEDGVTEPQATFSSCFAQPFLALHPMRYAKMLADRIEANNANAWLLNTGWVGAGFSQGGKRCPLKYTRAILDAIHSGELAKVQYENYDIFNLQVPTTCPKVPDDMLNPKKAWTAGADSFEGEVKKLGGLFNENFKKYESEATPEVVKAGPAV

SEQ ID NO: 19939 - protein, 478 aa, Arabidopsis thaliana
MTKKRKLEGEESNEAEEPSQKLKQTPEEEQQLVIKNQDNQGDVEEVEYEEVEEEQEEEVEDDDDEDDGDENEDQTDGNRIEAAATSGSGNQEDDDDEPIQDLLEPFSKEQVLSLLKEAAEKHVDVANRIREVADEDPVHRKIFVHGLGWDTKTETLIEAFKQYGEIEDCKAVFDKISGKSKGYGFILYKSRSGARNALKQPQKKIGSRMTACQLASKGPVFGGAPIAAAAVSAPAQHSNSEHTQKKIYVSNVGAELDPQKLLMFFSKFGEIEEGPLGLDKYTGRPKGFCLFVYKSSESAKRALEEPHKTFEGHILHCQKAIDGPKPGKQQQHHHNPHAYNNPRYQRNDNNGYGPPGGHGHLMAGNPAGMGGPTAQVINPAIGQALTALLASQGAGLAFNPAIGQALLGSLGTAAGVNPGNGVGMPTGYGTQAMAPGTMPGYGTQPGLQGGYQTPQPGQGGTSRGQHGVGPYGTPYMGH

SEQ ID NO: 19940 - protein, 380 aa, Oryza sativa (japonica cultivar-group)
MVHAPAKVAAAAAIPLLTPYKMGQLELSHRVVLAPLTRCRSYGNVPQPHAAVYYSQRATRGGLLIAEATDISPTAQGYPETPGIYTQQQIEAWKPIVDAVHRKGALFFLQIWHVGRVSTTDFQPNGQAPISSTDKQITPDDSGMVYSKPRRLRTDEIPQIIDDFRRAARNAIEAGFDGVEIHGAHGYLLEQFMKDSANDRTDEYGGSLENRCRFAVEVIDAVVAEVGAHRVGIRLSPFVDFMDCFDSDPVALGSYMVQQLNKHPGFLYCHMVEPRMAIIEGRRKIAHGLLPFRKQFNGTFIAAGGYDREEGNKVVADGYADLVAYGRLFLANPDLPRRFELDAPLNRYDRSTFYTQDPVVGYTDYPFLEEIDEESRTTYA

SEQ ID NO: 19941 - protein, 305 aa, Miscanthus condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19942 - protein, 305 aa, Miscanthus condensatus
IESVGEGVTDVAPGDHVLPVFTGECKECAHCRSAESNMCDLLRINTDRGVMIGDGKSRFSINGKPIYHLVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19943 - protein, 305 aa, Miscanthus condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMSFLNERTLKGTFFGNFKPRTDLPNVVELYMKKELEVEKFITHSVPFAEINKAFDLMAKGEGIRCIIRMEN

SEQ ID NO: 19944 - protein, 305 aa, Miscanthus condensatus
IESVGEGVTDVAPGDHVLPVFTGECKECAHCRSAESNMCDLLRINTDRGVTIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYVKKELEVEKFITHSVPFAEINKAFDLMAKGEGIRCIIRMEN

SEQ ID NO: 19945 - protein, 305 aa, Miscanthus condensatus
IESVGEGVTDVAPGDHVLPVFTGECKECAHCRSAESNMCDLLRINTDRGVKIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMSFLNERTLKGTFFGNFKPRTDLPNVVELYMKKELEVEKFITHSVPFAEINKAFDLMAKGEGIRCIIRMEN

SEQ ID NO: 19946 - protein, 305 aa, Miscanthus condensatus
IESVGEGVTDVAPGDHVLPVFTGECKECAHCRSAESIMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNLLNERTLKGTFFGNFKPRTDLPNVVELYMKKELEVEKFITHSVPFAEINKAFDLMAKGEGIRCIIRMEN

SEQ ID NO: 19947 - protein, 305 aa, Miscanthus condensatus
IESVGEGVTDVAPGDHVLPVFTGECKECAHCRSAESNMCDLLRTNTDRGVMIGDGKSRFSINGKPIYHFVGTSTFSEYTVMHVGCVAKINPEAPLDKVCVLSWGISTGLGASINVAKPPKGSTVAIFGLGAVGLAAAEGARIAGASRIIGVDLNPSGFEEARKFGCTEFLNPKDHKKPVQEVLAEMTNGGVDRSVECTGNINAMIQAFECVHDGWGVAVLVGVPHKDAEFKTHPMNLLNERTLKGTFFGNFKPRTDLPNVVELYMKKELEVEKFITHSVPFAEINKAFDLMAKGEGIRCIIRMEN

SEQ ID NO: 19948 - protein, 305 aa, Miscanthus condensatus
IESVGEGVTDVAPGDHVLPVFTGECKECAHCRSAESNMCDLLRINTDRGVMIGDGKSRFSINGKPIYHFVGTSTFSEYTVMHVGCVAKIDPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19949 - protein, 305 aa, Miscanthus condensatus
IESVGEGVTDVAPGDHVLPVFTGECKECAHCRSAESNMCDLLRINTDRGVMIGDGKSRFSINGKPIYHFVGTSTFSEYTVMHVGCVAKIDPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPRKDAEFKTHPMNFLNERTLKGTFFGNFKPRTDLPNVVELYMKKELEVEKFITHSVPFAEINKAFDLMAKGEGIRCIIRMEN

SEQ ID NO: 19950 - protein, 305 aa, Miscanthus condensatus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19951 - protein, 305 aa, Miscanthus floridulus
IESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARTAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFELMAKGEGIRCIIRMEN

SEQ ID NO: 19952 - protein, 305 aa, Miscanthus sinensis var. formosanus
IESVGEGVTDVAPGDHVLPVSTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19953 - protein, 305 aa, Miscanthus sinensis var. formosanus
IESVGEGVTDVAPGDHVLPVFTGECKECAHCRSAESNMCDLLMINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFVCVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19954 - protein, 305 aa, Miscanthus sinensis var. formosanus
IESVGEGVTDVAPGDHVLPVFTGECKECPHCKSAESNMYDLLRINTDRGVMIGDGKSRFSINGKPIYHFVGTSTFSEYTVMHVGCVAKINPQAPLDKVCVLSCGISTGLGASINVAKPPKGSTVAIFGLGAAGLAAAEGARIAGASRIIGVDLNPSRFEEARKFGCTEFVNPKDHKKPVQEVLAEMTNGGVDRNVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19955 - protein, 305 aa, Miscanthus sinensis var. formosanus
IESVGEGVTDVAPGDHVLPVFTGECKECAHCRLAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTGFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19956 - protein, 305 aa, Miscanthus sinensis var. formosanus
IESVGEGVTDVAPGDHVLPVFTGECKECAHCRSAESNMCDLPRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRGVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19957 - protein, 305 aa, Miscanthus sinensis f. glaber
IESVGEGVTDVAPGDHVLPVFTGECKECPHCKSAESNMCDLLRINTDRGVMIGDGKSLFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNISAMIQAFECVHDGWGVAVLVGVPHKDAELKTHPMNFLNERTLKGTFFGDFKPRTDLPNVVELYMKKELEVEKFITHSVPFAEINKAFDLMAKGEGIRCIIRMEN

SEQ ID NO: 19958 - protein, 305 aa, Miscanthus sinensis f. glaber
IESVGEGVTVVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLTAAEGARIAGGSRIIGVDLNPSRFEEARKFGCTEFVNPKDHKKPVQEVLAEMTNGGVDRSVECTGNINAMVQAFECVHDGWGVAVLVGVPHKDAELKTHPMNFLNERTLKGTFFGDFKPRTDLPNVVELYMKKELEVEKFITHSVPFAEINKAFDLMAKGEGIRCIIRMEN

SEQ ID NO: 19959 - protein, 305 aa, Miscanthus sinensis f. glaber
IESVGEGVTDVAPGDHVLPVLTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRNVECTGNINAMIQAFECVHDGWGVAVLVGVPHKDAEFKTHPMNFLNERTLKGTFFGNFKPRTDLPNVVELCMKKELEVEKFITHSVPFAEISKAFDLMAKGEGIRCIIRIEN

SEQ ID NO: 19960 - protein, 305 aa, Miscanthus sinensis f. glaber
IESVGEDVTDVAPGDHVLPVFTGECKERAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSILFAEISKAFDLMAKGEGIRCIIRMEN

SEQ ID NO: 19961 - protein, 305 aa, Miscanthus sinensis var. sinensis
IESVGEGVTDVAPGDHVLPVFTGECKECPHCKSAESNMCDLLRINTDRGVMIGDGKSRFSINGKPICHFVGTSTFSEYTVMHVGCVAKINPQAPLDKVCVLSCGISTGLGASINVAKPPKGSTVAIFSLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19962 - protein, 305 aa, Miscanthus sinensis var. sinensis
IESVGEGVTGVAPGDHVLPVFTGECKECPHCKSAESNMCDLLRINTDRGVMIGDGKSRFSINGKPIYHFVGTSTFSEYTVMHVGRVAKINPQAPLDKVCVLSCGISTGLGASINAAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19963 - protein, 305 aa, Miscanthus sinensis var. sinensis
IESVGEGVTDVAPGDHVLPVFTGECKECPHCKSAESNMCDLLRINTDRGVMIGDGKSRFSINGKPICHFVGTSTFSEYTVMHVGCVAKINPQAPLDKVCVLSCGISTGLGASINVAKPPKGSTVAIFSLGAVGLAAAEGARIAGASRIIGVDLNPSRFEEARKFGCTEFLNPKDHKKPVQEVLAEMTNGGVDRSVECTGNIYAMIQAFECVYDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19964 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPLKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19965 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPLKGSTVAIFGLGAVGLAAAEGARIAGASRIIGVDLNPSRFEEARKFGCTEFANPKDHKKPVQEVLAEMTNGGVDRSVECTGNINAMIQAFECVHDGWGVAVLVGVPHKDAEFKTHPMNFLNERTLKGTFFGNFKPHTDLPNVVELYMKKELEVEKFITHSIPFAEINKAFDLMAKGEGIRCIIRMEN

SEQ ID NO: 19966 - protein, 305 aa, Miscanthus sinensis var. sinensis
IESVGEGVTDVAPGDHVLPVFTGECKECAHCRSAESNMCDLRRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLDPSRFEIARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19967 - protein, 305 aa, Miscanthus sinensis var. sinensis
IESVGEGVTDVAPGDHVLPVFTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRADLPNVVELYMKKELEVEKFITHSIPFAEINKAFDLMAKGEGIRCIIRMEN

SEQ ID NO: 19968 - protein, 305 aa, Miscanthus sinensis var. sinensis
IESVGEGVTDVAPGDHVLPVFTGECKECPHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRILGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFDNFKPRTDLPNVVELYMKKELEVEKFITHSIPFAEINKAFDLMAKGEGIRCIIRMEN

SEQ ID NO: 19969 - protein, 305 aa, Miscanthus sinensis var. sinensis
IESVGEGVTDVAPGDHVLPVFTGECKECPHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRILGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19970 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNISAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19971 - protein, 305 aa, Miscanthus sinensis var. sinensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMDFLNERALKGTFFGNFKPRTDLPNVVELYMKKELEVEKFITHSIPFAEINKAFDLMAKGEGIRCIIRMEN

SEQ ID NO: 19972 - protein, 305 aa, Miscanthus sinensis var. sinensis
IESVGEGVTDVAPGDHVLPVFTGECKECPHCKSAESNMCDLPRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEAGKFGCTEFVNPKDHKKPVQEVLAEMTNGGVDRSVECTGNINAMIQAFERVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19973 - protein, 305 aa, Miscanthus sinensis var. sinensis
IESVGEGVTDVAPGDHVLPVFTGECKECAHCRSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRVIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19974 - protein, 305 aa, Miscanthus sinensis var. sinensis
IESVGEGVTDVAPGDHVLRVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINATIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19975 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVMELYMKKELEVEKFITHSVPFAEINKAFDLMAKGEGIRCIIRMEN

SEQ ID NO: 19976 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGALRIIGVDLNPSRFEEARKFGCTEFVNPKDHKKPVQEVLAEMTNGGVDRSVECTGNINAMIQAFECVHDGWGVAVLVGVPHKDAEFKTHPMNFLNGRTLKGTFFGNFKPRTDLPNVVELYMKKELEVEKFITHSIPFVEINKAFDLMAKGEGIRCIIRMEN

SEQ ID NO: 19977 - protein, 305 aa, Miscanthus transmorrisonensis
IESVGEGVTDVAPGDHVLPVFTGERKECPHCKSAESNMCDLLMINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19978 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19979 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASGIIGVDLNPSRFEEARKFGCTEFVNPKDHKKPVQEVLAEMTNGGVDRSVECTGNINAMIRAFECVHDGWGVAVLVGVPHKDAEFKTHPMNFLNERTLKGTFFGNFKPRTDLPNVVELYMKKELEVEKFITHSIPFAEINKAFDLMAKGDGIRCIIRMEN

SEQ ID NO: 19980 - protein, 305 aa, Miscanthus transmorrisonensis
IESVGEGVTDVAPGDHVLPVFTGECKECPHCKSAESNMCDLLRINTDRGVMIGDGKSRFPINGKPIYHFVGTSTFSEYTVTHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEISKAFDLMAKGEGIRCIIRMEN

SEQ ID NO: 19981 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRNVECTGNINAMIQAFECVHDGWGVAALVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19982 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTAAIFGLGAVGLAAAEGARIAGASRIIGADLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19983 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19984 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSRGISTGLGASINVAKPPKGSTVAIFGLGAVGLAAAEGARIAGASRIIGVDLNPSRFEEARKFGCTGFVNPKDHKKPVQEVLAEMTNGGVDRSVECTGNINAMIQAFECVHDGWGVAVLVGVPHKDAEFKTHPMNFLNERTLKGTFFGNFKPRADLPNVVELYMKKELEVEKFITHSVPFAEINKAFDLMARGEGIRCIIRMEN

SEQ ID NO: 19985 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVARINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGAPHKDAEFKTHPMNFLNERTLKGTFFGNFKPRTDLPNVVELYMKKELEVEKFITHSVPFAEINKAFDLMAKGEGIRCIIRMEN

SEQ ID NO: 19986 - protein, 305 aa, Miscanthus transmorrisonensis
IESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTGAIFGLGAVGLAAAEGARIAGASRIIGVDLNPSRFEEARKFGRTEFVNQKDHKKPVQEVLAEMTNRGVDRNVECTGNINAMIQAFECVHDGWGVAVLVGVPHKDAKFKTHPMNFLNERTLKGTFFGNFKPRTDLPNVVELYMKKELEVEKFITHSVPFAEINKAFDLMAKGEGIRCIIRMEN

SEQ ID NO: 19987 - protein, 305 aa, Miscanthus transmorrisonensis
IESVGEGVTDVAPGDHVLPVFTGECKECPHCKSAESNMCDLRRINTDRGVMIGDDKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFAEINKAFDLMAKGEGIRCIIRMEN

SEQ ID NO: 19988 - protein, 305 aa, Miscanthus transmorrisonensis
IESVGEGVTDVTPGDHVLPVFTGECKECPHCKSAESNMCDLLRVNTDRGVIIGDGKSRFSINGKPIYHFVGTSTFSEYTVMHVGCVAKINPQAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMVQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19989 - protein, 305 aa, Miscanthus transmorrisonensis
IESVGEGVTDVAPGDHVLPVFTGECKECPHCKSAESNMCDLLRFNTDRGVMIGDGKSRFSINGKPIYHFVGTSTFSEYTVMHVGCVAKINPQAPLDKVCVLSCGISTGLGASINVAKPPKGSTVAIFDLGAVGLAAAEGARIAGASRIIGVDLNPSRFEEARKFGRTEFVNQKDHKKPVQEVLAEMTNRGVDRNVECTGNINAMIQAFECVHDGWGVAVLVGVPHKDAEFKTHPMNFLNERTLKGTFFGNFKPRTDLPNVVELYMKKELEVEKFITHSIPFAEINKAFDLMAKGEGIRCIIRMEN

SEQ ID NO: 19990 - protein, 305 aa, Miscanthus transmorrisonensis
IESVGEGVTDVAPGDHVLPVFTGECKECPHCKSAESNMCDLLRINTDRGVMIGDGKSRFSINGRPIYHFVGTSTFSEYTVMQVGCVAKINPQAPLDKVCVLSCGISTGLGASINVAKPPKGSTVAIFGLGAVGLAAAEGARIAGASRIIGVDLNPSRFEEARKFGCTEFVNPKDHKKPVQEVLAEMTNGGVDRSVECTGNINAMIQAFECVHDGWGVAVLVGVPHKDAESKTHPMNFLNERTLKGTFFGNFKPRTGLPNVVELYMKKELEVEKFVTHSVPFAEINKAFDLMAEGEGIRCIIRMEN

SEQ ID NO: 19991 - protein, 500 aa, Atriplex triangularis
MAFPMPVRQLFIDGERREPLLKNRIPIINPSTEEIIGDIPAATAEDVEVAVVAARKAFKRNKGRDWAATSGAHRAKHLRAIAAKITERKDHFVKLETLDSGKPFDEAVLDIDDVASCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDIDKIAFTGSSATGSKIMASAAQLVKPVTLELGGKSPVIMFEDIDIETAVEWTLFGVFWTNGQICSATSRLLLHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 19992 - protein, 466 aa, Chloranthus nervosus
SVGFKAGVKEYKLNYYTPEYETKDTDILAAFRLTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERGITLGFVDLLRDDFIEKDRSRGLYFTQDWVSLPGVLPVASGGIHVWHMPALTEIFGDDSVLQFGGGTLGHPWGNAPGAVANRVALEACVQARNEGRDLAREGNEVIREASKWSPELAAACEVWKEIKFEFEAMDTV

SEQ ID NO: 19993 - protein, 462 aa, Hedyosmum sprucei
KAGVKEYKLTYYTPEYDTKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALFKAQVETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHAGTVVGKLEGERGITLGFVDLLRDDYIEKDRSRGLYFTQDWVSLPGVLPVASGGIHVWHMPALTEIFGDDSVLQFGGGTLGHPWGNAPGAVANRVALEACVQARNEGRDLAREGNEVIREASKWSPELAAACEVWKEIKFEFEAMDTV

SEQ ID NO: 19994 - protein, 242 aa, Fagus sylvatica
STFAAAPLVPIIRDNLNLTKADIGNAGVASVSGSIFSRLAMGAICDLLGPRYGCAFLIMLSAPTVFCMSFVSNAGGYIAVRFMIGFSLATFVSCQYWMSTTFNSKIIGLVNGTAAGWSNMGGGATQLLMPLLYDLIQRAGATPFTAWRIAFFIPGWLHVIMGILVLILGQDLPDGNLSTLQKKGDVAVDKFSRVLWYAVTNYRTWIFVLLYGYSMGVELSIDNVIAEYFYDRFNLKLHTAGL

SEQ ID NO: 19995 - protein, 394 aa, Wigglesworthia glossinidia endosymbiont of Glossina brevipalpis
MKIIKVTDLNLKDKKVLIRSDLNVPIKNGKIMCNMRIIKSLETINFVIKNEAKCVIVASHLGNPIEEKYDYNFSLTHIVNHMKKIIKYPIRLIQNYLNGFEAKEKEIIVLENVRFNPGERKNDKNLSKKYANLCDILVMDSFGSSHRSESSTTGIIKFAPISCIGLLFLKEIKYLKKALFNSKRPIVTIFGGSKISTKLGVIEKLSNISENVLVGGGIANTILFSKGHNIGKSLHDKNNISKIKKFLYKKNIIIPKDFIVTDNINKFSSYKEKSIKEIKNEDYIVDIGKKSCECFIKIIKKAKTIFWNGPLGLIEIKQFRNGTKEIANSVIHSSAKSIIGGGETVLAMRMFNFIDRFSYISTGGGAFLSFIEKQELPVLSELKKFKKYTNFKQN

SEQ ID NO: 19996 - protein, 387 aa, Vibrio cholerae
MSVIKMIDLDLAGKRVFIRADLNVPVKDGKVTSDARILASLPTIKHCLEAGAKVMVTSHLGRPTEGEYAEEFSLLPVVNYLNDALDCEVRLVKDYLDGVELNAGELVVLENVRFNKGEKKNEEALSKKYAALCDVFVMDAFGTAHRAQASTHGVGMFAPIACAGPLLADELEALGKAMDKPARPMVAIVGGSKVSTKLTVLESLSKIADQLVVGGGIANTFIAAAGHNVGKSLYEADLVETAKKLMEECAIPVATDVACAKAFDENAEAEIKHVSEVQDDDMIFDLGPNSTAELAEILKNAKTILWNGPVGVFEFKNFEAGTRGIAEAIAQSEGFSVAGGGDTLAAIDKFGIKADVSYISTGGGAFLEFVEGKKLPAVEMLEARAKA

SEQ ID NO: 19997 - protein, 385 aa, Geobacillus stearothermophilus
MSALFPTYNRWNIAVQSAEGTVVTDVNGKQYLDFVSGIAVCNLGHRHPHVQKSIEQQLNQYWHVSNLFTIPIQEEVASLLVAHSAGDYVFFCNSGAEANEAALKLARKHTGRHKVITFRQSFHGRTFATMAATGQEKVHSGFGPLLPEFIHLPLNDVDALKQAMSEEVAAVMLEVVQGEGGVRPVDPAFLQTASELCQQHGALLIIDEVQTGIGRTGKPFAYQHFDVEPDIITAAKGLGSGIPVGAMIGKAFLKESFGPGVHGSTFGGNPIAMAAAKATLEVVFDPAFLQDVQEKGRYFLARLHDALASLDIVKDVRGLGLLVGIECQTDVAPLLPLIHENGLLVLSAGPNVIRLLPLVVTKAEIDEAVDILTNVLNNANASAVL

SEQ ID NO: 19998 - protein, 1338 aa, Kluyveromyces lactis
MSFLKKKSSTAGHSRSGSASSILNKHVDPANISEFYPSSLDHKVTSGLKNDYSFDSSSKGSRKSSGGSTNSLTSERLLFNWDVTDPSQWTMPRIIQWFRANDFNDQWITFFKRNSISGNKFLKLLAYDNFAPYEKSLQQSKSSSYERFQYLLKKTLEENVVKGNNRNGNRIINNSRSSSESAKVSQRLSTSFSTHIRSTSESALLNIENITKDSSSSEPTTSKKQEASNYSLPLRQAKTNSASALYRRSLISLRNASSTKDNASKNDIKITIPPRPLSTTENTNKSPTTPSSVSPSHTAYTGIFRRQHKTSSSESSLFTSIFGHGVVEEPEETPKPRPVENRRIPAASTVNASTSKQSINVDDKARLWDKIKRKGQLPAEPSSQPAARIIIEEVKESPKAEPPEIVIPEEIYPKRPSDSRELFIMLTKDNSTFSPFNVQPHLGTDVSELKKAVALALGLTHSNFSIHLTDFGAEFGSQIPDGLLADFQKTSFQNIPNKLYIQDLEKKANLNPRPRTETLASQHSTAASTKSKTSVKSNASAASNGEGSSSDLTSIDDQGSSHRRAYPQTPSHYYDNSTSAETDYWSFKDSVPETISDAPHITLPKSRPSLKLNSSVLNTHASEKSTFRIIRQTSDTDIDFNKRRESPYVRVAELAPKRKAPKPPVNGNPVTSGSLPSAAAKNVSESPLESPPKLDRNGKTIYQKNKPRPPPPLTTERSSRRSVSSLSGQDLNEVKESPVQSFTPASTQVMVPQPYKGALETLKPRKSSADLSIRPRMSLRQFSRSNSSLNRKVLSTSRQTLNRTNSKPLVTSSTAADIFDENDISFADAPELSDSDDYSASSDEIIWSRDRKSISNDVPEFSFNTEDTIDLVGTDTTQVSVGATEGSDTPKKMALRPSPDVVYQNLEKFFPDADLDNPILEGLTPPPSPNADSSPPSPRGFEKSLKTKSEQQPAFLSSRGESSQFLTPVKSLKPPKRTKTIRIIAQEASEARKNEVSQKLQRKNTKMWGTKVVEITDKRTISINKSRNSRGEYKEFAWIKGEIIGKGSFGAVYLALNVTTGEMLAVKQVTVPEFSSQDESAISMVEALKSEVSTLKDLNHVNIVQYLGFEEKNGIYSLFLEYVAGGSVGSLIRMYGRFDDQLIRHLTKQVLEGLAYLHSKGILHRDMKADNLLLDNDGVCKISDFGISRKSNNIYSNSDMTMRGTVFWMAPEMVDTAHGYSAKVDIWSLGCVVLEMFAGKRPWSNFEVVAAMFQIGKSKTAPPIPDDTKDLVSPAGQSFLDQCFEIDPEMRPTADSLVGHPFCKTSSSFDFPKTKLAQFIKSNDKLNSSRLRISSQEL

SEQ ID NO: 19999 - protein, 154 aa, Cicer arietinum
VKGLTMCYAVILVTFYSAAVSGYWVFGNKSNSNILKSLLPDSGPTLAPTWVLGLAVIFVLLQLFAIGLVYSQVAYEVMEKKSADVKQGMFSKRNLIPRLILRTIYMIFCGFLAAMLPFFGDINGVVGAVGFIPLDFVLPNDSYTTKHTSLQNHP

SEQ ID NO: 20000 - protein, 252 aa, Picea abies
MPFRGVAIGRPEEVTHPTAFKAALAELISTLIFVFAGEGSGMAFAKLTSDASTTPAGLVAVALAHGLGLFVAVAVGANISGGHVNPAVTFGALVGGHITLLRGILYWIAQLLGAIVACLLLKFTTGGLSTPIHSVASGMNTGEGVVMEIVITFALIYTVYATAADPKKGDLGTIAPIAIGFIVGANILAAGPFSGGSMNPARSFDPAVVSGDFTDNWVYWVGPLIGGGLAGIVYRGIFIGDDLHVPLPVSDF

SEQ ID NO: 20001 - protein, 347 aa, Anthurium andraeanum
MMHKGTVCVTGAAGFVGSWLIMRLLEQGYSVKATVRDPSNMKKVKHLLDLPGAANRLTLWKADLVDEGSFDEPIQGCTGVFHVATPMDFESKDPESEMIKPTIEGMLNVLRSCARASSTVRRVVFTSSAGTVSIHEGRRHLYDETSWSDVDFCRAKKMTGWMYFVSKTLAEKAAWDFAEKNNIDFISIIPTLVNGPFVMPTMPPSMLSALALITRNEPHYSILNPVQFVHLDDLCNAHIFLFECPDAKGRYICSSHDVTIAGLAQILRQRYPEFDVPTEFGEMEVFDIISYSSKKLTDLGFEFKYSLEDMFDGAIQSCREKGLLPPATKEPSYATEQLIATGQDNGH

SEQ ID NO: 20002 - protein, 363 aa, Anthurium andraeanum
MATEVMTAVPAGSRVESLASSGIQAIPPEYVRPAEERVSLTDALEAARRAEDGPQIPTVDVAGFSSGDEAARRACAEAVRRAATDWGVMHVVNHGIPLELIRRMQAAGEAFFALPIEEKEKYANDQSSGNIQGYGSKLANNASGQLEWQDYFFHLIFPEDKANFSIWPKQPANYVEETREFGRQLRVVASKMLAMLSLGLGVEEGKLEAEVGGMEDLLLQMKINYYPRCPQPELAVGVEAHTDVSALSFILHNMVPGLQVHNEGQWVTARCVPDSIIMHVGDVVEILSNGQYKSILHRGLVNKEKVRVSWAVFCEPPRDKILLQPLPDILGQGHPAQFPPRTFSQHIQHKLFRKTQGDFATPN

SEQ ID NO: 20003 - protein, 231 aa, Shigella flexneri
MFRKLAAECFGTFWLVFGGCGSAVLAAGFPELGIGFAGVALAIGLTVLTMAFAVGHISGGHFNPAVTIGLWAGGRFPAKEVVGYVIAQVVGGIVAAALVYLIASGKTGFDAAASGFASNGYGEHSPGGYSMLSALVVELVLSAGFLLVIHGATDKFAPAGFAPIAIGLALTLIHLMSIPVTNTSVNPARSTAVAIFQGGWALEQLWFFWVVPIVGGIIGGLIYRTLVEKRD

SEQ ID NO: 20004 - protein, 348 aa, Actinobacillus pleuropneumoniae
MNNDFLVLKNITKSFGKATVIDNLDLVIKRGTMVTLLGPSGCGKTTVLRLVAGLENPTSGQIFIDGEDVTKSSIQNRDICIVFQSYALFPHMSIGDNVGYGLRMQGVSNEERKQRVKEALELVDLAGFADRFVDQISGGQQQRVALARALVLKPKVLILDEPLSNLDANLRRSMREKIRELQQRLGITSLYVTHDQTEAFAVSDEVIVMNKGTIMQKARQKIFIYDRILYSLRNFMGESTICDGNLNQGTVSIGDYRFPLHNAADFSVADGACLVGVRPEAIRLTATGETSQRCQIKSAVYMGNHWEIVANWNGKDVLINANPDQFDPDATKAFIHFTEQGIFLLNKE

SEQ ID NO: 20005 - protein, 380 aa, Sclerotinia sclerotiorum
MVHILSSALSLLRLGAAVSAAPAPAPTAAPNVADALAAVEKRAGSCTFSDPAVPLPAIKSKASCATIVISAVAVPSGTTLDLTGLKSGTHVVFEGTTTFGYEEWSGPLVSVSGTDITVTGASGSVLDGNGAKYWDGKGTNGGKTKPKFFYAHSLKGKSSINNVKILNSPVQVFSINSASGLTLSGITIDNSAGNSLGHNTDAFDVGSSTDITISGANVQNQDDCLAINSGTGITFTGGTCSGGHGLSIGSVGGRSDNVVSDVIIESSTVKNSANGVRIKTVLGATGSVSGVTYKDITLSGITSYGVVIEQDYENGSPTGKPTSGVPITGVTLSNVHGTVSSSATNVYVLCAKCSGWTWDVNVTGGKTSTKCAGLPSGVKC

SEQ ID NO: 20006 - protein, 421 aa, Medicago sativa
MKFSTAIIVSFLFIADFCAAQSGVLDISKFGGKPNSDIGQALTSAWNEACASTTAAKIVIPAGTYQLNGIELKGPCKAPIELQVDGTIQAPADPSVIKGTEQWFKFLYMDHLTLSGKGVFDGQGATVYKKAAPASAWSGKNSNSKVFMNFGFNFVNNSIVRGVTSKDSKNFHVMVFGCKNITFDGFTITAPGDSPNTDGIHMGKSTDVKILNTNIGTGDDCVSIGDGSKQITVQGVNCGPGHGLSVGSLGKFTTEENVEGITVKNCTLTATDNGVRIKTWPDAPGTITVSDIHFEDITMTNVKNPVIIDQEYYPWNQCSKKNPSKIKLSKISFKNVKGTSGTAEGVVLICSSAVPCDGVELNNVDLKFNGAPTTAKCTNVKPLVTGTAPVCQAPGAPAASTTATPAASKTATPAAGKSPAK

SEQ ID NO: 20007 - protein, 436 aa, Nitrosomonas europaea ATCC 19718
MNDKKSAMRSHRVVWHPCTQMKHHEEFPPVLITRGEGVWLYDADGQRYLDTISSWWVNLFGHCNPRINAAIIDQLGRLEHTMLAGLTHEPVVELSERLSTITPGSLSHCFYASDGASANEIALKMSFHYWQQSGFPEKTQFINLQNGYHGETLGALSVTDVPIFRQVYAPLLRPAHPVLTPDWRFAEAGETPEAHALKAAAALESYLTQHHASTAALILEPLVQGAAGMGMYHPVYLQKAREICDTYRIHLITDEIAVGFGRTGTLFACEQAAITPDIMCLAKGLSGGYLPLSVVLTNDTIYRAFYSDQTSQAFLHSHSHSGNALACRAALATLDIIEQDNVIETNRHKTKFLNQCLQSVRTHPNVRHFRNCGMIWAFEVDNPRPDFTNRFAQMGLERQLLIRPMGNSVYIMPPYIINEEEMEFMAQAILNILNEI

SEQ ID NO: 20008 - protein, 129 aa, Nitrosomonas europaea ATCC 19718
MTDKWLDTINWSADGLIPAIAQDKNNGKILMVAWMNREALKRTVESGEAVYWSRSRKKLWHKGEESGHTQKISAIHLDCDEDILLLSVEQKGGIACHTGRQSCFFRQLKNGEWVVTEPVIKDPSQIYTK

SEQ ID NO: 20009 - protein, 371 aa, Nitrosomonas europaea ATCC 19718
MRRIRAAVVYQKGGPFQIEDLRLEAPRTDEVLVRIVATGMCHTDMVARDQLYDVPLPVVLGHEGSGIVEQIGDGVRKVAVGNHVVLTYMWCGHCKPCLRGDLTYCEHFYALNFGGVREDGSTSTCLANDTRRPIHDHFFGQSSFGTFALVHERNVIKVPETAPLELLGPLGCGIQTGAGAVINTLKVSPGSSFVAFGGGAVGLSAVMAAHAAGATTIISVDVVPSRLALAMELGATHTINSRETDPVEAVHKIINGGADFTLESSGRPAVLRQAIDALAIRGTCGIVGAPALGTEASFDVNGVMTTGKRIIGIVEGDSKPDLFIPALVELYQQGKFPFDRLVKFYSLDQINQAAEDSEKGITIKPIIRLQS

SEQ ID NO: 20010 - protein, 349 aa, Nitrosomonas europaea ATCC 19718
MTIKAYGARAGDLPLEPMNITRRTPSAHDVQIDITHCGVCHSDLHQVRSEWAGTLYPCVPGHEIVGRITAVGAQVSGYKPGDLVGVGCIVDSCQHCADCNDGLENYCDHMVLTYNGPTSDAPGHTLGGYSQQIVVHERYVLRIRHSEAQLAAVAPLLCAGITTWSPLRHWKVGPGQKVGVVGIGGLGHMGIKLAHAMGAYVVAFTTSESKREAARALGAHETVVSRNPDEMARHVGSLDFILNTVAASHDLDAFFALLKRDGTMALVGAPATPHPSPNVFNLIMKRRSLAGSLIGGISETQEMLDFCAKHNIVADVEMIRIDEINEAYERMLKGDVKYRFVIDCASLTA

SEQ ID NO: 20011 - protein, 368 aa, Nitrosomonas europaea ATCC 19718
MKTRAAVAWQAGQPLTIEEVDLAGPRTGEVLVEIKATGICHTDYYTLSGADPEGLFPAILGHEGAGIVVEVGADVKSLRPGDHVIPLYTPECRECKFCLSRKTNLCQAIRATQGRGLMPDGTSRFSLDGKAIMHYMGTSTFSNYIVVPEIALAKIREDAPFDKACYIGCGVTTGIGAVLFTAKVEVGANVAVFGLGGIGLNVIQGARMAGADKIIGIDLNPEREALGRQFGMTHFIDPSQVENVVDAVIQLTDGGADYSFECIGNTTVMRQALECTHKGWGRSIIIGVAKAGAEISTRPFQLVTGRKWEGSAFGGARGRSDVPRIVDWYMDGKISIDPLITHILKLEEINEGFKLMEAGESIRSVVVF

SEQ ID NO: 20012 - protein, 224 aa, Nitrosomonas europaea ATCC 19718
MSKIIIACRDLYKSYFQGNLEVPVLHGIDLQVNEGEMVAIVGASGSGKSTLLHVLGGLDKPTRGEVTLLDRELSTISEAERGSLRNHALGFVYQFHHLLPEFSAQENVAMPLFIRRMNKKAAMEQAAAMLQRVGLGHRLTHTPGELSGGERQRAAVARALVTRPACVLADEPTGNLDRHTAEAVFDLMLELNHEANAGLVIVTHDTQLASRADRVLHLVDGMLQ

SEQ ID NO: 20013 - protein, 158 aa, Nitrosomonas europaea ATCC 19718
MNIYDCGIKTMDGQDKLLGDYKGKVLLIVNTASKCGFTPQYQGLEDLYRRYKDRGFVVLAFPCNQFGHQEPGSESEIQQFCTTRYDVSFPVFAKIEVNGANTHPLYRYLKNEKSGVLGTKAIKWNFTKFLVDRSGHVVRRYAPADKPESLTGDIEQLL

SEQ ID NO: 20014 - protein, 187 aa, Nitrosomonas europaea ATCC 19718
MIDRNGYRANVGIILLNSQNQVFWGKRARQDSWQFPQGGIKSGETPTEAMYRELAEETGLQPVHVEILGRTREWLRYDVPACWTRRDWRKNYRGQKQIWFLLRLLGRDSDVSLETCAHPEFDAWRWNQYWVELESVVEFKRQVYRQALTELSRLLDHEAGLGNDRAYREPLEPVEKNRKKSSDTRQS

SEQ ID NO: 20015 - protein, 224 aa, Nitrosomonas europaea ATCC 19718
MSLTPVLELSNVSKTYSSRQVLSGLSYSFAAGEYVAIMGDSGVGKSTLLNLIAGLDSPDSGEIRIDGKILPVEDEAATNLRRRHLGFIFQAFHILPHLTLLQNVSLPLLLNRLPLDRAPVMLTAVGLQGREQDFPHQLSGGELQRVAIARALVHRPRLILADEPTGNLDQDTAHEVLQLIRTEIKANQASAIIVTHSRLAAETADKILMLSKHGLTPVPLENQT

SEQ ID NO: 20016 - protein, 384 aa, Nitrosomonas europaea ATCC 19718
MNQPSVVVVGSGLAGYTVVRELRKLDAAVPITLLSADHGSFYSKPMLSNALATGKTPDSILSAGTMQMSGQLDITVRPYTSVNAIDVAAGSVSFEEGGQLTYDRLVLALGADPIRLPIPGEGVDEILSVNNLDDYRKFREALESKRHIAILGAGLIGCEFANDLAAKGYQVSVFDLSPQPLGRLLPPEAGRFFRDKLTAAGVNFLLGTTVERVSKENGYYQLFYEGGKVVQADMILSAVGLRPRTRLAAVAGIQVNRGIAVNRYLQTSIQNIYALGDCAEVEGKVLPFILPIAHAGRALAATIAGNPTLLHYPAMPVMVKTPACPTVVSPPDPAVQGEWEVVAIENGMKALYHDEAGNLHGFALLGTATVERNTLASRLPPVLA

SEQ ID NO: 20017 - protein, 393 aa, Nitrosomonas europaea ATCC 19718
MSHVMNTYARLPVTFVKGEGVWLWDDQGNRYLDALSGIAVCGVGHCHPVLVKALCEQVSTLIHTSNVYHIQHQERLADRLTSLSGLEKAFFCNSGAEANEAAIKLARLYGHNQGINLPTIIVMERSFHGRTMATLTATGNRKTQAGFEPLLTGFVRVPYDDLEAVNKVAANNREIVAILLETYQGEGGVNFPQANYLQGLRRICDQNGWLLMLDEVQCGLGRTGKWFAFQHSEVMPDAMTLAKGLGSGVPIGACLAGGKAAEVFKPGNHASTFGGNPLACRAALTTLDIIEQEGLMDNAVTIGNFMWEEFGRRLQAWQDVLKIRGQGMMIGIELPVPCSELVPEALKRRVLVNVTSEKVVRLLPALNMQKAEAEQVVTEVSALITWFLESRVK

SEQ ID NO: 20018 - protein, 422 aa, Nitrosomonas europaea ATCC 19718
MKRETLAIHGGFAGDPQTHAVAVPIYQTTSYYFDDTQHGADLFDLKVQGNIYTRIMNPTTAVLEERVALLEGGVGALAMASGMAAITACVQTLARAGDNIISTSQVYGGTYNFFCHTLPNLGIEVRMVDGRNPAAFADAIDDNTRMIYCESIGNPAGNVVDIAALAEVAHAAGVPLVVDNTVPTPVLCRPFEHGADIVVHALTKYMGGHGTSIGGIIVDSGKFPWEGNSRFPQFNQPDPSYHGVVYVDAFGPAAFIGRARVVPLRNMGAAISPFNSFLILQGIETLPLRMERHCTNALAIARYLQRHPKVSWVNFAGLEDNRDYALVQKYMDGGIPSSILSFGIKGGREACARFMDRLMLIKRLVNIGDAKTLACHPATTTHRQLNDEELAKAGVSADLVRLCVGIEHIDDLIADVEQAFQD

SEQ ID NO: 20019 - protein, 252 aa, Nitrosomonas europaea ATCC 19718
MGRAGFVAGNWKMHGSLVRNQELLDAVVSGTRSLQNVSCVVCVPYPYIAQTQSVLEGSHVLWGGQNVSQYHHGAYTGEVSADMLADLGCRYVIVGHSERRTLFGEGNQVVAEKFRAAQERSITPILCVGETLAQRESDETEQVIAMQLDAVIDLAGIEALGQSVIAYEPVWAIGTGKTATPQQAQDVHKFIRSRIAVHSGGIAENIQILYGGSVKADNARELFTMPDIDGGLIGGASLVAAEFISICLAAQN

SEQ ID NO: 20020 - protein, 256 aa, Nitrosomonas europaea ATCC 19718
MPICLTRLLATAFHRLSAAHTTAGCSPSPTILKEANIRIILLGAPGAGKGTQASFIRECFSIPQISTGDILRNAVKAGTELGMMAKKIMESGGLVPDEIIIDLVRKRIEEPDCANGFLFDGFPRTIPQADALRTANVHIDHVIEIDVPDAEIIKRLSGRRVHPPSGRIYHIEFNPPAVADRDDVTGEALVLREDDREETVRKRLQVYHEQTRPLVGYYFEWANSGDPNAPGYIKIAGTGNVEAIQENIIAALKQTK

SEQ ID NO: 20021 - protein, 502 aa, Nitrosomonas europaea ATCC 19718
MPDDPAENCHFPSDQTNTYMKHTLIPVILSGGSGTRLWPLSRQQYPKQLLPLVNRYSLLQETVRRLDGLEDIAVQSSIIVSNEEYRFVIAEQLRVLGKIGKIILEPYGRNTAPALTIAALAAMQDSDDPVLLVMPSDHVITDISVFQAIIHKGMTLAESGMLVTFGITPNAPETGYGYIQYGTALHEPGTFRIARFVEKPDLATAQNYLEEGSYLWNSGMFMMRASIWLTAIDTCRRDILEACRAAWQSGSIDGDFYRIDKTAFAACPSDSIDYAVMETLSARPDMLPPGAIIPLSAGWSDIGAWDALWRTLQKDESGNVVRGDVLLHACHDTLAFSEHRLVACIGVENVVIVETSDAVLVAHQDKTQEVKHIVDILKQRNRPEIRSHRKIYRPWGWYDSVDRGERFQVKRIVVNPGAALSLQMHHHRAEHWIVVRGTAQVTRADKTFLVSENESTFIPLGTPHRLENPGRVPLEMIEVQSGSYLGEDDIVRFEDKYGRKEN

SEQ ID NO: 20022 - protein, 354 aa, Nitrosomonas europaea ATCC 19718
MLFNPLQVGSLTLPNRILLAPLTRARADAGHMPNALMAEYYSQRATGGLLISECTMVAPGTSAFVNEPGIYNDAQIAAWRQVTDAVHAKGGRIFMQIWHAGRAAYPGAADGAPIVSSSATAIEGEIHTPQGKVPHAVPRPLTVDEIPGIVAAFAQGARNAIAAGFDGVEVHGANGYLIDQFLRDTPNQRTDAYGGSLENRARLLFEVLTAVTQAIGSERVGLRLSPLNSFNSMKDSDPLALIGFLADRLNAFKLAYLHVMRADFFGVQKADVMPVAREKYKGVLVGNMGYSADEAEAAIAEGRLDAVAFGTAFLANPDLPARIRAKAPLNAPDSNTFYAGGAKGYTDYPTLQLA

SEQ ID NO: 20023 - protein, 282 aa, Cucumis sativus
MEFPIINLEKLNGEERSSILAKIKDACENWGFFEVLNHGIDTEFLDKVEKLTKEHYKKCMEERFKEHIASKGLNDVVTEVNDVDWESTFFLRHLPVSNIADLPELSDDYKSVMKQFASKLQVLAELLLDLLCENLNLPKSYLKNAFHGSNGPTFGTKVSNYPPCPNPDLIKGLRAHTDAGGIILLFQDDKVSGLQLLKEGEWVDVPPVRHSIVVNIGDQLEVITNGKYKSVLHRVIAHPEGEGRMSLASFYNPGSDAVIFPAPSLVAEEKNEYTQNLYLRII

SEQ ID NO: 20024 - protein, 317 aa, Cucumis sativus
MAVFPIINLENINGDGRAKILEQIEDACQNWGFFELVNHGIPHEFLDMVEKMTRDHDKKCMEERFKETVLSKGLEAAQAEVNDMDWESTFFLRHLPESNISQMSDLDEEYKKIMKEFAKKLENLAEELLDLLCENLGLEKGYLKNAFYGSKGPTFGTKVSKYPPCPKPDLIKGLRAHTDAGGIILLFQDDKVGGLQLLKDGDWIDVPPMRHAIVVNLGDQLEVITNGRYKSVMHRVLITQNSGTGRMSIASFYNPGSDAVIYPAPALVEKDEEKKEVYPKFVFEDYMKLYLGVKFQAKEPRFEAMKANANLGPMATA

SEQ ID NO: 20025 - protein, 138 aa, Ipomoea cordatotriloba
HAAELTAGFYNVAGRDGYRPIARMLARHHATLNFTCLEMRDSEQPAEAKSAPQELVQQVLSSGWKEYIDVAGENALPRYDATAYNQMLLNVRPNGVNLNGPPKLKMFGLTYLRLSDDLLQTDNFELFKKFVKKMHADL

SEQ ID NO: 20026 - protein, 475 aa, Adiantum capillus-veneris
MSPQTETKAGVGFKAGVKDYRLTYYTPEYKTKDTDILAAFRMTPQPGVPAEEAGAAVAAESSTGTWTTVWTDGLTSLDRYKGRCYDIEPVAGEENQYIAYVAYPLDLFEEGSVTNMLTSIVGNVFGFKALRALRLEDLRIPPAYSKTFLGPPHGIQVERDKLNKYGRPLLGCTIKPKLGLSAKNYGRAVYECLRGGLDFTKDDENVNSQPFMRWRDRFLFVAEALFKSQAETGEIKGHYLNATAGTCEEMMKRAVFARELGAPIVMHDYLTGGFTANTSLAFYCRDNGLLLHIHRAMHAVIDRQKNHGIHFRVLAKALRMSGGDHIHAGTVVGKLEGEREVTLGFVDLLRDDYIEKDRSRGIYFTQDWVSMPGVFPVASGGIHVWHMPALTEIFGDDSVLQFGGGTLGHPWGNAPGAVANRVALEACVQARNEGRDLAREGNEIIREASKWSPELAAACEIWKAIKFEFETIDTL

SEQ ID NO: 20027 - protein, 111 aa, Ipomoea ramosissima
HHATLNFTCLEMRDSEQPAEAKSAPQELVQQLLSGGWKEYIDVAGENALPRYDATAYSQMLLNVRPDGVNLNGPPKLKMSGLTYLRLSDDLLQTDNFQLFKKFVKKMHADL

SEQ ID NO: 20028 - protein, 138 aa, Ipomoea littoralis
HAAELTAGFYNVPKRDGYRPIARMLARHHATLNFTCLEMRDSEQPAEAKSAPQELVQQVLSSGWKEYIDVAGENALPRYDATAYNQMLLNVRPNGVNLNGPPKLKMSGLTYLRLSDDLLQTDNFQLFKKFVKKMHADL

SEQ ID NO: 20029 - protein, 138 aa, Ipomoea nil
HAAELTAGFYNVAGRDGYRPIARMLARHHATLNFTCLEMRDSEQPAEAKSAPQELVREVLSSGWKEYIDVAGENALPRYDATAYNQMLLNVRPNGVNLNGPPKLKMSGLTYLRLSDDLLQTDNFELFKKFVKKMHADL

SEQ ID NO: 20030 - protein, 138 aa, Ipomoea setosa
HAAELTAGFYNVPGRGGYRPIARMLARHHATLNFTCLEMRDSEQPAEAKSAPQELVQQVLSSGWKEYIDVAGENALPRYDATAYNQMLLNVRPNGVNLNGPPKPKMSGLSYLRLSDDLLQTENFGLFKKFVKKMHADL

SEQ ID NO: 20031 - protein, 138 aa, Ipomoea tabascana
HAAELTAGFYNVAGRDGYRPIARMLARHHATLNFTCLEMRDSEQPAEAKSAPQELVQQVLSSGWKEYIDVAGENALPRYDATAYDQMLLNVRPNGVNLNGPPKLKMSGLTYLRLSDDLLQTDNFQLFKKFVKKMHADL

SEQ ID NO: 20032 - protein, 138 aa, Ipomoea umbraticola
HAAELTAGFYNVAGRDGYRPIARMLARHHATLNFTCLEMRDSEQPAEAKSAPQELVQQVLSGGWKEYIDVAGENALPRYDATAYNQMLLNVRPNGVNLNGPPKLKMSGLTYLRLSDDLLQTDNFQLFKKFVKKMHADL

SEQ ID NO: 20033 - protein, 138 aa, Ipomoea leucantha
HAAELTAGFYNVAGRDGYRPIARMLARHHATLNFTCLEMRDSEQPAEAKSAPQELVQQVLSSGWKEYIDVAGENALPRYDATAYNQMLLNVRPNGVNLNGPPKLKMSGLTYLRLSDDLLQTDNFELFKKFVKKMHADL

SEQ ID NO: 20034 - protein, 155 aa, Helicobacter pylori
MLHKKYRPNVAAIIMSPDYPNTCEIFIAERIDIEGAWQFPQGGIDEGETPLEALHRELLEEIGTNEIEILAQYPRWIAYDFPSNMEHKFYAFDGQKQRYFLVRLKHANNIDLNKHTPEFRAYQFIHLKDLLKKIVPFKCQVYRQVIAYFKREGYL

SEQ ID NO: 20035 - protein, 155 aa, Helicobacter pylori
MLHKKYRPNVAAIIMSPDYPNACEVFIAERIDIEGAWQFPQGGIDEGETPLEALYRELLEEIGTNEIEILAQYPRWIAYDFPSNMEHKFYSFDGQKQRYFLVRLKHANNIDLNKHTPEFRAYQFIHLKDLLKKIVPFKRQVYRQVIAYFKREGYL

SEQ ID NO: 20036 - protein, 155 aa, Helicobacter pylori
MLHKKYRPNVAAIIMSPDYPNTCEVFIAERIDIEGAWQFPQGGIDEGETPLEALHRELLEEIGTNEIEILAQYPRWIAYDFPSNMEHKFYAFDGQKQRYFLVRLKHANNIDLNKHTPEFRAYQFIHLKDLLKKIVPFKRQVYRQVIAYFKREGYL

SEQ ID NO: 20037 - protein, 155 aa, Helicobacter pylori
MLHKKYRPNVAAIIMSPDYPNTCEIFIAERIDIEGAWQFPQGGIDEGETPLEALHRELLEEIGTNEIEILAQYPRWIAYDFPSNMEHKFYSFDGQKQRYFLVRLKHANNIDLNKHTPEFRAYQFIHLKDLLKKIVPFKRQVYRQVIAYFKREGYL

SEQ ID NO: 20038 - protein, 338 aa, Streptomyces hygroscopicus subsp. yingchengensis
MVEVVLPGKVEPEGLQVRQGPVPAAGPGQVVVRMEATGVSFAEQQMRRGRYYDQPPFPFVPGYDLVGTVIETGDGVAPGLAGTRVAALLKVGGWATHVVVDAADVVPVPDGISAAQAETVVINGITAWQMLHRKARVRAGQTVLVHGANGGVGSVLVQLAHAAGVQVIGTASARHHAALREAGVMPIDYRTENIPARVREHAPGGVDAVFDHVGGRSVVDSWQLLAPGGTLVSYGSASTRDDEGSKQWPVLKLLARVWLWNALPNRRRAYFFNVWAGRALTPSRFRARLRNDLTEVFTALHRGDITPAIAAQLRLDRVAEALRLAESGTVSGKVVLVP

SEQ ID NO: 20039 - protein, 453 aa, Streptomyces hygroscopicus subsp. yingchengensis
MSQPIDSVTAGHTPEETSAGPDTSAWSFETKQIHAGAAPDPTTGARATPIYQTTSFVFRDTQHAADLFSLAEPGNIYTRLHNPTQDVFEQRIAALEGGVAAVALSSGQAAETLAILTLASAGDHIVSSTSLYGGTYNLFRHTLPKLGIEVSFVDDPDDVEAWRAAVRPNTKALFAETLGNPRGNVLDVRAVADVAHAAGVPLIVDNTVPTPYLLRPIEHGADIVVHSATKFLGGHGTAIAGVVVDGGTFDFGAHADRFPDFTEPDPSYHGLRYWPALGPGAFAVKLRVQLLRDLGPALSPHSAFLLLQGVETLSLRIERHSANAQALAEWLEQRDEVAVVHYPGLPSSRWYEAGQRYLPRGAGAIVSFELRDGVEAGKRFVDAVELFSHLANIGDVRSLIIHPASTTHSQLDEEQLAATGTSPGLVRLSVGIENLADLKADLEAGFRAAKDAS

SEQ ID NO: 20040 - protein, 407 aa, Streptomyces hygroscopicus subsp. yingchengensis
MPIHPATSYVFRDTAHAAAAFELADLTTHAYTRLSNPTTAVAEERIAALEGGTAAVAVASGQAATSLALLNLARAGDHIVASSSLYGGTRTLLEHTFADLGIDVTFVDDPDDLGAWYTAVRPTTKAFFGETLGNPRGNVLDIEAVAGIAHETGVPLVVDNTVLTPYLLRPFEHGADIVVHSTTKFLSGHGTSIGGAVVDSGRFDFSADPDRWPGLTHPDPTYNGLSFWDSFSGLGLAYALRLRTRLVRDLGPAVSPFNSFLLLQGLETLSLRIERHVSNAQSLAEWLEQQPQVSQVHYPGLSSSPWHVPAKRYLPRGAGAVLAFELAAGLEAGRRFVEGVRLFSHLANIGDVRSLVIHPASTTHAQLDARQQTAAGVTPGLVRLSVGLEGVGDLIADLEAGLRAAVV

SEQ ID NO: 20041 - protein, 257 aa, Streptomyces hygroscopicus subsp. yingchengensis
MPGTGCPWQGAHSQGTVVAMNDRTALVTGANKGIGKHIARVLVAEGLTVYVGSRDRGLGQRAVEEIGAGARLLVLDVTDLDGIARATTQVDRLDVLVNNAGISPSLAPPADTSVEEFRRTYETNVFGVVAVTNAFLPALRRSPHPRIVNISSGTASLTWSTNPNPQFTPGSGGAAAYRSSKAALNALTVLYAQTLAEDGFKVNALAPGMRATDLNPLAAAAGDDPAEAAQGAARLALLPDDGPTGGFFSWDGTPVPW

SEQ ID NO: 20042 - protein, 324 aa, Malus x domestica
MASQPLPKVELRELGNTGLKLSCVGFGASPLGNVFGPVSDDEAIGSVREAFRRGINFFDTSPYYGGTLSEKVLGKTLKALGVPRSEYVVATKCGRYADGFDFSADRVTKSIDESLERLQLDYVDILQCHDIEFGSLDQIVNETIPALKKLKEAGKIRFIGITGLPLGIFTYVLDRIPAGMVDVVLSYCHYGINDSTLEDLIPYLKSKGVGIISASPLAMGLLTENGPPEWHPASAELKSACRAAAVYCKERGNNISKLALQYSLSNKDISSVLVGMNSINQVEENVAAAVELATIGKNEKILAEVEAILKPVKNQTWPSGLQQS

SEQ ID NO: 20043 - protein, 257 aa, Pseudomonas putida
MQLKDAQLFRQQAYINGEWLDADNGQTIKVTNPATGEVIGTVPKMGTAETRRAIEAADKALPAWRALTAKERSAKLRRWFELMIENQDDLARLMTTEQGKPLAEAKGEIAYAASFIEWFAEEAKRVYGDTIPGHQPDKRLIVIKQPIGVTAAITPWNFPAAMITRKAGPALAAGCTMVLKPASQTPYSALALVELAHRAGIPAGVLSVVTGSAGEVGGELTGNSLVRKLSFTGSTEIGRQLMEECAKDIKKVSLELG

SEQ ID NO: 20044 - protein, 360 aa, Hypocrea virens
MSRSNPPNNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVAARWYRAPEIMLTFKEYTKAIDVWSVGCILAEMLSGKPLFPGKDLTFPDHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 20045 - protein, 439 aa, Rhodotorula mucilaginosa
MAISKIHSRYVYDSRGNPTVEVELTTEKGTFRSIVPSGASTGVHEALELRDGDKSKWLGKGVLKAVANVNDTIAPALIEANIDVADQAKIDEFLLKLDGTPNKAKLGANAILGVSLAAAKAGAAQKDVPLYKHIADISKAKEGKFVLPVPFQNVLNGGSHAGGDLAFQEFMIVPSGAPSFSEGLRIGSEVYHHLKSLTKKKYGQSAGNVGDEGGVAPDIKTAKEALDLIVSAIEAAGYTGQVDIAMDVASSEFYKDGLYDLDFKNPNSDKSKWITGPQLAELYEQLLNEYPIVSIEDPFAEDDWEAWSHFFSKVEGKTQIVGDDLTVTNPIRIKKAIETKAADALLLKVNQIGTLTESIQAANDSYAAGWGVMVSHRSGETEDTFIADLSVGIRSGQTKTGAPARSERLAKLNQILRIEEELGDKAIYAGKDFHKAHSL

SEQ ID NO: 20046 - protein, 431 aa, Shewanella oneidensis
MAKIINVIGREIMDSRGNPTVEAEVHLEGGFIGMAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 20047 - protein, 472 aa, Lactococcus lactis
MAQANFGVVGMAVMGKNLALNVESRGYTVAIYNRTTSKTEEVFKEHQDKNLVFTKTLEEFVGSLEKPRRIMLMVQAGAATDATIKSLLPLLDIGDILIDGGNTHFPDTMRRNAELADSGINFIGTGVSGGEKGALLGPSMMPGGQKEAYDLVAPIFEQIAAKAPQDGKPCVAYMGANGAGHYVKMVHNGIEYGDMQLIAESYDLLKRILGLSNAEIQAIFEEWNEGELDSYLIEITKEVLKRKDDEGEGYIVDKILDKAGNKGTGKWTSESALDLGVPLPLITESVFARYISTYKDERVKASKVLSGPALDFSGDKKEVIEKIRKALYFSKIMSYAQGFAQLRKASEEFDWDLPYGTIAQIWRAGCIIRAEFLQNITDAFDKDSELENLLLDDYFVDITKRYQEAVRDVVSLAVQAGTPIPTFTSAISYYDSYRSENLPANLIQAQRDYFGAHTYERTDKAGIFHYDWYTED

SEQ ID NO: 20048 - protein, 475 aa, Cratoneuron filicinum
  misc_feature (402)..(402): Xaa can be any naturally occurring amino acid
MSPQTETKAGVGFKAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQFARELGMPIVMHDYLTGGFTANTSLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVSPVASGGIHVWHMPALTEIFADDSVLQXGGGTLGHPWGNAPGAVDNRVAVEACVQARNEGRDLAREGNEIIREATKWSPELAAACEVWKEIKFEFDTIDTL

SEQ ID NO: 20049 - protein, 250 aa, Triticum monococcum
MNKRLLDSRHCLANANCGLALPLVLFNVCCYEGLWVHYFHVAGAVALQLRLAPLQDDVIVASFPKSGTTWLNALTFATMARRTNPAAGAGHPLLRLNPHQCIPFLDKLFQSCTEAKLEALPSPRLMNTHMPIDMIMPGGGGCKVVYICREPKDMVISQWHFLRRLQPDLPLADLLESVCSGAMPYGPVWDHILGYWRASTARPDGVLFLRYEELLRNPAEKVRELARFVGLPFSDAEEEAGVVHDIVKLE

SEQ ID NO: 20050 - protein, 267 aa, Humulus lupulus
MADANMGAGGGQFPDFPSVLTHGGQYVQFDIFGNFFEITTKYRPPIMPIGRGAYGIVCSVLNTELNEMVAVKKIANAFDIYMDAKRTLREIKLLRHLDHENVIGLRDVIPPPLRREFSDVYIATELMDTDLHQIIRSNQGLSEDHCQYFMYQLLRGLKYIHSANVLHRDLKPSNLLLNANCDLKICDFGLARPNIENENMTEYVVTRWYRAPELLLNSSDYTAAIDVWSVGCIFMELMNRKPLFAGKDHVHQIRLLTELLGTPTESN

SEQ ID NO: 20051 - protein, 101 aa, Xerophyta viscosa
MEGYGNHQHHNVDEYGNPLPVGYGEGYGHQNMQRPGEYYGNQGYGGHQHGAYSGPGYQQDYGSGPRLQRSGSSTSSEDDGYGGRRKKGLKNRIMENLPGRR

SEQ ID NO: 20052 - protein, 512 aa, Medicago truncatula
MAGGVLPVDSTPVAVTAINIGGKLTLSIIITCIVAASGGLLYGYDLGVSGGVTTMVPFLQKFFPDILRKAASAEVNMYCVYDSQILTLFTSSLYLAGLVSSIAASKVTAAYGRRNVIIIGGALFIAGGAINGGSENIPMLILGRVLLGFGVGFTNQAAPLYLSETAPPKWRGTFNTGFQFFLGIGVVAAGCINYATAKHTWGWRLSLGLAVVPAAVMTIGSFLITDTPNGLVERGKIEQAKQALRKIRGSSVDIEPELEELIKWTEIAKSVQQEPFKTILKREYRPHLVMAFAIPFFQQLTGINIVAFYSPNLFHSVGFGHDGALLSAIILGSVSLLSNLISAGIVDRIGRRFLFISGGIMMLVCLIAVSIVLAVVTGVDGTKDISKGNAIVVLVLLCFYSAGFGWSWGPLTWLIPSEIFPVKIRTTGQSIAVAVQFIIIFVLSQTFLTMLCHMKFGAFVFYAFWVIVMTLFVIFFLPETKGIPLESMYTIWGRHWFWSRYVKGQEVLENLP

SEQ ID NO: 20053 - protein, 368 aa, Arabidopsis thaliana
  misc_feature (215)..(215): Xaa can be any naturally occurring amino acid
MMRGAAPTGVVSVMVLMILVLLKQIESASANGSSLGLPPRKFCNIYQGSWVYDKSYPLYDSKNCPFIERQFNCKSNGRPDSEYLKYRWQPSGCNLPRFNGLDFLGRIMKGKKLMFVGDSLSLNQWQSLTCLLHNAAPKANSTSTRSPSGLSVFSFPAYNSSIMFSRNAFLVDIVGAPPKRVMKLDSISSGSLWKTADVLVFNSWRWWLHTDRKQXWDAIMSGNVTVKDMDRLVAYEKAMMTWAKWIDQNIDPSKTKVFFQGISPDHGRAREWSKQGGKGSCIGETKPIMGSSYLAGPHAAEMVVAKVIKTMKNQARLMDVTLMSQLRKDGHPSVYGFGGHRMADCSHWCLSGVPDSWNQLLYSELFHS

SEQ ID NO: 20054 - protein, 214 aa, Arabidopsis thaliana
MRGAAPTGVVSVMVLMILVLLKQIESASANGSSLGLPPRKFCNIYQGSWVYDKSYPLYDSKNCPFIERQFNCKSNGRPDSEYLKYRWQPSGCNLPRFNGLDFLGRIMKGKKLMFVGDSLSLNQWQSLTCLLHNAAPKANSTSTRSPSGLSVFSFPAYNSSIMFSRNAFLVDIVGAPPKRVMKLDSISSGSLWKTADVLVFNSWRWWLHTDRKQP

SEQ ID NO: 20055 - protein, 364 aa, Setaria italica
MWWRAVRARRRIAGARPASTAAAAAEKSCRAVVVPRFGGPEVLEVRQGVPVPDLKPREVLVRTRAVSINPLDLRMRSGYGRSIFEPLLPLIIGRDIIGEVAATGTYASSFSIGQEVFGALHPTALRGTYADYAILSLDELTPKPSTLSHVEASAIPFAALTAWRALHGTARISEGQRVLVIGGGGAVGLAAVQLAVAAGCGVSATCGSQSIERVMGAGAEQAIDYTAEETEAAVKGKFDAVLDTIGVPETERIGINVLRRGGHYMTLQGEAAALADRYGLAVGLPVATAALLKKQMQYRSSHGVEYWWTYMRADAEGLHEIQRLSGAGKLQIPVEKTFPINQVREAHMAKEKKLVHGKVVLEFD

SEQ ID NO: 20056 - protein, 315 aa, Phaseolus vulgaris
MSNFPVINFEKLNGEERKDIMEKIKDACENWGFFELVDHGIPHDLLDTVERLTKEHYEKCMEEKFKESMASKGLEAIQTEVKDMDWESTFHLRHLPESNISEVPDLVDEYRKVMKDFALRLEKLAEQLMDLLCENLGLEKGYLKKAFYGSRGPTLPTKVANYPPCPNPRVVKGLRAHTDAGGIILLFQDDKVSGLQLLKDDQWVDVPPMRHSIVVNIGDQLEVITNGKYKSVEHRVIAQTDGARMSIASFYNPGSDAVIYPAPELLEKEAEEKAQLYPKFVFEDYMKLYADLKFQAKEPRFEAFKESNFDPIATA

SEQ ID NO: 20057 - protein, 215 aa, Pisum sativum
MGAADEEYDYLFKLVLIGDSGVGKSNLLSRFTRNEFNLESKSTIGVEFATRSVRILDKLVKAQIWDTAGQERYRAITSAYYRGAVGALLVYDSTRHVTFENVERWLKELRDHTDAYVVIMLVGNKTDLRHLCAVSTEEATAFAEKENIYFMETSALESMNVDSAFVEVLTQIYNVVSKRALEKENGSASVPKGETINIGRDDVSEVKKSTCCSTA

SEQ ID NO: 20058 - protein, 217 aa, Pisum sativum
MGAYRADDDYDYLFKVVLIGDSGVGKSNLLSRFTKNEFSLESKSTIGVEFATRSIRVDDKVVKAQIWDTAGQERYRAITSAYYRGAVGALLVYDVTRHVTFENVERWLKELRDHTDANIVVMLVGNKADLRHLRAVSTEDSTSFAEREHTFFMETSALESLNVESAFTEVLTQIYRVVSKKALEIGDDPAALPKGQTINVGSRDDVSAVKKGGCCSA

SEQ ID NO: 20059 - protein, 218 aa, Pisum sativum
MAGYRADDEYDYLFKLVLIGDSGVGKSNLLSRFTRNEFNLESKSTIGVEFATKSLNIDSKVIKAQIWDTAGQERYRAITSAYYRGAVGALLVYDVTRRATFENAARWLKELRDHTDPNIVVMLIGNKSDLRHLVAVPTEDGKSFAERESLYFMETSALEATNVENAFSEVLSQIYHIVSKKAVEAGESGSSSAVPSIGQTINVKEDSSVFKRFGCCSN

SEQ ID NO: 20060 - protein, 202 aa, Pisum sativum
MNPEYDYLFKLLLIGDSGVGKSCLLLRFADDSYLDSYISTIGVDFKIRTVEQDGKTIKLQIWDTAGQERFRTITSSYYRGAHGIIVVYDVTDQESFNNVKQWLNEIDRYASENVNKLLVGNKSDLADNKVVSSETAKAFADEIGIPFMETSAKNANNVEQAFMAMAAEIKNRMASQPSNNARPPTVQIRGQPVNQKSGCCSS

SEQ ID NO: 20061 - protein, 168 aa, Oryza sativa (japonica cultivar-group)
MLVYQDLLTGDELLSDSFPYREIENGILWEVDGKWVVQGAIDVDIGANPSAEGGGDDEGVDDQAVKVVDIVDTFRLQEQPPFDKKQFVTFMKRYIKNLSAKLDAEKQEEFKKNIEGATKYLLGKLKDLQFFVGESMHDDGGLVFAYYKDGATDPTFLYFSHGLKEVKC

SEQ ID NO: 20062 - protein, 228 aa, x Citrofortunella mitis
MAAAAAAAAQWLSVCITFSVSLIIIIGSSSLVAVVSGNSEGDALYALRRSLSDPDYVLQSWDPTLVNPCTWFHITCNQDNRVTRLDLGNSNLSGHLVPELGKLEHLQYLELYKNNIQGTIPVELGNLKSLISLDLYNNNISGKIPPSLAKLKSLVFLRLNDNRLTGQIPRELVGISSLKVVDVSSNDLCGTIPTSGPFEHIPLNNFENNPRLEGPELLGLASYDTNCS

SEQ ID NO: 20063 - protein, 116 aa, Ipomoea nil
MASPLSSSFLSLSTTHTPQHNQLFFFTNRIHTSTISHKPISSFKLQAAKLPAGVELPKEQPKLEPPFLGFTRTAEIWNSRACMIGLIGTFIVELILNRGILQLIGVDVGKGLDLPL

SEQ ID NO: 20064 - protein, 254 aa, Populus alba x Populus grandidentata
TNYRTWIFVLLYGYSMGVELSTDNVIAEYFYDRFDLKLHTAGVIAATFGMANLVARPFGGYSSDVAARYFGMRGRLWVLWILQTLGGVFCIWLGRANSLPLAVTAMILFSIGAQAACGATFGIIPFISRRSLGIISGLTGAGGNFGSGLTQLVFFSSTSLSTAAGLSWMGVMICGCTLPVALVYFPQWGGMFFPPSKDVVKSTEESYYASEWDEDERQKGMHQQSLKFAENSRSERGNRIASAPTPPSTTPNRV

SEQ ID NO: 20065 - protein, 442 aa, Arabidopsis thaliana
MLKIKRVPTVVSNYQKDDGAEDPVGCGRNCLGACCLNGARLPLYACKNLVKSGEKLVISHEAIEPPVAFLESLVLGEWEDRFQRGLFRYDVTACETKVIPGKYGFVAQLNEGRHLKKRPTEFRVDKVLQSFDGSKFNFTKVGQEELLFQFEAGEDAQVQFFPCMPIDPENSPSVVAINVSPIEYGHVLLIPRVLDCLPQRIDHKSLLLAVHMAAEAANPYFRLGYNSLGAFATINHLHFQAYYLAMPFPLEKAPTKKITTTVSGVKISELLSYPVRSLLFEGGSSMQELSDTVSDCCVCLQNNNIPFNILISDCGRQIFLMPQCYAEKQALGEVSPEVLETQVNPAVWEISGHMVLKRKEDYEGASEDNAWRLLAEASLSEERFKEVTALAFEAIGCSNQEEDLEGTIVHQQNSSGNVNQKSNRTHGGPITNGTAAECLVLQ

SEQ ID NO: 20066 - protein, 475 aa, Arabidopsis thaliana
MEANKKAKPSYGDVISNLPNDLLCRILSYLSTKEAALTSILSKRWSNLLLSIPILDFDDSVLLKPQKGQRKNVFFKAFVDRLLSQRVETSSHVQRVSLKCRQGGVEPDCVIKWILTTVRDLGVLDLSLCIDFGIFHLPFNVFRSKTLVKLRIGTMIRLSQFPSDVVSPTLNSLVLDLVEFRDGDKVEFRQILLAFPSLQSLRVHESNKWKFWNGSASSRTLKSLVYRSDDDSSAPKPCVSFDTPSLVYLDYSDMVADKYENLKFDSLVEARLDLHLTAFQIMRKPNNIGIVSGDVTTLFKGIRNVKILCLSPDALEALYYRGEKIPMFNNLITLSLGSDKPHGSPFIFWKLLPSLLNNSLKLETLIIKGLVHYVAEGWEGLSPMTPMSRLCFSWDTVSDSLSSSAMKVLEISGYKGTWQELNQMKRFLGNLSRLEVVRVYHKAMDDKERINVMFDLFLLPKVSSECDIQVMKETA

SEQ ID NO: 20067 - protein, 479 aa, Arabidopsis thaliana
MSSIWNVAMLMVALVVVRISHWLYRWSNPKCPGKLPPGSMGFPIIGETLDFFKPCGVEGIPTFVKKRMIRYGPLFRTNIFGSKTVVSTDPDVIHQIFRQENTSFELGYPDIFVKVFGKDNLFLKEVFIHKYLQKITMQILGSEGLKQTMLGNMDKATRDHIRSIASQGSFNVRKEVENLVVAYMTPKLISNLKPETQSKLIDNLNAFNLDWFKSFLRLSTWKAVTKALKSREEAIQVMKDVLMMRKETREKQEDFLNTLLEELEKDGSFFDQGSAINLIFLLAFALREGTSSCTALAVKFISKDPKVLAELKREHKAIVDNRKDKEAGVSWEEYRHNMTFTNMVSNEVLRLANTTPLLFRKAVQDVEIKGYTIPAGWIVAVAPSAVHFDPAIYENPFEFNPWRWEGKEMIWGSKTFMAFGYGVRLCVGAEFSRLQMAIFLHHLVAYYDFSMVQDSEIIRSPFHQYTKDLLINISQSPTK

SEQ ID NO: 20068 - protein, 475 aa, Astilbe taquetii
MSPQTETKASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPVAYVKTFEGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAFYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 20069 - protein, 302 aa, Pseudomonas chlororaphis
MPAQGRPAVPRFGLRQARGLPAAQLADRPGNRPGPGPGRGLRPSPFGPGRKRPGAAGPAGRKLMDRQITASTCCYCGVGCGVLIEHDGERILGVSGDPAHPANFGKLCSKGSTLHLTGDLAARALYPELRLGKGLARARSDWDSALDHAASVFAETIAEHGPDSVAFYISGQLLTEDYYAFNKLARALVGTNNIDSNSRLCMSSAVVGYKRSLGADAPPCSYEDLELSDCVMIVGSNMAYAHPILFRRLEEAKSRRPQMKIIVIDPRRTDTCDLADLHLAILPGTDVALFHGILHLLLWEDW

SEQ ID NO: 20070 - protein, 243 aa, Cyanidioschyzon merolae strain 10D
MLIAYLTAGAPDINTTKEAVMKLAKKGADVIEIGVPYSDALADGAILQKASKQALMNGFHLDHLWNLLSEVNEIEVPLVILAYYNQIWHYGVEKWVKKLVAHNVKGLIVPDLPYEESKTLRQICDRYGLNIIWLISPTTNKTRAQELARACKDWIYVISRTGVTGLETEFDKQIPKLIGELKKVTKAPIALGFGISKSEQVKLVKSWGADGVIIGSACMQILLEKGVDQLSEWISVMKKSFCP

SEQ ID NO: 20071 - protein, 158 aa, Cyanidioschyzon merolae strain 10D
MSRSQKNDNFIDKTFTILADVLVKLLPTSQNAKKAFSYYREGMAAQAEGEYAQALESYYHALEFEEDVIDRSYIIYNIGLIYASNGEDEQALEYYHQALELNPRLVQALNNIAVIYHKQGMTYQDEQLLQKAAAYWRKAIQLAPGQYLEAQNWLKNMV

SEQ ID NO: 20072 - protein, 185 aa, Cyanidioschyzon merolae strain 10D
MFKRSLIFIAAVMSVCQISAIQISAVSADVLTPCQQSEAFHKREINEVRTLENRQANYEANSPSYLALQSQIDQVHKRFDKYGTLLCGQDGLPHLITDGDWRHAREFTIPALLFLYITGWIGWVGRSYLKYTKETKNPTEQEIILDVPMALKYMLSGFLWPLSAWQEYRSGQLLAKEDEITVSPR

SEQ ID NO: 20073 - protein, 273 aa, Cyanidioschyzon merolae strain 10D
MGKSTRQASPRLLKIWSKCEACQNLVDIKQLQGNLRVCVECDYHWRMPSRERIASLVDNWQPLNDHLTSTDALDFYDQQPYALRIQQTQMRTQLPEAVLTGIGDLEDQKVALGVMDFEFMGGSMGSAVGEKITRLIETSISQALPLILISASGGARMQEGVLSLMQMAKISSALERFHQHGLLYISVLTSPTTGGVMASFAMLGDLILAEPKATVGFAGKRVIEQTIKEDLPQNFQSAEYLRQHGFLDLIVHRSKLKTTLYKMIRWHHRLTEG

SEQ ID NO: 20074 - protein, 290 aa, Streptomyces violaceoruber
MHVPSTAPPPATAAPLFGPFTVGSLALENRIVMAPMTRELSPGGVPGPEVAAYYARRARNGVGLIITEGAAIGHPSSERRAAVPRIHGADALAGWTRVTQAVHAAGGRIAAQLMHVGLDPLLWGMTPAEMDAASPAGFELLSPSGVDPSQPAAATVGREMSDVDISSVIDAYARAAAEARQAGFDAIELHAAHGYLIDQFFWAVTNRRKDRYGGDLSARTRFGADVVRACRHAVGEDFPIFLRFSQWKVGHYAARLADSPDELAAVLGPLVQAGVDAFHCSTRRFWQPEF

SEQ ID NO: 20075 - protein, 173 aa, Flaveria bidentis
MASIPATFATVAQANMVAPFTGLKANAAFPVTKKVNGFSTLPSNGGRVQCMKVWPPVGKKKYETLSYLPELTEAQLAKEIDYLIRNKWVPCLEFELEHGFVYRENARSPGYYDGRYWTMWKLPMFGCTDSAQVMKELQECKKEYPQAWIRIIGFDNVRQVQCVSFIASKPTGF

SEQ ID NO: 20076 - protein, 173 aa, Flaveria bidentis
MASIPATVAAVPQTNMVAPFTGLKANAAFPVTKKVNGFSTLPSNGGRVQCMKVWPPVGKKKYETLSYLPELTEAQLAKEVDYLIRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 20077 - protein, 1023 aa, Hordeum vulgare
METRPWLLRLIAILTTTTALLLHPSTSSSVSTAHDLPALLSFKSLITKDPLGALSSWTTNGSTHGFCSWTGVECSSAHPGHVKALRLQGLGLSGTISPFLGNLSRLRALDLSGNKLQGQIPSSIGNCFALRTLNLSVNSLSGAIPPAMGNLSKLLVLSVSKNDISGTIPTSFAGLATVAVFSVARNHVHGQVPPWLGNLTALEDLNMADNIMSGHVPPALSKLINLRSLTVAINNLQGLIPPVLFNMSSLECLNFGSNQLSGSLPQDIGSMLPNLKKFSVFYNRFEGQIPASLSNISSLEHLSLHGNRFRGRIPSNIGQSGRLTVFEVGNNELQATESRDWDFLTSLANCSSLLLVNLQLNNLSGILPNSIGNLSQKLEGLRVGGNQIAGLIPTGIGRYLKLAILEFADNRFTGTIPSDIGKLSNLKELSLFQNRYYGEIPSSIGNLSQLNLLALSTNNLEGSIPATFGNLTELISLDLASNLLSGKIPEEVMRISSLALFLNLSNNLLDGPISPHIGQLANLAIIDFSSNKLSGPIPNALGSCIALQFLHLQGNLLQGQIPKELMALRGLEELDLSNNNLSGPVPEFLESFQLLKNLNLSFNHLSGPVPDKGIFSNASVISLTSNGMLCGGPVFFHFPTCPYPSPDKLASHKLLQILVFTAVGAFILLGVCIAARCYVNKSRGDAHQDQENIPEMFQRISYTELHSATDSFSEENLVGRGSFGSVYKGTSGSGANLITAAVKVLDVQRQGATRSFISECNALKMIRHRKLVKVITVCDSLDHSGNQFKALVLEFIPNGSLDKWLHPSTEDEFGTPNLMQRLNIALDVAEALEYLHDHIDPPIVHCDVKPSNILLDDDMVAHLGDFGLAKIIRAEKSKQSLADQSCSVGIKGTIGYVAPEYGTGTEISVEGDVYSYGVLLLEMLTGRRPTDPFFSDTTNLPKYVEMACPGNLLETMDVNIRCNQEPQAVLELFAAPVSRLGLACCRGSARQRIKMGDVVKELGAIKQIIMASQNYASWSTKLY

SEQ ID NO: 20078 - protein, 499 aa, Hordeum vulgare
MIGTRVLAHSRVDPAIRWGVAARGRVVFAAIRWGAAARGRVVFAAVRWGAAARGTKREAGQETSTSETKKTKRKWGRGFCGMASHEVEEPLTSETKKTKRKWGRGFCGMASHEAEEPLTSETKKKRKNVAASSEPDKKRWFKNKIWKKKKAKNEQLATLVKEISLATKLNSAMHVNINLSMNICPTQTYEEHSGTYLRNLAVIAVKQLDKDGLQGNREFLVEVLMLSLLHHPNLVTLLGYCTECDQKILVYEYMPLGSLQDHLLDLTPKSQPLSWHTRMKIAVDAARGLEYLHEVANPPVVYRDLKASNILLDGNFSAKLADFGLAKLGPVGDKTHVTTRVMGTYGYCAPEYAMSGKLTKMSDIYCFGVVLLELITGRRAIDTTKPTREQILVHWAAPLFKDKKKFTKMADPLLDSKYPLKGLYQALAISSMCLQEEAISRPLISDVVTALTFLADPNYDPPDDIEPLPISVPNYDKGISLREAEISLSGFEEKQVEDS

SEQ ID NO: 20079 - protein, 510 aa, Gossypium hirsutum
MPSFDTILLRDLVAAACLFFITRYFIRRLLSNPKRTLPPGPKGWPIVGALPLLGSMPHVELAKLAKKYGPVMYLKMGTCNMVVASTPDAARAFLKTLDLNFSNRPSNAGATHIAYNSQDMVFAEYGPRWKLLRKLSNLHMLGGKALEDWSQVRAVELGHMLRAMCESSRKGEPVVVPEMLTYAMANMIGQVILSRRVFVTKGSESNEFKDMVVELMTSAGLFNIGDFIPSIAWMDLQGIEGEMKKLHNRWDVLLTKMMKEHEETAYERKGKPDFLDIIMDNRENSAGERLSLTNVKALLLNLFTAGTDTSSSIIEWALAEILKNPKILNKAHEEMDKVIGRNRRLEESDIPKLPYLQAICKETFRKHPSTPLNLPRVSTQACEINGYYIPKNTRLSVNIWAIGRDPDVWGNPLDFTPERFLSGRFAKIDPRGNDFELIPFGAGRRICAGTRMGIVLVEYILGTLLHSFDWMLPPGTGELNMDEAFGLALQKAVPLSAMVRPRLAPTAYVS

SEQ ID NO: 20080 - protein, 506 aa, Brassica juncea
MTSINVKLLYHYVITNLFNLCFFPLTAIVAGKAYRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETHGPEGLLQVPPRKTFAAAREETEQVIIGALENLFKNTNVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPGDRRRSKYELVHTVRTHTGADDKSFRCVQQGDDENGKTGVSLSKDITDVAGRTVKKNIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNSPWEHCIDRYPVKIDSDSGKSETRVQNGRS

SEQ ID NO: 20081 - protein, 506 aa, Brassica juncea
MTSINVKLLYHYVITNFFNLCFFPLTAIVAGKASRLTIDDLHHLYYSYLQHNLITIAPLFAFTVFGSVLYIATRPKPVYLVEYSCYLPPTHCRSSISKVMDIFYQVRKADPSRNGTCDDSSWLDFLRKIQERSGLGDETYGPEGLLQVPPRKTFAAAREETEQVIIGALKNLFENTKVNPKDIGILVVNSSMFNPTPSLSAMVVNTFKLRSNVRSFNLGGMGCSAGVIAIDLAKDLLHVHKNTYALVVSTENITYNIYAGDNRSMMVSNCLFRVGGAAILLSNKPRDRRRSKYELVHTVRTHTGADDKSFRCVQQGDDENGKTGVSLSKDITDVAGRTVKKNIATLGPLILPLSEKLLFFVTFMAKKLFKDKVKHYYVPDFKLAVDHFCIHAGGRAVIDVLEKNLGLAPIDVEASRSTLHRFGNTSSSSIWYELAYIEAKGRMKKGNKVWQIALGSGFKCNSAVWVALSNVKASTNSPWEHCIDRYPVKIDSDSAKSEVRVQNGRS

SEQ ID NO: 20082 - protein, 475 aa, Botrychium biternatum
MSPQTETKAGVGFKAGVKDYRLTYYTPDYKTKDTDILAAFRMTPQPGVPAEEAGAAVAAESSTGTWTTVWTDGLTSLDRYKGRCYEIEPVPGEENQFIAYVAYPLDLFEEGSVTNMFTSIVGNVFGFKALRALRLEDSRIPPAYSKTFTGPPHGIQVERDKLNKYGRPLLGCTIKPKLGLSAKNYGRAVYECLRGGLDFTKDDENVNSQPFMRWRDRFLFVAEALFKSQAETGEIKGHYLNATAGTCEEMLKRAVFARELGVPIVMHDYLTGGFTANTSSAFYCRDNGLLLHIHRAMHAVIDRQKNHGIHFRVLAKALRMSGGDHIHSGTVVGKLEGEREITLGFVDLLRDDYIEKDRSRGIYFTQDWVSMPGVLPVASGGIHVWHMPALTEIFGDDSVLQFGGGTLGHPWGNAPGAVANRVALEACVQARNEGRDLAREGNEIIREAAKWSPDLAAACEVWKAIKFEFAAVDTL

SEQ ID NO: 20083 - protein, 180 aa, Medicago sativa
MALISSAAVTTVNRASSAQANLVAPFTGLKSSAGFPVTKKTNNDITSIASNGGRVNCMQVWPPVGKKKFETLSYLPPLTEEQLAKEVEYLIRKGWIPCLEFELEKGFVYRENHRSPGYYDGRYWTMWRLPLFGATDSSQVLKELADCKAEYPDSFIRIIGFDNVRQVQCISFIAHTPKNY

SEQ ID NO: 20084 - protein, 171 aa, Azotobacter vinelandii
MTSHFALFDLEPDFRLDQDRLAVRYRELVRRVHPDRFAGAPEREQRLALEEAARLNEAYQTLKSPSQRARYLLSLQGEELSQETTVQDPAFLMQQMELREELQELQDSADLAGVARFKRRLVQDQEQLNEGFAACWADPRRRDEAERLARRMQFLDKLFAEVRQLEERLDD

SEQ ID NO: 20085 - protein, 178 aa, Salmonella typhimurium
MKHTVEVMIPEAEIKARIAELGRQITERYKDSGSEMVLVGLLRGSFMFMADLCREVQVPHEVDFMTASSYGSGMSTTRDVKILKDLDEDIRGKDVLIVEDIIDSGNTLSKVREILGLREPKSLAICTLLDKPSRREVDVPVEFVGFSIPDEFVVGYGIDYAQRYRHLPYVGKVVLLDE

SEQ ID NO: 20086 - protein, 355 aa, Craterostigma plantagineum
MEKYELVKDIGSGNFGVARLMRNKETKELVAMKYIERGHKIDENVAREIINHRSLRHPNIIRFKEVVLTPTHLAIVMEYAAGGELFERICNAGRFSEDEARYFFQQLICGVHYCHALQICHRDLKLENTLLDGSPAPRLKSCDFGYSKSSLLHSRPKSTVGTPAYIAPEVLSRREYDGKLADVWSCGVTLYVMLVGAYPFEDQEDPFFFRKTILWIMAVQYKIPDYVRISQSCRHLLSRIFVANPLRRITIKEIKSHLWFLKNLPRELTEVAQAAYFRRDNPTYSLQSEEEIMKIVEEAKVPPQASRSIGGFGWGTEEDEENVEEEEEGESEGEEDEYEKQVKAAHASGEVPPLT

SEQ ID NO: 20087 - protein, 322 aa, Beta vulgaris
MDENYIRTCFAQSGELVNVKIIRNKQTMQSECYGFIEFSTHAAAERILQTYNNTLMPNVEQNYRLNWAFYGSGEKRGEDASDYTIFVGDLAPDVTDYTLQETFRVRYPSVKGAKVVIDRLTSRSKGYGFVRFGDESEQARAMSEMNGMMCLGRAMRIGAAANKKSVGGTASYQNNQGTPNDSDPSNTTIFVGNLDSNVTDEHLRQTFSPYGELVHVKIPAGKQCGFVQFTNRSSAEEALRVLNGMQLGGRNVRLSWGRSPNNRQSQPDQNQWNNAAYYGYPQGYDSYGYVSAPQDPNMYYGGYPGYGGYAMPQQAQMPLQQQ

SEQ ID NO: 20088 - protein, 485 aa, Burkholderia cepacia
MLKKSTTSSTANMCRVSVGSRSSSPLNNAVIAKVHEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAVRRPVGVVGVICPWNLPLLLMTWKVGPALACGNTVVVKPSEETPQTAALLGEVMNTAGVPPGVYNVVHGFGPNSTGEFLTSHPDVNAITFTGETGTGEAIMKAAADGARPVSLELGGKNAAIVFADCDLDKAIEGTLRSCFANCGQVCLGTERVYVERPIFDRFVSRLKKGAEGMQLGRPEDLATGMGPLISQEHREKVLSYYKKAVEAGATVVTGGGVPEMPEALKGGAWVQPTIWTGLGDDSVVAREEIFGPCALVMPFDSEEEVIRRANDNDYGLARRIWTTNLSRAHRVAGAIEVGIAWVNSWFLRDLRTAFGGSKQSGIGREGGVHSLEFYTELKNVCIKL

SEQ ID NO: 20089 - protein, 400 aa, Paracoccidioides brasiliensis
MKFSLLLAATTTLLGTSSAKVHKLKLNKISLSQQLDHANIETQVKALGQKYMGVRPSQHLNEMFKDTSKASGGHSVLVDNFLNAQYFSEISIGTPPQTFKVVLDTGSSNLWVPSSQCSSIACYLHSKYDSSASSTHRKNGTEFAIRYGSGSLSGFVSQDVLRIGDMTVESQDFAEATSEPGLAFAFGRFDGILGLGYDTISVNRIVPTFYLMVNQGLLDEPVFSFYLGNSDTDGDDSEATFGGIDKDHYTGNLTMISLRRKAYWEVDLDAITFGSETAELENTGVILDTGTSLLALPSTVAEILNQKIGAKKSFNGQYTVDCSKRSSFPDITFTLAGHNFTIGSYDYILEVQGSCISSFMGMDFPEPVGPLAILGDAFLRRWYSVYDLGNHQIGLAKARQ

SEQ ID NO: 20090 - protein, 363 aa, Streptomyces cattleya
MTLPTETWAVRIHRHGGPEVLVHERLPLPPLGPADVLVAVDTASVSGWDVKYRRGLPPGARLPGRERYRLPLQLGREAAGTVLATGPEAAGRFRPGDRVVAVVHPENPRAPETVRGLGNLSTGIALPGHQAPGGYARYLICHQDMWLPLPSGVDLEQAAVTLWPYATCHRVLRDRLRVALGETLLVCGATGAMGLAALRLARLTGVRVIAMTRYRAKERALRTAGADEVVVAGDPRQACEAVRALTGGEGVDHAVDFTGSAALLRLAVDSLRLGGRLCPAATQRPPGPLPVTTGDLTRLEITVYGIRGARHRDALRVLALLGDGSLPATPIAARFPLSRAGAAHEFLEHNTTAVGRVVLKPGW

SEQ ID NO: 20091 - protein, 450 aa, Lactobacillus fermentum
METLSFDSSALKKFVHPNELGEMQAMVTAADSELRNGTGAGADFRDWLHLPTDYDKDEFARIEAAAKKIQADSEVLVVIGIGGSYLGARMAVDFLHHSFYQAQTAADRKQPLVLFAGNSLSSSYIADLIDVIGDRDFSVNVISKSGTTTEPSIAFRVFRQLLEDKYGVDGANARIYATTDRQRGALKTEADAEGWGTFVIPDGVGGRFSVLTAVGLLPIAVSGADIDQLMAGAAKAEATYVNPDLTQNEAYQYAAYRNILYRKGYTTELLENYEPNMTMLAEWWKQLAGESEGKDQKGIYPSSANFTTDLHSLGQYIQEGRRNLMETVVKLAEPNHNVKVPSAKSDFDGLKYLEGKEIDWVNTQAYRAVVAAHTTGGVPVMTVNIAKEDEFTLGYLIYFFEVAIAISGYLNGINPFNQPGVEAYKTNMFGLLGKPGFEEIGEQLKKEMDD

SEQ ID NO: 20092 - protein, 189 aa, Legionella pneumophila
MTIPDKIKAVYEKSTCLYTSNEVEAALDRMAIKIHETLQDKNPVIICVMVGGLVPLGNLLHRLDFPLEVDYVHATRYRGDLTGGDILWKVRPSSNLAGRTVLVVDDILDGGITLAAIINEIKAMGAAEVYSAVLVDKYRKRVPNGLQKADFVGLQVEDHYIFGYGMDYHKYLRNAPGIFIVHPDHEANK

SEQ ID NO: 20093 - protein, 156 aa, Haemophilus influenzae
NRTNTPVLVDGKDVMPEVNAVLAKMKDFCQRIISGEWKGYTGKAITDVVNIGIGGSDLGPYMVTEALRSYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 20094 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNIHFVSNVDGTHIAETLKKVNPETTLFLVASKTFTTQETMTNAQSARDWLLKTAKDESAVAKHFAALSTNAKDVEKFGIDTN

SEQ ID NO: 20095 - protein, 156 aa, Haemophilus influenzae
NRANTPVLVDGKDVMPEINAVLAKMKDFCQRIISGEWKGYTGKSISDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 20096 - protein, 156 aa, Haemophilus influenzae
NRANTPVLVDGKDVMPEVNAVLAKMKDFCQRIISGEWKGYTGKAISDVVNIGIGGSDLGPYMVTEALRPYKNHLNMHFVSNVDGTHIAETLKKVNPETTLFLVASKTFTTQETMTNAQSARDWLLKAAKNESAVAKHFAALSTNAKDVEKFGIDTN

SEQ ID NO: 20097 - protein, 156 aa, Haemophilus influenzae
NRSNTPVLVDGKDVMPEVNAVLAKMKDFCLRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDENEVAKHFAALSTNAKDVEKFGIDTN

SEQ ID NO: 20098 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKINPETTLFLVASKTFTTQETMRNAQSARDWLLKAAKNESAVAKHFAALSTNAKDVEKFGIDTN

SEQ ID NO: 20099 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKATKDESAVAKHFAALSTNAKDVEKFGIDTN

SEQ ID NO: 20100 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKINPETTLFLVASKTFTTQETMTNAQSARDWLLKATKDESAVAKHFAALSTNAKDVEKFGIDTN

SEQ ID NO: 20101 - protein, 156 aa, Haemophilus influenzae
NRANTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 20102 - protein, 365 aa, Pseudomonas citronellolis
MNSAIKGTNVTALPQKIQTILDKGQGTAARALDKLPKIVQESLAKVLGYPYQYPDLDAFTKCLMAVQIKQGRIGFIGEDPIESRRQFDAQMLAILNKATQIESVEDIRLPLQSGTVFARHYHPAPNKKLPMILFYHGGGFVVGGLDTHDEVCRLIAKYAKVQVLSIDYPLAPEASPQLLIKSCEDALAWVYQNRRQLKIYKNRIAVAGDSAGGNISTVVAQHTAGKSYAPQAQLLIYPVVDFKSRHPSFYAYGEGLVLTSKDVDYVTQYYATQHNIALDNPLISPTYGNLRKLAPVYVITAGHDLLHDEGEIYSHKLRQSGVKVQYVDYPDQTHGFINLTPISSKAKRNTIEIAKNFRKFWDKHS

SEQ ID NO: 20103 - protein, 505 aa, Helianthus tuberosus
MEIPYLLTTTLLLLFTTLYLLLRRRSSTLPPTIFPSLPIIGHLYLLKPPLYRTLAKLSAKHGQILRLQLGFRRVLIVSSPSAAEECFTKNDIVFANRPKMLFGKIIGVNYTSLAWSPYGDNWRNLRRIASIEILSIHRLNEFHDIRVEETRLLIQKLLSACNSGSSQVTMKFSFYELTLNVMMRMISGKRYFGGDNPELEEEGKRFRDMLDETFVLAGASNVGDYLPVLSWLGVKGLEKKLIKLQEKRDVFFQGLIDQLRKSKGTEDVNKKKTMIELLLSLQETEPEYYTDAMIRSFVLVLLAAGSDTSAGTMEWVMSLLLNHPQVLKKAQNEIDSVIGKNCLVDESDIPNLPYLRCIINETLRLYPAGPLLVPHEASSDCVVGGYNVPRGTILIVNQWAIHHDPKVWDEPETFKPERFEGLEGTRDGFKLLPFGSGRRSCPGEGLAVRMLGMTLGSIIQCFDWERTSEELVDMTEGPGLTMPKAIPLVAKCKPRVEMTNLLSEL

SEQ ID NO: 20104 - protein, 501 aa, Thermoproteus tenax
MRAGLLEGVIKEKGGVPVYPSYLAGEWGGSGQEIEVKSPIDLATIAKVISPSREEVERTLDVLFKRGRWSARDMPGTERLAVLRKAADIIERNLDVFAEVLVMNAGKPKSAAVGEVKAAVDRLRLAELDLKKIGGDYIPGDWTYDTLETEGLVRREPLGVVAAITPFNYPLFDAVNKITYSFIYGNAVVVKPSISDPLPAAMAVKALLDAGFPPDAIALLNLPGKEAEKIVADDRVAAVSFTGSTEVGERVVKVGGVKQYVMELGGGDPAIVLEDADLDLAADKIARGIYSYAGQRCDAIKLVLAERPVYGKLVEEVAKRLSSLRVGDPRDPTVDVGPLISPSAVDEMMAAIEDAVEKGGRVLAGGRRLGPTYVQPTLVEAPADRVKDMVLYKREVFAPVASAVEVKDLDQAIELANGRPYGLDAAVFGRDVVKIRRAVRLLEVGAIYINDMPRHGIGYYPFGGRKKSGVFREGIGYAVEAVTAYKTIVFNYKGKGVWKYE

SEQ ID NO: 20105 - protein, 412 aa, Rhodococcus erythropolis
MANAKRHHVIVGGSAAGVSAALSMRRAGFEGQITLVEADTAVPYQRPPLSKSFEDLDSPKVIVPEVTYDDHDVQLLSGERVASLDEDRRRVVLESGTDLQADSVLVATGVLPRRLGVPGDDLNNVLTLRDINDARALASRLDAGPLVVVGGGFIGLEVAAAARLRGQHVTVIEALRVPLTGALGDEVGSLVTNMHLARGVHVVTERTVVELRGDGDVESVILNDGSQLNAATVVVGCGVSPNDELARRAGVFTDNGIVIDEYGQTSRGWIWAAGDVATFESPFTDRRQRIEHWNVAQGQGAVVGANMAGTATAYRDVPYFWSDQYDSHLQMYGRAVASDRLTIRPSSEHEGFLALWIRDDVLVAAASIGESKQLRLAKNLIEHHVPVRETELANPHQSLRELVKQHKPQAFR

SEQ ID NO: 20106 - protein, 436 aa, Streptomyces kasugaensis
MSDSVLLSARQPLPPIDYSHAAGAWIHTAEGDSLLDAASGLVCVNIGHAHPHVVEQITRQARTATFASPGVLLPAVQEELAGRLTEAVNRPGDGVSLACSGTSAVELAISYARLIQRSRGQDGRHHILTARLGYHGNSALTLGLSGHRRRRPHPDDALGLAPAFDPPYPGHHRDCPHDRCRASCADAVAEAIDRRGPESVAAVLIEPVNGTTGGAYTPPPGYLAALRRACHERGVLVIHDEVLTGLGRTGLPLGADHCTDAAADIVVLSKGLSAGYLPLAAVLVNPEGVARLRSGPRPLPLMGTMSATPLQAAAGLAVLDVLGEIGALDPARVRGGDVAAAVRAVAALPVVQETRGVGYFHAVELAPGTQAAALAAARDERLLLYPFNGFHADGTGEGLIVAPPLNSTPSEVEFLAQGLRRALERTAARSEDRSHR

SEQ ID NO: 20107 - protein, 175 aa, Oryza sativa (japonica cultivar-group)
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKANPDAFVRIIGFDNVRQVQLISFIAYKPPGCEESGGN

SEQ ID NO: 20108 - protein, 125 aa, Synechococcus sp. PCC 7002
MAGSEVKADYWINEYITPWDIYSHGITKILAYKQTQFQEMAIVESGAYGKALVLDGKWQSCTGDEFLYHEPLVHPAMIAHGAPKKVLILGAGEGATVREVLRWQSVEKVMMVDIDGEVVEACKEF

SEQ ID NO: 20109 - protein, 471 aa, Arabidopsis thaliana
MCILIFVGNNGETYFNTAALVSGVQNFPKSRGPVVGILKGFAGLGGAILSQVYTMIHSSDRASLIFMVAVAPSVVVVPLMFFIRPVGGHRQIRSSDATSFTVIYAVCILLAAYLMAVMLVEDFIDLSHSIIIAFTVVLFAILLVPIFIPIATSCFTASTDPCDTLEEPLLGDQQGQDPGQSTTPDHGPELIFSEVEDEKPKEVDLLPAVERHKRIAQLQAKLMQAAAEGAVRVKRRRGPHRGEDFTLTQALVKADFWLIFFSLLLGSGSGLTVIDNLGQMSQSLGYDNTHVFVSMISIWNFLGRIGGGYFSELIVRDYAYPRPVAIAVAQLVMSVGHIFFAYGWPGAMHIGTLLIGLGYGAHWAIVPATASELFGLKKFGALYNFLTLANPAGSLVFSGLIASSIYDREAERQAQGSLFNPDDVLRCRGSICYFLTSLIMSGFCLIAAALSMILVQRTKPVYTNLYGKTRN

SEQ ID NO: 20110 - protein, 507 aa, Arabidopsis thaliana
MGSKKKCFDGSRDGISGLPDAMICHILSFLPTKVAASTTVLAKRWKPLLAFMPNLDFDESFRFDPRMTCEERRKGSESFMLVVDSVLALQAEANATLNKFYVKCEGVEQNSVLEWIPKVLKRGVLDIDLQIPSSRGFGSNSTFYPLPSEIFVSKTLVRLKIQFQDGANVNVEGDVSLPMLKTLHLDYVKMDTRMLQKLLSGCHTLEELLLMNLIWKESSEPEPCFVSVSVRTLKILKFSRFENFMKAKDFKPIVLLSFDIPNLVYLEYLDTIADKYEQVRFDSLVKASIGLCKTSKQIENDNNNVTKLFMGICNVTILYLTEDTLKVLGCCRETMPVFENLIHLTIRTGVHIGWKSLPHLLKNCPNLQTLVFEGMHHIYRKGRACGDVDEDGTCMCKNLDNMRVKKDIDACLSSSPVKVIKILNFGELCGFCEFCDVEEDVAGQIKQVKQFLETMPDLEKVILYYNTPEDEDVMKVFKKLKKLPRVASAKCEVQIISDNINLSFTFR

SEQ ID NO: 20111 - protein, 1078 aa, Arabidopsis thaliana
MELSVSPQTQKMNLQTPRKSSLSGSRKDLWFAIREGSLVDVDSALSILKKTGGNINLRNAYGLTPLHIAVWRNHIPIVRRLLAAGADPDARDGESGWSSLHRALHFGHLAVASVLIDSGASFTLEDIKLRTPVDLVSGPVAQVIGEQQSSEVFSWGNGANYQLGTGNQHVQKVPGRVDSLHGCFIKLVSAAKFHSVAISTHGEVYTWGFGRGGRLGHPEFDIHSGQAAVITPRQVISGLGSRRVKAVAAAKHHTVIATEGGDVYTWGSNREGQLGYTSVDTQATPRKVTSLKAKIVAVSAANKHTAVVSDCGEVFTWGCNKEGQLGYGTSNSASNYSPRLVDYLKGKVFTAIASSKYHTLVLRNDGEVYTWGHRLVTPRRVIISRNLKKAGNTLLNFHRRRPLRLTAIAAGMVHSLALAEDGAFFYWVSSDSNLRCQQLHSLHGKTVVSISAGKYWASAVTSTGEVYMWDGKNGKDIAPSLSRLHNLKRATTVAVGETHLLVVGSLYHPAYAPIVLKKSQTLQADKCREEENEELDEGFMFDDVESVNVLQSVQYDNPKERIVPSLKSLCEKVAAECIVEPRNAIQLLEIADSLGAEDLKKYCEDIVIRNLDFILTFSPQSIANTSPDVLANLEKLLDDRSSETWSSRPLPTPTATFPVVIDSEEEESESDILRTRDSHVKHFSSIGGTRMDSFLQPEDELTQHNSKEVRALRKKLQQIEILEAKQSRGQLLDGQQIAKLQKKLDIESSLVELGIPVEEFPEAKATTALPLEGKANKKGKKKKKGNQRFVQVETFPEFGEVKVEIDTMQDKEIEEICEAIKPKGGKTMLDTTMISGFPKESDFVSLSQKKDNPPDSPRSKKLATAANKKKNRKGGLSMFLTGALDDVPKPVVAPPPRPKIEGPVWGGAKISKGLSSLRDIQDEQSKTRSHEPVRTTKNQSGDDSPGKSEGKILLSSFLTSKPIPMEPAKSLQQSDVEKGTPPWASSETPRKLSRPSLRDIQMQEVKKQQSLSHSPKTKTSGFTVATGQGSPSDSPGTNRWFKPEIDAPSAIRSIQIEEKAMKDLRRFYSSVKVVRNQP

SEQ ID NO: 20112 - protein, 138 aa, Arabidopsis thaliana
MIKEALMVLKEKNGSSPYAIAKKIEEKHKSLLPESFRKTLSLQLKNSVAKGKLVKIRASYKLSDTTKMITRQQDKKNKKNMKQEDKEITKRTRSSSTRPKKTVSVNKQEKKRKVKKARQPKSIKSSVGKKKAMKASAA

SEQ ID NO: 20113 - protein, 291 aa, Arabidopsis thaliana
MCFSPEDRKKTDHLLALDGAKERLKLFKADLLDEGSFELAIDGCETVFHTASPVAITVKTDPQVELINPAVNGTINVLRTCTKVSSVKRVILTSSMAAVLAPETKLGPNDVVDETFFTNPSFAEERKQWYVLSKTLAEDAAWRFAKDNEIDLIVLNPGLVTGPILQPTLNFSVAVIVELMKGKNPFNTTHHRFVDVRDVALAHVKALETPSANGRYIIDGPVVTIKDIENVLREFFPDLCIADRNEDITELNSVTFNVCLDKVKSLGIIEFTPTETSLRDTVLSLKEKCLV

SEQ ID NO: 20114 - protein, 475 aa, Arabidopsis thaliana
MVDLYEFWAVIVSLIVVKLCHSIYQWRNPKSNGELPPGSMGYPIIGETFEFMKPHDAIQLPTFVKEKVLRHGPVFRTSLFGGKVIISTDIGLNMEIAKTNHIPGMPKSLARLFGANNLFVNKDTHKHARSLTNQFLGSQALKLRMLQDIDFLVRTHLKEGARKGSLDIKETTSKIIIECLAKKVMGEMEPDAAKELTLCWTFFPREWFGFAWNIPGTGVYRMVKARNRMMKVLKETVLKKRASGEELGDFFKTIFGDTERGVKTISLESATEYIFTLFLLANETTPAVLAATIKLISDHPKVMQELQREHEGIVRDKIEKNEKADLTWEDYKSMTFTQMVINESLRITSTVPTVLRIIDHEFQFGEYTIPAGWIFMGYPYVHFNAEKYDDPLAFNPWRWKGKDLSAIVSRTYIPFGSGSRLCVGAEFVKLKMAIFIHHLSRYRWSMKTETTLLRRFVLILPRGSDVQILEDTKAK

SEQ ID NO: 20115 - protein, 241 aa, Arabidopsis thaliana
MAEASFYIGVIGNVISVLVFLSPVETFWKIVKRRSTEEYKSLPYICTLLGSSLWTYYGIVTPGEYLVSTVNGFGALVETIYVSLFLFYAPRHLKLKTVDVDAMLNVFFPIAAIVATRSAFEDEKMRSQSIGFISAGLNIIMYGSPLSAMKTVVTTKSVKYMPFWLSFFLFLNGAIWAVYALLQHDVFLLVPNGVGFVFGTMQLILYGIYRNAKPVGLSNGLSEIAQDEEEGLTSRVEPLLS

SEQ ID NO: 20116 - protein, 388 aa, Arabidopsis thaliana
MNCLFLFMSKKPKSRGNMEKEKKNIRGREFLQKSAPELTTRKTTLSFNLPTPRSLPSPTSIKDLYTDREQNQNQNLRVFSFKELSDATCEFSRKLKIGEGGFGSVYKATINNPTVGDSHSSPLTVAVKKLNRQSLQGHKQWLAEVHFLGVVNHPNVVRLLGYCSEDRERLLVYELMSNRSLEDHLFTLRTLTLSWKQRLEIMLGAAQGLAYLHEIQVIYRDFKSSNVLLNEEFHPKLSDFGLAREGPEGDNTHVTTARVGTDGYAAPEYVITGHLKTHCDVYSFGVVLYEIITGRRTLERMKPLAEQKLLEWVKKYPINSKRFKMIVDSKLCNKYPIAMVRRVAKLADHCVNKIDKERPTMAFVVESLTNIIEESNSEDMGSSVGIRG

SEQ ID NO: 20117 - protein, 352 aa, Arabidopsis thaliana
MGSRDLISSLPDEILGKVLSLLPTKRAASTAVLSKRWNNLPALVDKLDINDAIGGPGGFPEFIDKTLALLTNSTTIKRTSLNNEFQYGESQVNTWIRSFLERGCLQLYLNAQSLYTIDTEFFTSNTLVELTITGGFSPDGLLPPGGVFFPKLKTLSLVLMTFVDSDMYELFISGCPLLEEFLLRNDEIEIPPVWNALVSSPSIKRLTIVHHFPNYREAHDGCWFRTPNLVYLDYSSYVPDWYEVDLGSLVEARLDLRSWERLRDEKAGGYGDCDSVYDDEEYPDDPILGDVTNLVTGLSNIKTLHLSPDSLEVFYFCCKSMPVFHNLLTLSFESAKKEAGQCCHFSSISLLT

SEQ ID NO: 20118 - protein, 335 aa, Arabidopsis thaliana
MGSRDLISSLPDEILGKVLSLLPTKRAASTAVLSKRWNNLPALVDKLDINDAIGGPGGFPEFIDKTLALLTNSTTIKRTSLNNEFQYGESQVNTWIRSFLERGCLQLYLNAQSLYTIDTEFFTSNTLVELTITGGFSPDGLLPPGGVFFPKLKTLSLVLMTFVDSDMYELFISGCPLLEEFLLRNDEIEIPPVWNALVSSPSIKRLTIVHHFPNYREAHDGCWFRTPNLVYLDYSSYVPDWYEVDLGSLVEARLDLRSWERLRDEKAGGYGDCDSVYDDEEYPDDPILGDVTNLVTGLSNIKTLHLSPDSLEVSFPYLLLFQFEVHSSLQSLLIV

SEQ ID NO: 20119 - protein, 406 aa, Arabidopsis thaliana
MGCAQSTIAVVGRKNKKRIIQESVVFVLQFRVPVQSDLQRQLKGVSPKTTINRLTCLRNQIELVAEDTGGSAISELRTALEEYLSLLSGLIKKSKDGMEGCVELKWRTLGDGRRAEICCTNLWMEMLIVIHMMAALALTEANSLMIPKDCYASGSGNGVRVVSTDCRRDAVDLLLKASGYLEFCVREILTQLPHDIKSKLPDDMQESVLQTLSIQALGQGTEIQLGLAVDSQKATLSVKRRIACEQVIYFTQAYHCLSSCEAVSHGCAKKLLRFIYWKFLEAKVLYVYAAAYYYHGLVTDKGSEPACHLSAVCCFLAAAEILGESKKACLSFCLAPPVTRAPPMWGVMKHLSQKIPEVAFRKSQTYGYLLEEEEKAMQCLPELPDFQLSLRPDDFELPEIEDVSSS

SEQ ID NO: 20120 - protein, 397 aa, Arabidopsis thaliana
MEPSQRNTKPPSFSDSTIPVDSDGRATVFRPFSLSSPHSRAFHLAWLSLFSCFFSTFSIPPLVPVISSDLNLSASTVSAAGIASFAGSIFSRLAMGPLCDLIGPRTSSAILSFLTAPVILSASLVSSPTSFILVRFFVGFSLANFVANQYWMSSMFSGNVIGLANGVSAGWANVGAGISQLLMPLIYSTIAEFLPRAVAWRVSFVFPAIFQVTTAVLVLLYGQDTPHGNRKNSNQNKLTIPEEEEVLVVEEDERSSFVEILIGGLGNYRAWILALLYGYSYGVELTTDNVIAGYFYERFGVNLEAAGTIAASFGISNIASRPAGGMISDALGKRFGMRGRLWGLWIVQSVAGLLCVLLGRVNSLWGSILVMWVFSVFVQAASGLVFGVVPFVSTRLV

SEQ ID NO: 20121 - protein, 378 aa, Arabidopsis thaliana
MKKLLVTKLLGPQALERSRGIRADELERFHSSLLDKAVKKEIVEIGKEATKLSNNSLWRMSIGRSFSEKNGEAERVRGLVTELDGLTKKVLFATLLHRPLEKLGISLFKKEIMCVSDSFDEVLERVLVEHEQKLDDHQDRDMMDVLLAAYGDENAEHKISRNHIKAFFVELFFAGTDTSAQSIQWTMAEIINNPNILKRLREEIDSVVGKTRLIQETDLPKLPYLQAVVKEGLRLHPPLPLFVRTFQEGCKIGGFYVPEKTTLIGNAYVMMRDPSVWEDPEEFKPERFLSSSRSTQEEERREQALKYIPFGSGRRGCPGSSLGYIFVGTAVGMMVQCFDWSIKGDKVQMDEAGGLNLSMAHSLKCTPVPRNRPLLADQ

SEQ ID NO: 20122 - protein, 322 aa, Arabidopsis thaliana
MWFFGSKGASGFSSRSTAEEVTHGVDGTGLTAIVTGASSGIGVETARVLSLRGVHVVMAVRNTDSGAKVKEDIVKQVPGAKLDVMELDLSSMQSVRKFASEYKSTGLPLNLLINNAGIMACPFMLSKDNIELQFATNHLGHFLLTKLLLDTMKSTSRESKREGRIVNLSSEAHRFSYPEGVRFDKINDKSSYSSMRAYGQSKLCNVLHANELTKQLKEDGVNITANSLHPGAIMTNLGRYFNPYLAVAVGAVAKYILKSVPQGAATTCYVALNPQVAGVSGEYFQDSNIAKPLPLVKDTELAKKVWDFSTKLTDSQSGESSS

SEQ ID NO: 20123 - protein, 248 aa, Arabidopsis thaliana
MAQSCLKIVRINNLRNRVNRRILILRRFTRLLWSRIVACTPGKSRRYLLLSRALPSPTVSRPSPSPIPAVDVVVGGGGGGGEFVRRSSVVYDNDNSHRRSDSDLVSLKISLLGDPEIGKTSFLAKYVGEEKEVEMRELEKGINCTDKTLYMGGARISYSIWELEAERSRDQIPVACKDSVAILFMFDLTSRCTLNSVISWYQQARKSNQTAIPVMVGTKFDEFIQLPIDLQWTIASQVMFLTISFEVI

SEQ ID NO: 20124 - protein, 381 aa, Arabidopsis thaliana
MEEDRAILTFHRIPSLNSSLITTSSPAKSGAEQFRRRVLRNPARGDFGLGRFACISLVEKCEQREFAPTTAQLLNNPLAILALVPKDAAIFAAGALAGAAAKTVTAPLDRIKLLMQTHGIRLGQQSAKKAIGFIEAITLIAKEEGVKGYWKGNLPQVIRVLPYSAVQLLAYESYKNLFKGKDDQLSVIGRLAAGACAGMTSTLLTYPLDVLRLRLAVEPRYRTMSQVALSMLRDEGIASFYYGLGPSLVGIAPYIAVNFCIFDLVKKSLPEEYRKKAQSSLLTAVLSAGIATLTCYPLDTVRRQMQMRGTPYKSIPEAFAGIIDRDGLIGLYRGFLPNALKTLPNSSIRLTTFDMVKRLIATSEKQLQKISDDNRNRDQAQ

SEQ ID NO: 20125 - protein, 465 aa, Arabidopsis thaliana
MSKEEFMKIQTCVLKVNIHCDGCKQKVKKILQKIEGVFTTKIDAELGKVTVSGNVDPSVLIKKLLKSGKHAEIWGAPKGGSNNNQNQPNLANQFKAMQIDHGGKGGGGGGGGPANNNKGQKIGGGGGGGGGGGGGGGGGPPKMVIPQLTPQQMQQLNPQQLQQLQQLQQMKGFQDLKLPPQLKGGPGPGPGSVPMNKNPQMPNNPNQKAVKFNVPDDDDEEDFSDEFDDEFDEDDDEFDDDLEDDEFDDHPPPPNKMKPMMGGGNMIMPNNMMPNMMMPNAQQMLNAHKNGGGGGGPQSMSMPMGGAMGGPMGSLPQMGGGPGPMSNNMQAVQGLPAMGPGGGGGGGPSAEAPPGYFQGQVSGNGGGGQDSMPGNPYLQQQQQQQQQQYLAAVMNQQRSMGNERFQPMMYARPPPAVNYMPPQPQPHQQHPYPYPYPYPPQYPPHNGDQYSDYFNDENTSSCNIM

SEQ ID NO: 20126 - protein, 326 aa, Arabidopsis thaliana
MDQAKGKVCVTGASGFLASWLVKRLLLEGYEVIGTVRDPGNEKKLAHLWKLEGAKERLRLVKADLMEEGSFDNAIMGCQGVFHTASPVLKPTSNPEEEILRPAIEGTLNVLRSCRKNPSLKRVVLTSSSSTVRIRDDFDPKIPLDESIWTSVELCKRFQVWYALSKTLAEQAAWKFSEENGIDLVTVLPSFLVGPSLPPDLCSTASDVLGLLKGETEKFQWHGQMGYVHIDDVARTHIVVFEHEAAQGRYICSSNVISLEELVSFLSARYPSLPIPKRFEKLNRLHYDFDTSKIQSLGLKFKSLEEMFDDCIASLVEQGYLSTVLP

SEQ ID NO: 20127 - protein, 331 aa, Arabidopsis thaliana
MTSLPYADADCSLRALAGRAEGFGRFAVGGLHGDLYVVTSLADDGPGTLREGGRRKEPLWIVFAVSGTINLNSYLSVSSYKTIDGRGQRIKLTGKGIRLKECEHIIICNLEFEGGRGHDVDGIQIKPKSRHIWIDRCSLRDYDDGLIDITRQSTDITVSRCYFAQHDKTMLIGADPSHVEDRCIRVTIHHCFFDGTRQRQPRLRFGKVHLYNNYTRNWGIYAVCASVEAQVFSQCNIYEAGVKKKTFEYYSEKAADKEEARTGLVRSENDLFLNGAQPSLMTGASEECVFHPSEHYPTWTVEPPSETLKQIMQICTGWQSLSRPSDHGVPK

SEQ ID NO: 20128 - protein, 401 aa, Arabidopsis thaliana
MRGRSLTLSRVKLELARRSMSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 20129 - protein, 446 aa, Arabidopsis thaliana
MDFSGLFLTLSAAALFLCLLRFIAGVRRSSSTKLPLPPGTMGYPYVGETFQLYSQDPNVFFAAKQRRYGSVFKTHVLGCPCVMISSPEAAKFVLVTKSHLFKPTFPASKERMLGKQAIFFHQGDYHSKLRKLVLRAFMPDAIRNMVPHIESIAQESLNSWDGTQLNTYQEMKTYTFNVALISILGKDEVYYREDLKRCYYILEKGYNSMPINLPGTLFHKAMKARKELAQILANILSKRRQNPSSHTDLLGSFMEDKAGLTDEQIADNIIGVIFAARDTTASVLTWILKYLADNPTVLEAVTEEQMAIRKDKKEGESLTWEDTKKMPLTYRVIQETLRAATILSFTFREAVEDVEYEGYLIPKGWKVLPLFRNIHHNADIFSDPGKFDPSRFEVAPKPNTFMPFGSGIHSCPGNELAKLEISVLIHHLTTKYRLVHLQNDNSPFGN

SEQ ID NO: 20130 - protein, 420 aa, Arabidopsis thaliana
MSSLPLRSGEKMESPSISDAVPLHAPEDATADFSQPQSPLHEVDSFPVTESSDDVVVNVSEIPNLSPSDDDFDHERNSGEDRDQDHGENPVETDGVVVPIDELNQKIIRQVEYYFSDENLPTDKFLLNAMKRNKKGFVPISTIATFHKMKKLTRDHALIVSALKESSFLVVSADEKKVKRLSPLPEIRDPKIFTVLVENLPEDHSNENIREIFGKAGSIKSVSICDPNAVEESEKGGKKENFIRTRLHAFVEYETVEAAEKAAATLNNEQDWRNGLRVKLLEQAAGKFAQRRPARREVDKEKDTTGRVHDQTGGEKNKKTREHQNHRLHHSDNPADDDGGNHQKDKNGNKGRVVGQGRRQNHQGGNGHGTASSSSHPNYHPVEVSKRPPGPRMPDGTRGFTMGRGKAIPPPTSTQTSHEV

SEQ ID NO: 20131 - protein, 325 aa, Arabidopsis thaliana
MSSEEEKTVCVTGASGYIASWIVKLLLLRGYTVKASVRDPNDPRKTEHLLALEGAEERLKLFKANLLEEGSFDSAIDGCEGVFHTASPFYHDVKDPQAELLDPAVKGTINVLSSCLKTSSVKRVVLTSSIAAVAFNGMPRTPETIVDETWFADPDYCRASKLWYVLSKTLAENAAWKFAKENNLQLVSINPAMVIGPLLQPTLNTSAAAVLSLIKGAQTFPNATFGWVNVKDVANAHIQAFENPDADGRYCLVERVAHYSEVVNILHDLYPDFQLPEKCADEKIYIPTYKVSKEKAESLGVEFVPLEVSIKETVESLRDKGFIRF

SEQ ID NO: 20132 - protein, 269 aa, Arabidopsis thaliana
MYNNMGPRPGMAMPQANPQPSPFGNPFSGPGSGLIRSGLGAYGEKIFGSSSEYVQSNISRYFSDPQYYFQVNDQYVRNKLKIVLLPFLHRGHWTRISEPVGGRLSYKPPIYDINAPDLYIPLMAFGTYVVLAGLSLGLYGKFTPEALNWLFVKGMVGWFLQVMLLKITLLSLGSGEAPLLDIVAYAGYTFTGLCLAVLGKIIWGYSYYVLIPWTCLCTGVFLVKTMKRVLFAESRSYDSSRHHYLLIFVALAQFPLLIWLGNISVNWLF

SEQ ID NO: 20133 - protein, 477 aa, Arabidopsis thaliana
MSFVWSAAVWVIAVAAVVISKWLYRWSNPKCNGKLPPGSMGLPIIGETCDFFEPHGLYEISPFVKKRMLKYGPLFRTNIFGSNTVVLTEPDIIFEVFRQENKSFVFSYPEAFVKPFGKENVFLKHGNIHKHVKQISLQHLGSEALKKKMIGEIDRVTYEHLRSKANQGSFDAKEAVESVIMAHLTPKIISNLKPETQATLVDNIMALGSEWFQSPLKLTTLISIYKVFIARRYALQVIKDVFTRRKASREMCGDFLDTMVEEGEKEDVIFNEESAINLIFAILVVAKESTSSVTSLAIKFLAENHKALAELKREHAAILQNRNGKGAGVSWEEYRHQMTFTNMVINETLRMANMAPIMYRKAVNDVEIKGYTIPAGWIVAVIPPAVHFNDAIYENPLEFNPWRWEGKELRSGSKTFMVFGGGVRQCVGAEFARLQISIFIHHLVTTYDFSLAQESEFIRAPLPYFPKGLPIKISQSL

SEQ ID NO: 20134 - protein, 2208 aa, Arabidopsis thaliana
MSAASSSSVLHLRTNQQLLSLRSLKNSTSVASQLAVTSGVSRRRSCTARCSVKKPVIPESPFLGTRVRRSGSETLQFWRSDGPGRSAKLRTVVKSSFSAVPEKPLGLYDPSYDKDSCGVGFVAELSGETTRKTVTDSLEMLIRMTHRGACGCESNTGDGAGILVGLPHDFYAEAATELGFVLPSAGNYAVGMFFLPTVESRREESKNVFTKVAESLGHSVLGWRLVPTDNSGLGNSALQTEPIIAQVFLTPTTKSKADFEQQMYILRRVSMVAIRAALNLQHGAMKDFYICSLSSRTIVYKGQLKPDQLKDYYYADLGSERFTSYMALVHSRFSTNTFPSWDRAQPMRVLGHNGEINTLRGNVNWMRAREGLLKCNELGLSKKELKKLLPIVDVSSSDSGAFDGVLELLVRAGRSLPEAVMMMIPEAWQNDKNIDPSRKEFYEYLSALMEPWDGPALISFTDGRYLGATLDRNGLRPGRFYITHSGRVIMASEVGVVDVPPEDVMRKGRLNPGMMLLVDFEKHIVVDDDALKQQYSLARPYGEWLKRQKIELKDIIESVPEAERIAPSISGVVPASNDDDSMESMGIHGLLSPLKAFGYTVEALEMLLLPMAKDGSEALGSMGNDTPLAVMSNREKLCFEYFKQMFAQVTNPPIDPIREKIVTSMECMIGPEGDLTETTEEQCHRLSLKGPLLKIEEMEAIKKMNYRGWRTKVLDITYAKERGTKGLEETLDRICDEANEAIKEGYTLLVLSDRAFSATRVAVSSLMAVGAVHHHLVKTLARTQVGLVVESAEPREVHHFCTLVGFGADAICPYLAVEAVYRLQVDGKIPPKSNGEFHSKEELVKKYYKASNYGMMKVLAKMGISTLASYKGAQIFEALGLSSEVIQKCFAGTPSRVEGATFEMLARDGLQLHELAFPTRGYAPGSAEASALTNPGNYHWRKNGEIHLNDPLAIAKLQEAARTNSVAAYKEYSKRINELNKQSNLRGLMKFKDADVKIPLDEVEPASEIVKRFCTGAMSYGSISLEAHTTLAMAMNKLGGKSNTGEGGELPSRMEPLADGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTVTEMIGRADMLELDREVVKNNDKLENIDLSLLLRPAAEIRPGAAQYCVQKQDHGLDMALDQELIALSKSALEKSLPVYIETPICNVNRAVGTMLSHEVTKRYHLTGLPKDTIHIKFTGSAGQSLGAFLCPGIMLELEGDSNDYVGKGLSGGKVVVYPPKGSSFDPKENIVIGNVALYGATSGEAYFNGMAAERFSVRNSGAKAVVEGLGDHGCEYMTGGTVVVLGKTGRNFAAGMSGGIAYVLDVDGKFNTRCNLELVDLDKVEDEEDKMTLKMMIQQHQRHTNSQLAQEVLADFENLLPKFIKVFPRDYKRVLSAMKHEEVSKQAIERASEEADETEEKELEEKDAFAELKNMAAASSKEEMSGNGVAAEARPSKVDNAVKNGGFIAYEREGVKYRDPNVRLNDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 20135 - protein, 450 aa, Arabidopsis thaliana
MAPALSPTRSHHVAVIGAGPAGLVAARELRREGHSVVVFEKQKQVGGTWIYTDEVESDPLSVDPTRSVVHSSVYRSLRINGTRECTGYRDFPFVVRSGVSRDPRRFPSHGEVLAYLKDFAKEFGIEEMVRFETEVVKVSPAAEEGIGKWRIESTEKEKKVRRDEIYDAVVVCNGHYVEPRLAQIPGISSWPGKEMHSHNYRIPEPFRDKVVVLIGNSSSAEDISRDIARVAKEVHVACRSNPADTFIKQTGYNNLWTHSMIESVHEDGSVVYQNGKTISVDIIMHCTGYKYHFPFLDTNGIVTVDDNRVGPLYKDVFPPAFAPWLSFIGIPWQVLPFPMFELQSKWIAGVLSGRIPLPSKEDMMIEIKTFYSTLEVQGIPKRYTHRMGNTQFEYYNWLASQCGCSETEEWRKEMCLANGVRKEAHPETYRDEWDDHHLVSEAYQDFSLYS

SEQ ID NO: 20136 - protein, 1483 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPETAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLVERRRLFCEISMKLYPRTSSGLFSLQSLLKSGFSPTLNSIDRFLRYLYRLQKFNCILQFYSQLDSKQININHRIYSIVSWAFLNLNRYEDAEKFINIHISKASIFPRTHMLDSLIHGFSITRDDPSKGLLILRDCLRNHGAFPSSLTFCSLIYRFVEKGEMDNAIEVLEMMTNKNVNYPFDNFVCSAVISGFCKIGKPELALGFFESAVDSGVLVPNLVTYTTLVSALCQLGKVDEVRDLVRRLEDEGFEFDCVFYSNWIHGYFKGGALVDALMQDREMVEKGMNRDVVSYSILIDGLSKEGNVEEALGLLGKMIKEGVEPNLITYTAIIRGLCKMGKLEEAFVLFNRILSVGIEVDEFLYVTLIDGICRKGNLNRAFSMLGDMEQRGIQPSILTYNTVINGLCMAGRVSEADEVSKGVVGDVITYSTLLDSYIKVQNIDAVLEIRRRFLEAKIPMDLVMCNILLKAFLLMGAYGEADALYRAMPEMDLTPDTATYATMIKGYCKTGQIEEALEMFNELRKSSVSAAVCYNRIIDALCKKGMLDTATEVLIELWEKGLYLDIHTSRTLLHSIHANGGDKGILGLVYGLEQLNSDVCLGMLNDAILLLCKRGSFEAAIEVYMIMRRKGLTVTFPSTILKTLVDNLRSLDAYLLVVNAGETTLSSMDVIDYTIIINGLCKEGFLVKALNLCSFAKSRGVTLNTITYNSLINGLCQQGCLVEALRLFDSLENIGLVPSEVTYGILIDNLCKEGLFLDAEKLLDSMVSKGLVPNIIIYNSIVDGYCKLGQTEDAMRVVSRKMMGRVTPDAFTVSSMIKGYCKKGDMEEALSVFTEFKDKNISADFFGFLFLIKGFCTKGRMEEARGLLREMLVSESVVKLINRVDAELAESESIRGFLVELCEQGRVPQAIKILDEISSTIYPSGKNLGSYQRLQFLNDVNEEEIKKKDYVHDFHSLHSTVSSLCTSGKLEQANEFVMSVLSCMPR

SEQ ID NO: 20137 - protein, 415 aa, Arabidopsis thaliana
MGLSLRVRRRGGSVSKKEIIPVTSCSEEVEITIPSQFQCPISYELMKDPWFESGYQTCPVTNTVLTSLEQIPNHTIRRMIQGWCGSSLGGGIERIPTPRVPVTSHQVSEICERLSAATRRGDYAACMEMVTKMTRLGKESERNRKCVKENGAGLVLCVCFDAFSENANASLLLEETVSVLTWMLPIGLEGQSKLTTTSSFNRLVELLRNGDQNAAFLIKELLELNVTHVHALTKINGVQEAFMKSINRDSTCVNSLISIHHMILTNQETVSRFLELDLVNITVEMLVDSENSVCEKALTVLNVICETKEGREKVRRNKLVIPILVKKILKISEKKDLVSVMWKVCKSGDGSEVEEALRLGAFKKLVVMLQVGCGEGTKEKVTELLKMMNKVMKMNGFVDRSYSSSIEFKHVKKPF

SEQ ID NO: 20138 - protein, 319 aa, Arabidopsis thaliana
MNGEGKVVCVTGASGYIASWIVKLLLLRGYTVRATVRNPMDTKKTNHLLTLEGASERLKLFKSDLLEEGSFDQAIEGCDGVFHTASPVSLTVTDPQTEMIDPAVNGTLNVLRTCAKVSSVKRVIVTSSTAATLSINPNDVVDETVFTDLSVYLAMKAWYGYSKTLAEETAWRFAKENGIDLVVMNPGNVIGPVLQPTLNYSVEVIVDLINGKNPSNSFYYRFMDVRDVSLAHIKAFEVPSASGRYILADPDVTMKDIQKLLHELFPDLCRVDKDNENEVGEMAYKVCVDKLKSLGIEFTPIKESLKDTVVSLKERCLLI

SEQ ID NO: 20139 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 20140 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKVWVIGSYGGRARQDLPKVVKLAESGIFNLTNAVSSKYKFEDAGKAFQDLNEGKIVSRGVVEIL

SEQ ID NO: 20141 - protein, 414 aa, Streptomyces rochei
MLRQEAPYVIDSAGRDLPGEAARLRERGPVVRVVLPGGVSAWAVTDLDLIKQLLTDSRASKDAYRHWPAWAGGEVDESWQMSMWVSVRNMLTAYGEEHARLRRLVAGAFTARRTADLRPRVERITARLLDGLAAVPPGAAVDVRNEFARPLSVLVMGETLGLPEDLHADLQRMVDVLFKTTAEPEEARANQYELYALLTELVAARRSAPGTDLTSELIAARDEDGGEGLSEKELVDTLLLLIGAGTETTVNLIDQAVHGLITHPAQLALVLGGEATWDSVIDETLRHQPVVANVPFRFAVEDIEVGGVTIPKGDPILLSLAAAARCPHRHGADADQFDVARPSRRDHVPFGYGVHHCVGRPLARLEVSIALESLFARYPRMAAAVPEAELAVRESFISSGHVALPVVLVPGAAA

SEQ ID NO: 20142 - protein, 313 aa, Streptomyces rochei
MPVPAVDPEIRTLLETADTGIFPVYGLDAVLADPQPYALLRAYPDTPADDQVTVLDLHIPGPAGGDLRVRVYRPDTTEVLPVILYITRRRLHYGSPEAEEGRSLRYARDARAVVVSVDYRLAPEHPYPAAADDAYAALIWIAANPAELGGDRARIAVAGGSAGGNIAASTVLRARDQAGPHILFQLLTYPGVDGSLTSASVREFTDTPVLNRGAMELAWQYYAKDTHPHPYASPIRATDLGALPPTYIAVAEIDPLRDEGRDYAARLSAAGVTTELVQVPGAVHGFDILFPSARISERSLADQVRALHDALHP

SEQ ID NO: 20143 - protein, 299 aa, Arabidopsis thaliana
METQYPKLIEPSKTRIGWIGIGIMGSAMVSHILAAGYSVTVYARDLRKTKDLQTKGGRTANSPKELGEMSDVVFTIVGNSNDVRSLLLGDDGVLSGLKPGGVTVDMTSSKPGLAREIYAEARRRDCWAVDAPVSGGDAGAREGKLTIFAGGDSEIVEWLAPVMKTMGIVRFMGGAGSGQSCKIGNQICVGSNMIGLAEGIVFAEKAGLDPVKWLEAVKDGAAGSAVMRLFGEMMAVRDYKATGFAEYMVKDLGMAAEAAMAMPGTALNKQLFTVMVANGDGKLGFQGVVDVIRRLNGLS

SEQ ID NO: 20144 - protein, 379 aa, Arabidopsis thaliana
MVKETVYYDVLGVTPSASEEEIRKAYYIKARQVHPDKNQGDPLAAEKFQVLGEAYQVLSDPVHREAYDRTGKFSAPKETMVDPTAVFALLFGSELFEDYIGHLAVASMASTQMASEIENSDQFQDKLKAVQKEREENLSRFLKDFLSQYVHGDKEGFISRAESEAKRLSDAAFGADMLHTIGYVYTRQAAQELGKRALYLGVPFVAEWVRNKGHSWKSQISAAKGALQLLQLQEESNRRLKKDGTSPANELESHIQTNKETLMGSLWKLNVVDIEVTLLHVCQMVFRENNLRKEELKSRAMALKILGKIFQQEKQSKNGTTSRKEDEDSDDDDSSSDDDSSQPLSYRTPLLTQGIGRLFRCLCNPAFDVDDDEIVYKGK

SEQ ID NO: 20145 - protein, 347 aa, Zea mays
MAFAPKTSSSSSLSSALQAAQSPPLLLRRMSSTATPRRRYDAAVVVTTTTTARAAAAAVTVPAAPPQAPAPAPVPPKQAAAPAERRSRPVSDTMAALMAKGKTAFIPYITAGDPDLATTAEALRLLDGCGADVIELGVPCSDPYIDGPIIQASVARALASGTTMDAVLEMLREVTPELSCPVVLLSYYKPIMSRSLAEMKEAGVHGLIVPDLPYVAAHSLWSEAKNNNLELVLLTTPAIPEDRMKEITKASEGFVYLVSVNGVTGPRANVNPRVESLIQEVKKVTNKPVAVGFGISKPEHVKQIAQWGADGVIIGSAMVRQLGEAASPKQGLRRLEEYARGMKNALP

SEQ ID NO: 20146 - protein, 474 aa, Microbispora rosea subsp. aerata
MSRRAKIVCTLGPATSSPERLRELIKAGMNVARFNLSHGSHELHKEVFDRVRAAADELGCAVGVLADLQGPKIRVGRFASGPVRLGYGDVFTITTEDVPGDRDIVSTTYEGLPGDVKPGDTILVDDGRLNLEVTAVDGPRVVTKVVIGGMISDNKGLNLPGVAVSAPALTEKDEEDLRWALRTGFDMIALSFVRCPDALVRAIMEEEGVRLPLLAKIEKPQAVERLEEIVDTFDGVMVARGDLGVELPLEQVPIVQRRIIDLCREKAHPVIVATQMLDSMMSSPRPTRAEASDVAYAVMDGADAVMLSGETSVGNYPVEAVSTMARIASPRRATRCRPPTPWTACPRPPAAHRPRGAEVGAIVGAKALVAYTMSGETARRLARYRSPIPLLAFTSNPLVRGQLALTWGVETFEVPFVHHTDDMVRQVEASLLSLGICEKGDKVVVVAGSPPGNHGSTNSLRVHTIGSAVAHPAV

SEQ ID NO: 20147 - protein, 470 aa, Arabidopsis thaliana
MAAEKIETVVAGNYLEMEREEENISGNKKSSTKTKLSNFFWHGGSVYDAWFSCASNQVAQVLLTLPYSFSQLGMMSGILFQLFYGLMGSWTAYLISVLYVEYRTRKEREKFDFRNHVIQWFEVLDGLLGKHWRNLGLIFNCTFLLFGSVIQLIACASNIYYINDKLDKRTWTYIFGACCATTVFIPSFHNYRIWSFLGLAMTTYTSWYLTIASLLHGQAEDVKHSGPTTMVLYFTGATNILYTFGGHAVTVEIMHAMWKPQKFKAIYLLATIYVLTLTLPSASAVYWAFGDKLLTHSNALSLLPKTGFRDTAVILMLIHQFITFGFASTPLYFVWEKLIGVHETKSMFKRAMARLPVVVPIWFLAIIFPFFGPINSAVGSLLVSFTVYIIPALAHMLTFAPAPSRENAVERPPRVVGGWMGTYCINIFVVVWVFVVGFGFGGWASMVNFVRQIDTFGLFTKCYQCPPHKP

SEQ ID NO: 20148 - protein, 401 aa, Arabidopsis thaliana
MATKRSVGTLKEADLKGKSVFVRVDLNVPLDDNSNITDDTRIRAAVPTIKYLMGNGSRVVLCSHLGRPKGVTPKYSLKPLVPRLSELLGVEVVMANDSIGEEVQKLVAGLPEGGVLLLENVRFYAEEEKNDPEFAKKLAALADVYVNDAFGTAHRAHASTEGVAKFLKPSVAGFLMQKELDYLVGAVANPKKPFAAIVGGSKVSTKIGVIESLLNTVDILLLGGGMIFTFYKAQGLSVGSSLVEEDKLDLAKSLMEKAKAKGVSLLLPTDVVIADKFAPDANSKIVPATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELLEGKPLPGVLALDEA

SEQ ID NO: 20149 - protein, 418 aa, Arabidopsis thaliana
MYALILHGRRLVQLQKWCNFSLSVQKASPTSNFFSSASAACLSPRVGRKGNNFTVSYLVDSLGLTTKLAESISRKVSFEDKNNPDSVLNLLTSHGFTGSQISTIIRDYPQLLIADAEKSLGPKLQFLQSRGASSSEITEIVSSVPEILGKKGHKTISVYYDFIKDTLLEKSSKNEKLCHSLPQGNLENKIRNVSVLRELGMPHKLLFSLLISDSQPVCGKEKFEETLKKVVEMGFDPTTSKFVEALQVIYKMNEKTIEEKVHLYKSLGFDVGDVWSSFKKWPISLRVSEKKMLDSIETFLGLGFSRDEFAKMVKHFPPCIGLSTETVKKKTEFLVKKMNWPLKAVVSNPAVFGYSLEKRIVPRGNVIKALMSKGLMRNELPSISCVLMCTKQVFLNRYVANHVDKQLVTELMAIYRAS

SEQ ID NO: 20150 - protein, 465 aa, Calycanthus occidentalis
VGFKAGVKDYKLTYYTPDYETKDTDILAAFRVTPQPGVPAEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYTKTFLGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSMPGVLPVASGGIHVWHMPALTEIFGDDSVLQFGGGTLGHPWGNAPGAVANRVALEACVQARNEGRNLAREGNEIIREASKWSPELAAACEVWKEIKFEFEAMDTL

SEQ ID NO: 20151 - protein, 511 aa, Geobacillus stearothermophilus
MSKKPVALIILDGFALRDETYGNAVAQANKPNFDRYWNEYPHTTLKACGEAVGLPEGQMGNSEVGHLNIGAGRIVYQSLTRINIAIREGEFDRNETFLAAMNHVKQHGTSLHLFGLLSDGGVHSHIHHLYALLRLAAKEGVKRVYIHGFLDGRDVGPQTAPQYIKELQEKIKEYGVGEIATLSGRYYSMDRDKRWDRVEKAYRAMVYGEGPTYRDPLECIEDSYKHGIYDEFVLPSVIVREDGRPVATIQDNDAIIFYNFRPDRAIQISNTFTNEDFREFDRGPKHPKHLFFVCLTHFSETVAGYVAFKPTNLDNTIGEVLSQHGLRQLRIAETEKYPHVTFFMSGGREEEFPGEDRILINSPKVPTYDLKPEMSAYEVTDALLKEIEADKYDAIILNYANPDMVGHSGKLEPTIKAVEAVDECLGKVVDAILAKGGIAIITADHGNADEVLTPDGKPQTAHTTNPVPVIVTKKGIKLRDGGILGDLAPTMLDLLGLPQPKEMTGKSLIVK

SEQ ID NO: 20152 - protein, 329 aa, Cryphonectria parasitica
  misc_feature (54)..(54): Xaa can be any naturally occurring amino acid
STGSATTTPIDSLDDAYITPVQIGTPAQTLNLDFDTGSSDLWVFSSETTASEVXQTIYTPSKSTTAKLLSGATWSISYGDGSSSSGDVYTDTVSVGGLTVTGQAVESAKKVSSSFTEDSTIDGLLGLAFSTLNTVSPTQQKTFFDNAKASLDSPVFTADLGYHAPGTYNFGFIDTTAYTGSITYTAVSTKQGFWEWTSTGYAVGSGTFKSTSIDGIADTGTTLLYLPATVVSAYWAQVSGAKSSSSVGGYVFPCSATLPSFTFGVGSARIVIPGDYIDFGPISTGSSSCFGGIQSSAGIGINIFGDVALKAAFVVFNGATTPTLGFASK

SEQ ID NO: 20153 - protein, 510 aa, Arabidopsis thaliana
MSNIDIEGILKELPNDGRIPKTKIVCTLGPASRTVSMIEKLLKAGMNVARFNFSHGSHEYHQETLDNLRSAMHNTGILAAVMLDTKGPEIRTGFLKDGNPIQLKEGQEITITTDYDIQGDESTISMSYKKLPLDVKPGNTILCADGSISLAVLSCDPESGTVRCRCENSAMLGERKNVNLPGVVVDLPTLTDKDIEDILGWGVPNSIDMIALSFVRKGSDLVNVRKVLGSHAKSIMLMSKVENQEGVINFDEILRETDAFMVARGDLGMEIPIEKIFLAQKLMIYKCNLAGKPVVTATQMLESMIKSPRPTRAEATDVANAVLDGTDCVMLSGESAAGAYPEIAVKVMAKICIEAESSLDYNTIFKEMIRATPLPMSPLESLASSAVRTANKARAKLIIVLTRGGSTANLVAKYRPAVPILSVVVPVMTTDSFDWSCSDESPARHSLIYRGLIPMLAEGSAKATDSEATEVIIEAALKSATQRGLCNRGDAIVALHRIGAASVIKICVVK

SEQ ID NO: 20154 - protein, 255 aa, Arabidopsis thaliana
MADGISSFWGPVTSTIECCEMNYAYSSYIAEFYNTISNVPGILLALIGLVNALRQRFEKRFSILHISNMILAIGSMLYHATLQHVQQQSDETPMVWEILLYMYILYSPDWHYRSTMPTFLFLYGAAFAIVHAYLRFGIGFKVHYVILCLLCIPRMYKYYIHTEDTAAKRIAKWYVATILVGSICWFCDRVFCKTISQWPVNPQGHALWHVFMSFNSYCANTFLMFCRAQQRGWNPKVKYFLGVLPYVKIEKPKTQ

SEQ ID NO: 20155 - protein, 191 aa, Schizosaccharomyces pombe [sequence omitted]

SEQ ID NO: 20156 - protein, 315 aa, Betula pendula
MENFPVINMEKLNGDERGATMAKINDACENWGFFELVNHSIPHEFLDNLERLAKEHYKKCLEQRFKEMVASKALEGAKAEVNDMDWESTFHVRHLPQSNISEIPDLEDEYRNVLKEFALKLEKLAEELLDLLCENLGLEKGYLKNAFYGSNGPTFGTKVSNYPPCPKPDLIKGLRAHTDAGGIILLFQDDKVSGLQLLKDGQWIDVPPMRHSIVINLGDQLEVITNGKYKSILHRVIAQTDGNRMSIASFYNPGSDAVIYPAPSMVEKETEEKNVYPKFVFEDYMKLYAGLKFQAKEPRFEAMKANGKLGPIATA

SEQ ID NO: 20157 - protein, 295 aa, Gossypium hirsutum
MMPSVNPDQSDKDSEPFVEADPTGRYGRYTELLGSGAVKKVYRAFDQEEGIEVAWNQVKLRNFSDDPAMIDRLYSEVRLLRSLTNNNIISLYSFWRDEEHNTLNFITEVCTSGNLREYRKKHRQVSMKALKKWSKQILKGLNYLHSHEPCIIHRDLNCSNVFVNGNTGQVKIGDLGLAAIVGKNHSAHSILGTPEFMAPELYDEHYTELIDIYSFGMCVLEIVTLEIPYSECDNVAKIYKKVSSGVKPQALDKVRDADMRAFIERCIAQPGERPSAAELLKDPFYDEVDDYDENV

SEQ ID NO: 20158 - protein, 228 aa, Gossypium sturtianum
FTSLCHTDVYFWEAKGQTPLFPRIFGHEAGGIVESVGEGVAHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVE

SEQ ID NO: 20159 - protein, 228 aa, Gossypium robinsonii
FTSLCHTDVYFWEAKGQTPLFPRIFGHEAGGIVESVGEGVAHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQKVLAEMTNGGVDRSVE

SEQ ID NO: 20160 - protein, 228 aa, Gossypium bickii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVE

SEQ ID NO: 20161 - protein, 228 aa, Gossypium bickii
  misc_feature (174)..(175): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARXXGASRIIGVDLNPNRFEEAKKFGCTEFVNPKDHNKPVQEVLAEMTNGGVDRSVE

SEQ ID NO: 20162 - protein, 227 aa, Gossypium bickii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSV

SEQ ID NO: 20163 - protein, 228 aa, Gossypium nelsonii
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAEINPAAPLDKVCILSCGISTGLGAALNVAKPTKGSTVAIFGLGAVGLAAAEGARIAGASRIIGVDLNPNRFEEAKKFGCTEFVNPNDHNKPVQEVLAEMTNGGVDRSVE

SEQ ID NO: 20164 - protein, 228 aa, Gossypium australe
  misc_feature (178)..(193): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAASLDKVCILSCGISTGLGAALNVAKPTKGSTVAIFGLGAVGLAAAEGARIAGAXXXXXXXXXXXXXXXXKKFGCTEFVNPNDHNKPVQEVLAEMTNGGVDRSVE

SEQ ID NO: 20165 - protein, 228 aa, Gossypium australe
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGAALNVAKPTKGSTVAIFGLGAVGLAAAEGARIAGASRIIGVDLNPNRFEEAKKFGCTEFVNPNDHNKPVQEVLAEMTNGGVDRSVE

SEQ ID NO: 20166 - protein, 228 aa, Gossypium australe
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAASLDKVCILSCGISTGLGAALNVAKPTKGSTVAIFGLGAVGLAAAEGTRIAGASRIIGVDLNPNRFEEAKKFGCTEFVNPNDHNKPVQEVLAEMTNGGVDRSVE

SEQ ID NO: 20167 - protein, 228 aa, Gossypium anapoides
  misc_feature (133)..(133): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCIXSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 20168 - protein, 228 aa, Gossypium costulatum
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHAGSVAKINPAAPLDKVCILSCGISTGLGATLNVAKPAKGSTVAIFGLGAVGLAAAEGARIAGAFRIIGVDLNPNRFEEAKKFGCTEFVNPKDHNKPVQEVLAEMTNGGVDRSVE

SEQ ID NO: 20169 - protein, 228 aa, Gossypium costulatum
  misc_feature (129)..(129): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDXVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 20170 - protein, 228 aa, Gossypium costulatum
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPVAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 20171 - protein, 228 aa, Gossypium cunninghamii
FTSLCHTDVYFWEAKGQTPLFPRIFGHEAGGIVESVGEGVTHLKPGDHALPVFTGECGNCRHCKSKESNMCGLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 20172 - protein, 197 aa, Gossypium marchantii
IVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 20173 - protein, 228 aa, Gossypium nobile
  misc_feature (93)..(93): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSXNGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 20174 - protein, 228 aa, Gossypium pilosum
  misc_feature (200)..(200): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTXFVNPKDHNKPVQEVLAEMTNGGVDRSVE

SEQ ID NO: 20175 - protein, 228 aa, Gossypium pilosum
  misc_feature (152)..(152): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAXGSTVAIFGLGAVGLAAAEGARIAGASRIIGVDLNPNRFEEAKKFGCTEFVNPKDHNKPVQEVLAEMTNGGVDRSVE

SEQ ID NO: 20176 - protein, 228 aa, Gossypium pilosum
  misc_feature (95)..(95): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINXKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 20177 - protein, 228 aa, Gossypium populifolium
  misc_feature (115)..(115): Xaa can be any naturally occurring amino acid
  misc_feature (178)..(178): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHXGSVAKINPAAPLDKVCILSCGISTGLGATLNVAKPAKGSTVAIFGLGAVGLAAAEGARIAGAXRIIGVDLNPNRFEEAKKFGCTEFVNPKDHNKPVQEVLAEMTNGGVDRSVE

SEQ ID NO: 20178 - protein, 228 aa, Gossypium populifolium
  misc_feature (195)..(195): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKXFGCTEFVNPKDHNKPVQEVLAEMTNGGVDRSVE

SEQ ID NO: 20179 - protein, 197 aa, Gossypium populifolium
  misc_feature (42)..(42): Xaa can be any naturally occurring amino acid
IVESVGEGVTHLKPGDHVLPVFTGECGNCRHCKSKESNMCDXLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 20180 - protein, 228 aa, Gossypium populifolium
  misc_feature (115)..(115): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHXGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 20181 - protein, 228 aa, Gossypium pulchellum
  misc_feature (178)..(178): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGAXRIIGVDLNPNRFEEAKKFGCTEFVNPKDHNKPVQEVLAEMTNGGVDRSVE

SEQ ID NO: 20182 - protein, 228 aa, Gossypium rotundifolium
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPPKGSTVAIFGLGAVGLAAAEGARIAGASRIIGVDLNPNRFEEAKKFGCTEFVNPKDHNKPVQEVLAEMTNGGVDRSVE

SEQ ID NO: 20183 - protein, 228 aa, Gossypium rotundifolium
  misc_feature (181)..(181): Xaa can be any naturally occurring amino acid
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIXGVDLNPNRFEEAKKFGCTEFVNPKDHNKPVQEVLAEMTNGGVDRSVE

SEQ ID NO: 20184 - protein, 228 aa, Gossypium rotundifolium
FTSLCHTDVYFWEAKGQTPLFPRIFGHEAGGIVESVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPAKGSTVAIFGLGAVGLAAAEGARIAGASRIIGVDLNPNRFEEAKKFGCTEFVNPKDHNKPVQEVLAEMTNGGVDRSVE

SEQ ID NO: 20185 - protein, 228 aa, Gossypium herbaceum
FTSLCHTDVYFWEAKGQTSLFPRIFGHEAGGIVESVGEGVTHLKPGDHVLPVFTGGCGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTNGGVDRSVE

SEQ ID NO: 20186 - protein, 377 aa, Zymomonas mobilis
MTAIVSIHGRQVVDSRGNPTVEVDVTLEDGSFGRAAVPSGASTGVHEAVELRDGDKTRWGGKGVTKAVHAVNNEIANAIIGLEAEDQELIDQTMIKLDGTPNKGKFGANAILGVSLAVAKAAAEARGLPLYRYVGGTAAHVLPVPMMNIVNGGMHADNPIDFQEFMIAPVGASSINEAVRIGTEVSHTLKKELSAKGMNTNVGDEGGFAPSLDSASSALDFIVDSISKAGYKPGEDVFIALDAASSEFYNKDQNIYDLKGEGRKLTSAQLVDYYVELCGKYPIYSIEDLAEDDFEFWKILTEKLGDKVQLVGDDLFVTNVKRLSDGIERGIANSLLVKFNQIGSLSETLAAVNMANDASYTPVMSHRSGGNRRHHDC

SEQ ID NO: 20187 - protein, 268 aa, Populus alba
RATMIMRLKTKIQTLDEQMAAVSEKSSKYGQIAAEEIPKGLYCLGIRLTTEWFGNSNLHRRMNERMHIETKLRDNSLYHFCVFSDNILATSVVVNSTTLNSKNPDMVVFHLVTDEINYAAMKAWFSMNTFRGVTTEVQKFEDFKWLNASYVPVLKQLQDSETQSYYFSGHNNDGQTPIKFRNPKYLSMLNHLRFYIPEVFPALEKVVFLDDDVVVQKDLSGLFSIDLNSNVNGAVETCMETFHRYHKYLNYSHPLIREHFDPDACGCA

SEQ ID NO: 20188 - protein, 268 aa, Populus alba
RATMIMRLKTKIQTLDEQMAAVSEKSSKYGQIAAEEIPKGLYCLGIRLTTEWFGNSNLHRRMNERMHIETKLRDNSLYHFCVFSDNILATSVVVNSTTLNSKNPDMVVFHLVTDEINYAAMKAWFSMNTFRGVTIEVQKFEDFKWLNASYVPVLKQLQDSETQSYYFSGHNNNGQTPIKFRNPKYLSMLNHLRFYIPEVFPALEKVVFLDDDVVVQKDLSGLFSIDLNSNVNGAVETCMETFHRYHKYLNYSHPLIREHFDPDACGCA

SEQ ID NO: 20189 - protein, 405 aa, Fragaria x ananassa
MGGHNLVLIIFSVFLLSSSAYASRVAQFLAPGDFDVTSPKYGGKPNTDISQPLANAWKDACAATTPSRVIVPKGTFQLKGAVFKGPCKAPITVQVDGILQAPPIEAQLANKEFWVQFLEVERLTVSGTGTFDGQGQNSWKDNDCNKNPNCGGLAINVRFDRVKNSLVRDVTSLNSKNFHFNILGCEHLTFQHVIVKAPGDSPNTDGIHMGRSTRINITDTNIGTGDDCISVGDGTRQLTVSKVSCGPGHGISIGSLGRYDNEDDVSGLNIRDCTLSNTLNGVRIKTFPASPKATTASDIHFEKITMNYVANPVLIDQEYCPWGQCNKQIPSKVKISNVSFKNIIGTTSTAEALKIVCAKGLHCDQVVLSDIDLKLSGKGTLTSHCANVQPTITRVPPPLACATKA

SEQ ID NO: 20190 - protein, 368 aa, Bacillus sphaericus
MEKRDYYEVLGLTKDEIKKAYRKLSKQYHPDLNKEPGADEKFKEIAEAYEVLSDDQKKARYDQFGHEDPNAGFGGGFGGGGFGGFEDIFSSFFGGGGRRQDPNAPRKGDDLQYRMNIKFEEAIFGKETEIEIPKDETCETCHGSGAKPGTQPETCSTCNGAGQINQAVDTPFGRMMNRRSCTTCHGTGKIIKEKCSTCRGEGKVQKRKKIKVSIPAGVDDGQQIRVSGQGEPGINGGPAGDLYIMFRVQGHNDFERDGDDIYFELKLTFPQAALGDEIEVPTVHGKVKLRIPAGTQSGAQFRLKDKGVKNVHGYGMGNQYVTVKVMTPEKLTEKQKQLLREFAEISGDIPEEQGSSLFDKIKKKFQGE

SEQ ID NO: 20191 - protein, 294 aa, Candida albicans
MPSDPEEDYIPWIQQLCELFGHDYFVQVSQDFIEDDFNLTGLSSQVPYYREALYTILDYQVETAEDHNTDNTTTNTSNNNDSRNGTSKRNASELPNKALLAHSAELLYGLIHARYIVSKQGLTAMASKFERNDFGSCPRYFCDGMHLIPVGSTDVPGQETVRLFCPCCNDIYIPSSSRYLNIDGAFFGTTFPGLLVKMFPEIENQCRIRITKFSQNDFGLKLFGFKINELSATGPRMKWLRMHPETEGEKQELTHVNIMFQLATYMKTKRMEEDDEEEEDEVEEEDDDRTMASE

SEQ ID NO: 20192 - protein, 475 aa, Ophioglossum engelmannii
MSPQTETKAGVGFKAGVKDYRLTYYTPEYEPKDTDILAAFRMTPQPGVPAEEAGAAVAAESSTGTWTTVWTDGLTSLDRYKGRCYEIEPVAGEEDQYIAYVAYPLDLFEEGSVTNMFTSIVGNVFGFKALRALRLEDLRIPPAYSKTFMGPPHGIQVERDKLNKYGRPLLGCTIKPKLGLSAKNYGRAVYECLRGGLDFTKDDENVNSQPFMRWRDRFVFVAEALFKSQAETGEIKGHYLNATAGNCEEMIKRAVFARELGVPIVMHDYLTGGFTANTSLASYCRDNGLLLHIHRAMHAVIDRQKNHGMHFRVLAKALRMSGGDHIHAGTVVGKLEGEREITLGFVDLLRDDYIEKDRSRGIYFTQDWVSMPGVLPVASGGIHVWHMPALTEIFGDDSVLQFGGGTLGHPWGNAPGAVANRVALEACVQARNEGRDLAREGNEIIREAAKWSPELAAACEVWKEIRFEFKPVDTV

SEQ ID NO: 20193 - protein, 428 aa, Pseudomonas fluorescens
MPTKTADTLQYKANSRVSTFDQYKWRALIGVTFCYLFYYTGRQTLGFAIPGIQHDYCLSKYEIGWISAMMLWCYAGGQFINGNLGDKFGGKRMMIAGAILSLGANWVFSFGHSFWFFLLAWGANGYFQSMGFAPGSRLLSNWWSHKHRGFVYGVYVGFSGFSSVLAFILPLVILGAMQLDWIWIFRLAPLSMLLGAIVLWFFVSERPEDNKSAPLEQADDTSLPAAENNSTSAQRYVTVLRNWRLYITGFAIGFQNAARYALVVWVPVHFLGLDWKTSSAIIDPKWITIALPVGMALGALSNSWISDVVFQGRRYLAIVSYMVLASTTAMIMMFVPHASMVAIGLLFLCGFFVFGPASSFWALCPDIFGRHVAGTATGVLNTMSYAFAGMSEPVIGHMIDSTGSTSIIFPIVAGLCGASAMLSLLIKR

SEQ ID NO: 20194 - protein, 107 aa, Gossypium barbadense
QTKAIAGKVTNWDNVVLAYEPVWAIGTGKVATPAQAQEVHCELRKWLHENVGGDIAASTRIIYGGSVNGANCKELAAQPDVDGFLVGGASLKPEFVDIIKAAMVKKN

SEQ ID NO: 20195 - protein, 397 aa, Brassica napus
MGSYLGIYTILVLCLLGYSANAEVFTVGGPPGSDITAALLKAFTSACQAPAPSQVLIPKGDFKLGEIAMTGPCKSPVEFTLQGNVKADGGSTQGKDRWVVFEKINGFKLNGGGTFDGEGNAAWKANNCHKTFECKKLPISVRFDFVDNAEIKDVTSLDAKNFHFNVISGKNMTFDNIKIIAPAESPNTDGIHLGRCEGVKILNTKISTGDDCISVGDGMKNLLIEKVVCGPGHGISVGSLGRYGWEQDVNDIKVINCTLEGTDNGLRIKTWPSAACTTTAAGIHFENIILNKVSNPILIDQEYCPWNQCNKSKPSTIKLVDITFRNIRGTSGNKDAVKLLCSKGHPCENVEIGDINIEYTGPDGPPTFECTNVTPKLVGTQNPKACVGPVVKAPGQA

SEQ ID NO: 20196 - protein, 321 aa, Arabidopsis thaliana
MAVVQKGKVCVTGAGGFLGSWVVNHLLSRDYFVHGTVRDPGNEKYAHLKKLDKAGDKLKLFKADLLNYGSLQSAIAGCSGVFHVACPVPSASVPNPEVDLIAPAVDGTLNVLKACVEAKVKRVVYVSSVSAVAMNPMWSKSQVLDETAWSDQDYCKKTENWYSLSKTRAESEAFEFAKRTGLDLVSVCPTLVLGPVLQQHTVNASSLVLLKLLKEGYESRNNQERHLVDVRDVAQALLLVYEKAEAEGRYICIGHTVREQEVAEKLKSLYLNYNYPKRYIEADGKVKVSSEKLQKLGWTYRPLEETLVDSVESYRKAKLVD

SEQ ID NO: 20197 - protein, 324 aa, Arabidopsis thaliana
MEEDRCSIKDDATQLIGNTPMVYLNNIVDGCVARIAAKLEMMEPCSSVKERIAYGMIKDAEDKGLITPGKSTLIEATSGNTGIGLAFIGAAKGYKVVLTMPSSMSLERKIILLALGAEVHLTDPSKGVQGIIDKAEEICSKNPDSIMLEQFKNPSNPQTHYRTTGPEIWRDSAGEVDILVAGVGTGGTLSGSGRFLKEKNKDFKVYGVEPTESAVISGGKPGTHLIQGIGAGLIPDNLDFNVLDEVIQVTSVEAIETAKLLALKEGLLVGISSGAAAAAAIKVAKRPENAGKLIVVIFPSGGERYLSTSLFESVRHEAENLPIQ

SEQ ID NO: 20198 - protein, 224 aa, Haemophilus influenzae Rd KW20
MKPYLIAPSILSADLARLGDDVQNVLNAGADVIHFDVMDNHYVPNLTFGPAVCQALRDYGITAPIDVHLMVKPVDRIIPDFAKAGANYITFHPESSEHIDRSLQLIRDCGCKSGLVFNPAMPLSYLDYVLDKVDVVLLMSVNPGFGGQSFIPATLKKLQQARKIIDESGYDIRLEVDGGVKVDNIAEIAAAGADMFVAGSAIFGKPDYKQVIDQIRTQLASVSA

SEQ ID NO: 20199 - protein, 255 aa, Haemophilus influenzae Rd KW20
MLKVSNIQKNFNGNHVLKGIDFEINKGEVVAILGPSGSGKTTFLRCLNLLERPEQGILEFTDGSLKIDFSQKISKADELKLRRRSSMVFQQYNLFPHRSALENVMEGMVVVQKQDKAQAREKALSLLEKVGLKNKADLFPSQLSGGQQQRVGIARALAVKPDIILLDEPTSALDPELVGEVLQTLKMLAQEGWTMIIVTHEMQFAKDVADRVILMADGHIVEQNTADKFFTCPQHERTKQFLLQAKIPLELDYYI

SEQ ID NO: 20200 - protein, 458 aa, Haemophilus influenzae Rd KW20
MAKAPKTAYVCNDCGAEFSRWQGQCSACKAWNTITEVRLISTAKSKNDRFSGYAGETQAKIQTLSEISLQETPRFSSGFSELDRVLGGGIVPGSAILIGGHPGAGKSTLLLQVMCGLAKNMTALYVTGEESLQQVAMRASRLGLPSDQLKMLSETSVEQICNLADQLKPQIIVVDSIQVMHLADIQSSPGSVAQVRECASFLTRYAKTRQVAIIMVGHVTKDGTLAGPKVLEHAIDCSLLLEGEADSRYRTLRSHKNRFGAVNELGVFGMTEQGLREVKNPSAIFLSRGDEITSGSSVMVLWEGTRPLLVEIQALVDHSMLANPRRVAVGLEQNRLALLLAVLHRHGGLQMADQDVFVNVVGGVKVSETSADLALLLALISSFRNRPLPQDLVIFGEVGLAGEIRPVPSGQERISEAAKHGFKRAIVPFGNKPKSAVENMQVFTVKKLTDALAVLDNL

SEQ ID NO: 20201 - protein, 459 aa, Sirogonium melanosporum
GAGFKAGVKDYRLTYYTPEYETKETDILAAFRMTPQPGVPPEEAGAAVAAESSTGTWTTVWTDGLTSLDRYKGRCYDIEPVAGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKAQAETGEIKGHYLNATAGTCEEMMKRAEYAKELGVPIIMHDYLTGGFTANTSLAHYCRDNGLLLHIHRAMQAVIDRQKNHGIHFRVLAKALRMSGGDHIHSGTVVGKLEGERQVTLGFVDLLRDDYIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEVWKEIKFE

SEQ ID NO: 20202 - protein, 466 aa, Sphagnum palustre
GSGFKAGVKDYRLTYYTPEYAVKDTDILAAFRMTPQPGVPPEEAGAAVAAESSTGTWTTVWTDGLTSLDRYKGRCYDIEPVAGEENQYIAYVAYPSDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAAFARELGAPIIMHDYLTGGFTANTTLAHYCRDNGLLLHIHRAMHAVIDRQKIHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLARQGNDIIREAAKWSPELAAACEVWKEIKFEFDTIDTV

SEQ ID NO: 20203 - protein, 2187 aa, Streptomyces nanchangensis
MANQEQLVDYLKRVATDLHDTQQRLREVEARDRQPIAIVGMACRFPGGTDTPEALWDLVSEGRDVISPMPDDRGWDPGMFNDSGETGTSYVREGGFVHDIADFDADFFDINPREALAMDPQQRLLLETSWEAIERARIDLTSLRGSKTGVFVGGSTVYYAGNAAGVPQDVAGYLATGLAASSMSGRISYTFGFEGPSFTVDTACSSSGVALHLAVQALRKGECSLALAGGVCVMATPGTYLEFSKLNGLAADGRCKAFAAAADGFGPAEGVGVLLVERLADAERLGHPVLAVIRGSAINQDGASNGLTAPHGPAQERVIRAALADAQLSARDIDVVEAHGTGTSLGDPIEAQALIAAYGRRRADGGPLWLGSVKSNIGHTQAAAGMAGVIKMVHALRHGLLPRTLHVDEPTHQVDWSEGTVRLLTEARPWPEAGGPRRAGVSSFGMSGTNTHVILEQAPPAEEPAPAAESPVVPWLVSGRGEAALRAQAARLRDFLAERPEASPTRVGFALAGSRAAQSHRAAVVAADRDTLLAGLGSLAEGTPAGHVVTGSVSPGATAFVFPGQGSQWVGMALALADASPVFAEHFRRCAEAVERHTDYTVESVLRADPGAPSLDRVDVVQPVLWAVMVALAELWRSHGVEPAAVVGHSQGEIAAACVAGVLSVDDAARVVVLRSQVLPELSGRGGMASVAQPVGLVEKHLERWDGRLSVAAVNGPSSTVVSGDADALEELLEGYEADGVRARRVPVDYASHCAHVDALRGPLLDALSGIEPKAGTVPLYSTVTGRRIDGTTMDAGYWYTNLRQQVRFQEATEALLADGHGVFIECSPHPVLTIGVQETMDQSGANATALGTLRRDEGGWDRFLLALGQAHTHGVAVDWSRVFPDGTSPADLPTYAFQRRRYWLDATAGAAGDPASLGLTPADHPLLGAVTLLAEGDEVVMTGRLGLDTHPWLADHAVAGAVLVPGAVFVELAVRAGDEVGCDHLEEMVLASPLVLPEQGGFDLQLVVGGAAEDGRRTLGGYARPSGSDRPWVQHVTGTLAPGGAARPFDLAQWPPEGARPVPVEGCYDQLAEGGFRYGPAFRSLRAVYRRETEVFAEVVLPEEQRGKAAAFGIHPALLDGALHASGLSAVRGDSGGRMALPFAWNGVSLAATGAELLRVRLAPVGDDGMSVHATDASGHPVISIESLVTRPFTAGQLPSDGDETRDGLFRVAYTPLTDPEPGTATDDWTAVATGSEPTYYGVRRYGDLDALAAAVDGGLPAPPVTLLPCEPAPDDGDLPGALRRRLGEVLHTVQRWLADERFAASRLVVVTRGAVAAFEGDDVTDLVHAPVWGLIRSAQSEHPDRLALVDLDGPELPKAVAAAVAVAVAAGEKQIVVRDGTVRVSRLVPAVSGGALALPETPHWRLDIAAPATLDNLGLVAAEEPGPPAPGHVRVQVRAAGVNFRDVLIALGMYPGDGAFRGSEGAGVVLEVAEDVTSVAVGDRVMGMFQGAFGSTAVADARSVVPIPPGWTDEQAAAVPIAYVTAWYGLVDLAGLKAGESVLIHAATGGVGTAAVQIARHLGAEVYATAGPGKHHVLEAMGIDEAHRASSRDLDFEDAFRAATGGRGVDVVLNSLTGDHTDASLRLLAEKGRFVELGMTDVRDPEQLAEPYPGLRYRVLDLREPGEDGIGRMLTEILGRFAGGELTHPAVRAFDIRRARDAFRLMSRAAHIGKIVLTLPRPLDPDGTVLVTGGTGTLGGLIARHLVTRHGVRHLLLTSRRGPEAPGAPALREDLAALGATVTVTACDAGDRERLAEVLAGVPDAHPLTGVVHCAGVLDDGMVDALTPEQLARVLRPKAEAALHLHELTQDADLALFVLFSSIVGVYGNPSQANYAAASTFLDALAQHRQAGGLPAQSLAWGMWEETSALTGELDDGVRQRISQAGMDPLPTEQALALFDRSYAVGDALLVPIRQSTAASRGGPAAGRTRARRVADSGVAGTGGPSLTDRVTALPEAERDSCVLEAVRAHMAAVLGHDSADEIAPDRTFKELGFDSLTAVELRNRLSAATGLRLPATFVFDFANPVALAEHLREQIAPPTELGPPTDPSTPADPSPPPGLPEGPSTDPRESRVRQVLAAIPLRRLEESGLLETLLRLGEGPGEADTTGARPVEGTRDETHTPDSADIASMDLEELVNAALRNDES

SEQ ID NO: 20204 - protein, 217 aa, Clostridium saccharoperbutylacetonicum
MNKLIKLTDLNRIFKDGMTIMVGGFLDCGTPENIIDMLVDLNIKNLTIISNDTAFPDKGIGKLIVNGQVSKVIASHIGTNPETGKKMSSGELKVELSPQGTLIERIRAAGSGLGGVLTPTGLGTIVEEGKKKVTIDGKEYLLELPLSADVSLIKGSIVDEFGNTFYRAATKNFNPYMAMAAKTVIVEAENLVKCEDLKRDAIMTPGVLVDYIVKEAA

SEQ ID NO: 20205 - protein, 510 aa, Petunia x hybrida
MAGGFAAGSGGGDYEGKVTTFGIMTCLVAATGGLLFGYDIGISGGVTSMDEFLLKFFPNVYHKEKALKAGGNQYCKFDDHLLQLFTSSLYLAALVASFAASITTKAFGRKISMLIGGLIFLVGAVLNGAAMNLAALIIGRLLLGVGIGYANQSVPVYLSEMAPPKLRGALNVCFQMAVTLGIFVANMVNYGTSSMKKNGWRVSLVLAAVPAIIMTVGAVFLPDTPNSLIDRGQKEKAKAMLQKIRGTNNVDNEFEDLIIASDMSKLVTDPWGNIMKPRYRPQLTIAVLIPFFQQLTGINVIMFYAPVLFKTLGFGDEAALMTAVITGLVNVFATLISIFTVDRFGRRFLFLAGGLLMLICQAAVGSVIGSVFGTDGLGTFSKGLGNVTVGLICLYVAAFAWSWGPLGWLVPSEVFPMEIRSAGQSITVSVNMFFTFVIGQLFLTMLCEMKFGLFFFFAGFVVLMTLFIFFFLPETKGIPIEEVNRIWKNHWFWKSYVPNDDDDHHSKNQV

SEQ ID NO: 20206 - protein, 281 aa, Oryza sativa (japonica cultivar-group)
SLSRSWGMNGQIGDDHDILIECRDVHKSFGNKKVLNGISFKIRHGEAVGIIGPSGTGKSTVLKVMAGLLAPDKGDVIICGRKRHGLVSDEDISGVRIGLVFQSAALFDSLTVRENVGFLLYENSSLPEERIATLVTETLAAVGLKGVEDRMPSELSGGMKKRVALARSIIYDDTKETIEPEVILYDEPTAGLDPIASTVVEDLIRSVHVTGKDALGKPGKIASYVVVTHQHSTIKRAVDRLLFLHEGKVVWEGMTQEFTTSTNPIVKQFASGSLDGPIRYF

SEQ ID NO: 20207 - protein, 323 aa, Oryza sativa (japonica cultivar-group)
MAFTVKASSPSSPATTRLTGALHGGAARVAARKLPAAAVAASLTLDRAPAPAGAERGMSSSVSRTMSRLREKGKAAFIPYITAGDPDMGTTAEALRVLDACGADVIELGVPFSDPYTDGPVIQASAARALAAGATMDGVMSMLAEVTPELSCPVVLFSYFGPIVRRGPANFTAAAKEAGVQGLIVPDLPYVETSTFRSEAIKNNLELVLLTTPATPADRMKAITAASGGFVYLVSVNGVTGSIQNVNPRVEHLLQEIKQVTDKAVCVGFGISTPDHVRQIADWGADGVIIGSAMVRQLGEAASPKQGLKRLEKYARSLKDALP

SEQ ID NO: 20208 - protein, 324 aa, Oryza sativa (japonica cultivar-group)
MAFTVKASSPSSPAASSSSSSAPAKLGAAPGRVAVRKLTAAATSLRLDRAPAAPATERGLSSVSRTMSRLMEKGKTAFIPYITAGDPDMGTTAEALRLLDACGADVIELGVPFSDPYNDGPVIQASAARALSAGATMDGIMSMLAEVTPELSCPVVLFSYLGPIVRRGPANFTAAAKEAGVQGLIVPDLPYLEACSFRSEVIKNNLELVLLTTPTTPPDRMKAITAASGGFVYLVSVNGVTGSRQDVNPRVEHLLQEIKQVTDKAVCVGYGISTPDHVRQIAEWGADGVIIGSAMVRQLGEAASPKQGLKRLEKYARSLKNALP

SEQ ID NO: 20209 - protein, 326 aa, Oryza sativa (japonica cultivar-group)
MAFTTMKASPMSASSSSAPVLRRCVAQPARVAAARRLAAAAASVALEASPVPAAAAAAVERRMSVSQTMSKLKEKGKTAFIPYITAGDPDMGTTAEALRLLDACGADVIELGVPFSDPYADGPVIQASASRALAAGATPEAVLSMLKEVTPELSCPVVLLSYLGPILRRGAANFTAAAKEAGVQGLIVPDLPYVDTCTFRSEAIKSNLELVLLTTPATPGERMKIITEASGGFVYLVSVNGVTGPRPKVNTRVEHLLQDIKLVTDKAVCVGFGISTPDHVRQIAGWGADGVIIGSAMVRQLGEAASPKQGLKRLEEYARRMKDALP

SEQ ID NO: 20210 - protein, 279 aa, Oryza sativa (japonica cultivar-group)
MEMEDSGRGVVGAGKRGVAETFSRLREQGKTAFIPFITASDPDLATTSKALKILDSCGSDVIELGVPYSDPLADGPVIQAAATRALKKGATFDSVIAMLKGVIPELSCPIVIFTYYNPILKRGVSNFMAIIKQAGVHGLVVPDLPLEETALLRNEAVMHGIELVLLTTPTTPTERMKEIAKASEGFIYLVSSVGVTGARSNVNLRVEYLLQEIKKVTDKPVAVGFGISTPEHVKQIAGWGADGVIIGSAIVRQLGEAASPEEGLKRVEEYAKNMKAAMP

SEQ ID NO: 20211 - protein, 170 aa, Oryza sativa (japonica cultivar-group)
MGACNSCEATAVAAVNGRSASGEATAARVVLADGALRRFPGGTRASQAVKAAGGGGGGSSWFLCSADGLELGAAVAAVGGGDDEELQPGQLYFVLPAAMRRRPLQAEEMAALAVRASAALVGDHDGPLVFPEAAASAADPRAAGKGCRRSRTRRHSRGRDFVPDLGAIAE

SEQ ID NO: 20212 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQEGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRTIHDGLHVKGYMAWSLLDNFEWAEGYNMRFGMIHVDFRTQVRTPKESYYWYRNVVSNNWLETRR

SEQ ID NO: 20213 - protein, 370 aa, Rhodococcus rhodochrous
MMKTQAAILWERGGPWSVEEIDLDPPRHGEVLVEMGGSGLCHSDEHVLTGDLPWPLPMVGGHEGAGTVVEVGPGVEGLAAGDRVIFGFLPACGRCAACSAGMQNLCELGQYLGDGTQISDHTSRHHARGQDLGLMCLLGTFAQHTVVSEANCIKIDDDIALDKACLLGCGVVTGWGSAVFTGGVKPGDTSVVVGVGGIGINAVQGAAMNGSQYVVAVDPVEFKRTKALELGATHAVATSEEAQALVADLTYGRGANVVVNTTGVGEGDQIGASLAMTAKRGTVVVTNLHRATEETVKMSALDLVLMEKRVVGSLFGSANPRLHIPKMLGLYRSGHLKLDELATRSYKLDEVNTGYQDMREGRNLRGVITF

SEQ ID NO: 20214 - protein, 482 aa, Rhodococcus rhodochrous
MSMQYDSLFIGGDWIAPSSSKRITAISASTEQPIGSVPEAQEADVDAAVAAARRALDDPAGWAHWAPAARAAAIERLADVLERRAEDVVQCVSAQNGMPVAVARQLEGVFPVVLLRYYAGLARDTATEETRPGLFGGSTLVCREPLGVVGAIVPWNFPQTLAAFKYAPALAAGCTLVIKPSPETVLDAFVFAEAVAEAGIPAGVVNVVPGGREVGAYLVEHPGVDKISFTGSTAAGRSIGEVCGRLLRPVTLELGGKSAAIVLDDAGLDLQTMSEKLFAATLLNNGQTCFLGTRVLAPRSRYSEIVDLFTDLAGTLKVGDALDDTTQIGPMATAAQRDRVEQYIAKGLGDGARITIGGGRPADQDKGWFVEPTIFADVENNHTIAQEEIFGPVLSVIPYSDEDEAVRIANDSDFGLGGTVWTNDPDRGLALAKRVQTGTIGINGYLPEPTAPFGGVKASGLGRELGPEALSNYQQLKSIYLD

SEQ ID NO: 20215 - protein, 473 aa, Astragalus sparsus
MSPQTETKASAGFKAGVKDYKLTYYTPDYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMLKRAIFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREAGKWSPELAAACEVWKEIKFEFPAMD

SEQ ID NO: 20216 - protein, 473 aa, Cladrastis sinensis
MSPQTETKASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMD

SEQ ID NO: 20217 - protein, 473 aa, Glycine max
MSPQTETKASVGFKAGVKDYKLTYYTPDYETKDTDILAAFRVTPQPGVPPEEAGAAVAAESSTGTWTTVWTDGLTSLDRYKGRCYGLEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMD

SEQ ID NO: 20218 - protein, 473 aa, Lotononis galpinii
MSPQTETKASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPNAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNQIIREASKWSPELAAACEVWKEIKFEFPAMD

SEQ ID NO: 20219 - protein, 473 aa, Sesbania sesban
MSPQTETKASVGFKAGVKDYKLTYYTPDYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMD

SEQ ID NO: 20220 - protein, 482 aa, Pseudomonas fluorescens
MLDVPLLIGGQSCPARDGRTFERRNPVTGELVSRVAAATLEDADAAVAAAQQAFPAWAALAPNERRSRLLKAAEQLQARSGEFIEAAGETGAMANWYGFNVRLAANMLREAASMTTQVNGEVIPSDVPGSFAMALRQPCGVVLGIAPWNAPVILATRAIAMPLACGNTVVLKASELSPAVHRLIGQVLQDAGLGDGVVNVISNAPADAAQIVERLIANPAVRRVNFTGSTHVGRIVGELSARHLKPALLELGGKAPLLVLDDADLEAAVQAAAFGAYFNQGQICMSTERLIVDAKVADAFVAQLAAKVETLRAGDPADPESVLGSLVDASAGTRIKALIDDAVAKGARLVIGGQLEGSILQPTLLDGVDASMRLYREESFGPVAVVLRGEGEEALLQLANDSEFGLSAAIFSRDTGRALALAQRVESGICHINGPTVHDEAQMPFGGVKSSGYGSFGGKASIEHFTQLRWVTLQNGPRHYPI

SEQ ID NO: 20221 - protein, 445 aa, Arabidopsis thaliana
MVGSHKASGVLLVLLVVMATTIANGTPVVDTAKNAATAVEDTAKNVATAVGGAAASVGAKVTGAKPGGASLDVKASGAKGDGKTDDSAAFAAAWKEACAAGSTITVPKGEYLVESLEFKGPCKGPVTLELNGNFKAPATVKTTKPHAGWIDFENLADFTLNGNKAIFDGQGSLAWKANDCAKTGKCNSLPINIRFTGLTNSKINSITSTNSKLFHMNILNCKNITLTDISIDAPPESLNTDGIHIGRSNGVNLIGAKIKTGDDCVSIGDGTENLIVENVECGPGHGISIGSLGRYPNEQPVKGVTVRKCLIKNTDNGVRIKTWPGSPPGIASNILFEDITMDNVSLPVLIDQEYCPYGHCKAGVPSKVKLSDVTIKNIKGTSATKVAVKLMCSKGVPCTNIALSDINLVHNGKEGPAVSACSNIKPILSGKLVPAACTEVAKPGP

SEQ ID NO: 20222 - protein, 378 aa, Pisum sativum
ATQGQVITCKAAVAWEPNKPLTIEDVEVAPPQANEVRIQILFTALCHTDAYTLGGKDPEGLFPCILGHEAAGIVESVGEGVTDVKPGDHVIPSYQAECGECKFCKSPKTNLCGKVRAATGVGVMMADRKSRFSVKGKPIYHFMGTSTFSQYTVVHDVSVAKIHPDAPLDKVCLLGCGVPTGLGAVWNTAKVEPGSIVAIFGLGTVGLAVAEGAKSAGASRIIGIDIDSNKYDTAKNFGVTEFINPKDHEKPIQQVIIDLTDGGVDYSFECLGNVSVMRSALECCHKGWGTSVIVGVAASGQEISTRPFQLVTGRVWKGTAFGGFKSRSQVPWLVEKYLKKEIKVDEYITHNLTLLEINKAFDLLHEGQCLRCVLAVHD

SEQ ID NO: 20223 - protein, 307 aa, Deinococcus proteolyticus
MAYKDYYEVLGVSRSASDSDIKSAYRKLAKQYHPDKNAGDESAAEKFKEIGEAYAVLSDPQKRQAYDQFGHTGQVPPALPRRRLSGRRLRRVRPQPVQRLFPGDVRGPGRWHGSRGGFTSPDGRPIDLEDLFGGLGGMGGALRAEAGRFVQNVEGELQVSLSEAFEGSDEIINVDGRRLSLRVPAGTRDGARLRLAGQGPGGGDVLLTIRVLEDARFELDGDDLTTSVDVPAPVALGGAVTVQTITGSGQLNVPAGSSGGPMRLKGQGWPKKSGGRGDLYVRLNVTVPKELSEEERQLYEHVRDLQR

SEQ ID NO: 20224 - protein, 384 aa, Rhodobacter capsulatus
MAKVDFYEVLGVSKGASAEEIKKAYRSKAKELHPDRNQGQSAAEAQFKEVNGAYDVLKDGDKKAAYDRYGHAAFEGGMGGGGPRGPYGQGADFSSAFSDVFEDLFGDFMGGRGGPGGGGRRVRRRGSDLRYNMRVTLEEAFKGAQKTITVPGSAACGSCNGTGAEGGAEPQTCPTCSGLGKVRAQNGFFTVERTCPTCGGQGQVVKNPCRVCHGSGRIEKERTLSVNIPAGVETGTRIRLAGEGEAGMRGGPSGDLYIFIEVREHAIFQRDGVNLFCRVPVSMVSAALGGEVEVPTIDGGRSKVKVPVGSQSGRQMRLRGKGMPALRGGGIGDMVIELAVETPVNLTARQKELLDEFQRIQAENNPEGASFFQKVKSFWDGMKG

SEQ ID NO: 20225 - protein, 294 aa, Lycopersicon esculentum
MDQYEKVEKIGEGTYGVVYKARDRVTNETIALKKIRLEQEDEGVPSTAIREISLLKEMQHANIVRLQDVVHSEKRLYLVFEYLDLDLKKHMDSCPEFSKDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQPPLFPGDSEIDELFKIFRVLGTPNEDTWPGVTSLPDYKSAFPKWPPKDLAIIVPNVDGAGLDLLGKMLSLDPSKRITARNALEHEYFKDIGYVP

SEQ ID NO: 20226 - protein, 239 aa, Campylobacter jejuni
MYKAQNIITRFGNKVVHDGVSFEINKNEIFGILGGSGNGKSVLLKQMLMLEHFDEGEYEILGFKLKNISEEDALALRKKWGVVFQFSALFSFFSVYENIAIPLKEYTNLDSIAIKELVLMKLKMVGLNEAVLKQLPSELSGGMQKRVAIARALALDSKLLFLDEPTSGLDPHSSREFDDLILELKQSFDLNIVLVTHDKESMKNLLERFIILEDKKVAFCGNYEELRVQNERLFKRFME

SEQ ID NO: 20227 - protein, 421 aa, Arabidopsis thaliana
MATETNENLINSFIEITSSSREEANFFLESHTWNLDAAVSTFLDNDAAAAAEPNPTGPPPPSSTIAGAQSPSQSHSPDYTPSETSPSPSRSRSASPSSRAAPYGLRSRGGAGENKETENPSGIRSSRSRQHAGNIRTFADLNRSPADGEGSDSDEANEYYTGGQKSGMMVQDPKKVKDVDELFDQARQSAVDRPVEPSRSASTSFTGAARLLSGEAVSSSPQQQQQEQPQRIMHTITFWLNGFTVNDGPLRGFSDPENAAFMNSISRSECPSELEPADKKIPVHVDLVRRGENFTEPPKPKNPFQGVGRTLGASGSGSSSAPQASSAPMNVAPAPSRGLVVDPAAPTTSIQLRLADGTRLVSRFNNHHTVRDVRGFIDASRPGGSKEYQLLTMGFPPKQLTELDQTIEQAGIANAVVIQKF

SEQ ID NO: 20228 - protein, 336 aa, Pseudomonas stutzeri
MLPKLVITHRVHDEILQLLAPHCELMTNQTDSTLTREEILRRCRDAQAMMAFMPDRVDADFLQACPELRVVGCALKGFDNFDVDACTARGVWLTFVPDLLTVPTAELAIGLAVGLGRHLRAADAFVRSGEFQGWQPQFYGTGLDNATVGILGMGAIGLAMADRLQGWGATLQYHEAKALDTQTEQRLGLRQVACSELFASSDFILLALPLNADTQHLVNAELLALVRPGALLVNPCRGSVVDEAAVLAALERGQLGGYAADVFEMEDWARADRPRLIDPALLAHPNTLFTPHIGSAVRAVRLEIERCAAQNIIQVLAGARPINAANRLPKAEPAAC

SEQ ID NO: 20229 - protein, 266 aa, Cicer arietinum
AEEKGLITPGQSVLIEPTSGNTGIGLAFMAAAKGYKLIITMPASMSLERRIILLAFGAELVLTDPAKGMKGAVQKAEEILAKTPNAYILQQFENPANPKVHYETTGPEIWKGTEGKVDAFVSGIGTGGTITGAGKYLKEQNPNIKLVGVEPVESPVLSGGKPGPHKIQGIGAGFVPGVLEVNLIDEVIQISSDEAIETAKLLALKEGLFVGISSGAAAAAAIKIAKRPENAGKLIVVVFPSFGERYLSSVLFESVRRQAETMTFEP

SEQ ID NO: 20230 - protein, 465 aa, Pinus quadrifolia
VGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 20231 - protein, 465 aa, Pinus culminicola
VGFKAGVKDYRLTYYTPEYQTKDTDILAAFRVTPQPGVPAEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMVKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVMPVASGGIHVWHMPALTEIFGDDSVLQFGGGTLGHPWGNAPGAVANRVALEACVQARNEGRDLAREGNEVIREACKWSPELAAACEIWKEIKFEFDAIDRL

SEQ ID NO: 20232 - protein, 465 aa, Pinus catarinae
VGFKAGVKDYRLTYYTPEYQTKDTDILAAFRVTPQPGVPAEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVMPVASGGIHVWHMPALTEIFGDDSVLQFGGGTLGHPWGNAPGAVANRVALEACVQARNEGRDLAREGNEVIREASKWSPELAAACEIWKEIKFEFDVIDRL

SEQ ID NO: 20233 - protein, 465 aa, Pinus remota
VGFKAGVKDYRLTYYTPEYQTKDTDILAAFRVTPQPGVPAEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMVKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVMPVASGGIHVWHMPALTEIFGDDSVLQFGGGTLGHPWGNAPGAVANRVALEACVQARNEGRDLAREGNEVIREASKWSPELAAACEIWKEIKFEFDVIDRL

SEQ ID NO: 20234 - protein, 465 aa, Pinus cembroides subsp. orizabensis
VGFKAGVKDYRLTYYTPEYQTKDTDILAAFRVTPQPGVPAEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMVKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 20235 - protein, 465 aa, Pinus maximartinezii
VGFKAGVKDYRLTYYTPEYQTKDTDILAAFRVTPQPGVPAEEAGAAVAAESSTGTWTTVWTDGLTSLDRYKGRCYDIEPVPGEETQFIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVMPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 20236 - protein, 465 aa, Pinus rzedowskii
VGFKAGVKDYRLTYYTPEYQTKDTDILAAFRVTPQPGVPPEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVMPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 20237 - protein, 465 aa, Pinus nelsonii
VGFKAGVKDYRLTYYTPEYQTKDTDILAAFRVTPQPGVPPEEAGAAVAAESSTGTWTTVWTDGLTSLDRYKGRCYDIEPVPGEETQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVMPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 20238 - protein, 465 aa, Pinus aristata
VGFKAGVKDYRLTYYTPEYQTKDTDILAAFRVTPQPGVPAEEAGAAVAAESSTGTWTTVWTDGLTSLDRYKGRCYDIEPVPGEETQFIAYVAYPLDLFEEGSVTNLFTSIVGNVFGFKALRALPLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 20239 - protein, 465 aa, Pinus longaeva
VGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 20240 - protein, 465 aa, Pinus balfouriana
VGFKAGVKDYRLTYYTPEYQTKDTDILAAFRVTPQPGVPAEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 20241 - protein, 465 aa, Pinus gerardiana
VGFKAGVKDYRLTYYTPEYQTKDTDILAAFRVTPQPGVPPEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIIMHDYLTGGFTANTSLAHYCRDNGLLLHIHRAMHAVIDRQRIHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 20242 - protein, 465 aa, Pinus squamata
VGFKAGVKDYRLTYYTPEYQTKDTDILAAFRVTPQPGVPPEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMIKRAVFARELGVPIIMHDYLTGGFTANTSLAHYCRDNGLLLHIHRAMHAVIDRQRIHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDAIDRL

SEQ ID NO: 20243 - protein, 309 aa, Rhodobacter capsulatus
MTRSSIILGAPIQSGTHQPGCVMGPASLRTAGLIASLTALGWRIEDQGDLSIGPQAAVAHANPAVHHLAETRAWIALLAARAEAAAAQSDLPVFLGGDHSMSAGTMAGVAAHAARLGRPLFVLWLDAHPDLHSLDTTESGNLHGTPVAYACGLGDFAAYPPLAHAIDPSRLCMMGIRSVDPAEHRRILEHGIEVHDMRAIDETGVVAPLRAFIDRVKAANGLLHVSFDVDFLDPGIAPAVGTTVPGGATFREAHLIMEYLCDAGVVTSLDLVELNPFLDERGRTASLICDLAASLFGRRVLDRQTRSFA

SEQ ID NO: 20244 - protein, 244 aa, Streptomyces sp. CH7
IPGDTEVRELDLASLASVRAFAAKLTADHPSVDVLVNNAGLVHLGPRRTTADGFELHVGTNMLGPYALTGLLLDALTAGSGGRVVSLSSITHKNAHLDFGDLMSEHGYRASSAYGRSKLATTLFGLELDRRLRAAGLPVVSALAHPGLTRTNLTPRAWEHRGRFGRLIAAGGLLATQSVEQGALPQLRAATDPEVRGGQFFGPARLWETRGPVTEARLGEEAADPAVARRLWAVAEDLTGVRYP

SEQ ID NO: 20245 - protein, 465 aa, Rhodobacter capsulatus
MSPAAEAFARLRAGDARRRTEFTVQKRRAVLKRLASEIRAREAEIMAALAADLGKPAVEVRISEIIPILSEIRHTSRHLKAWAGVRRVRPTLSMIGTRATIRPEPKGTVLILAPWNYPLCLALGPLVSAIAAGNAAVVKPSELAPATSALVAKIVAACLPEDLVAVVEGGVETATALLAQPFDHIFFTGSPAVGKVVMAAAAKTLASVTLELGGKSPVILGPDADLKKAARMVAWGKFQNAGQTCIAPDHVFVPRAQEAGFTKALRAEIARMYGARPQASRSFARLIGAKHFERVRGMVTEAVGHGATLITGGEAEAASRYLAPTVLTHVPADAALMREEIFGPVLPVIAYDDLGAVLAGIEAGEKPLALYVFARDRKLIARICAATTSGAVGVNVTLAHFLHLNLPFGGIGQSGLGAAHGRWGFQAFSHEKPVLENRFAVLDPLMPPYGKLSARLARLVQALVG

SEQ ID NO: 20246 - protein, 226 aa, Hordeum vulgare
MATSKKVVTRDEWEGKLRDAKIRKEDMNRLVMNFLVTEGLVDAAHRFRLESGTQREIDLATITDRMEVKKAVQSGNIQEAVERINDLNPTVLDTNPELYFHLQQQKLIELIRVGKIPEALEFAQEELAPRGEENEAFLEEIEKTVALLVFEDVKNCPYGELLDVSQRLKTASEVNAAILTSQSHEKGPKLPSLLKMLIWTQNQLSEKAAYPRINNLSTADLEDPAI

SEQ ID NO: 20247 - protein, 483 aa, Pseudomonas fluorescens
MIPVILSGGSGSRLWPLSRKQFPKQFLALTGEHTLFQQTLERLVFEGMDTPIVVCNKDHRFIVNEQLANRKLECQRILMEPFGRNTAPAVALTAMMLVNEGRDELMLVLPADHVIDDQKALQRALALATVAAERGEMVLFGVPATRPETGYGYIKSTNDSLLPEGVSRVQQFVEKPDEKRAVEFVKSGGYFWNSGMFLFRASRFLEELKKHDPDIYDTCVLTLERSEQTADTVTLDDATFACCPDNSIDYAVMEKTQRACVVPLSAGWSDVGCWASLWAVNDKDIHGNVSKGDVVIQDSRNCMIHGNGKLVSVIGLDNIVVVETKDAMMIAHKDKVQGVKQMVSTLNDQGRSETQNHCEVYRPWGSYDSVDMGGRFQVKHISVKPGACLSLQMHHHRAEHWIVVSGTAEVTCDENVFLLTENQSTYIPIASVHRLRNPGKIPLEIIEVQSGSYLGEDDIERFEDIYGRSTPVERGVSVKTIAQ

SEQ ID NO: 20248 - protein, 426 aa, Mycobacterium leprae
MTRASDEVGAASACVGDPAQMTDDRSVRTPKALPDGVTAATVGVRGGLLRSRFEETAETMYLTSGYVYESAVVAEKSFTGELDHFVYSRYGNPTVTMFEERLRLIEGAPAAFVTASGMAAVFTSLGALLASGDRLVAARSLFGSCFVVCNEILPRWGVETVFVDGEDLVQWEQALSVPTQAVFFETPSNPMQSLVDIAAVTELAHAAGAKVVLDNAFATPLLQHGLPLGVDVVIYSGTKHIDGQGRVLGGAILGDRDYIDGPVQKLMRHTGPAMSAFNAWILLKGLETLAIRVDHCNSSAHRIAEFLEKHPAVSWVRYPFLVSHPQYDLAKRQMSGGGTVVTFALNSPEDAAKQRAFEVLDRLRLIDISNNFGDVKSLITHPATTTHRAMGPEGRAAIGLGDGVVRISIGLEDAADLIADIDQALS

SEQ ID NO: 20249 - protein, 355 aa, Schizosaccharomyces pombe
MVQRVVDRDYYDILNISVDADGDTIKKSYRRLAILYHPDKNRENPEAAREKFQKLAEAYQVLSDPKLREKYDKLGKVGAVPDAGFEDAFEFFKNLFGGDSFRDYVGELNLLKELCKMINEEPELKAIEDTEESKKQLQREESKEADRLLQERIDVLCKNLLDKLSIWTETDMSDRVTDAFKQKMQFEAELLKDESFGNEMLHAIGSTYVQRANILIQSQSFLGIRGVWGSLCAKGTLLKDTWNTVVSAVDVQSSAAALAKAEEGEEQWSKEKRDEAARELTGKVLSATWKGTRFEVQSVIRTVSDKILYDKAVPLEKRINRANALLMIGQVFLKVAPNEKSDANYFEDLMNDRGK

SEQ ID NO: 20250 - protein, 376 aa, Zea mays
NSARGNILNNAGVTLIEGRGKIVDPHTVSVNGKLYTAKHILVSVGGRPSMPDIPGIEHVIDSDAALDLPSKPEKIAIVGGGYIALEFAGIFNGLKSEVHVFIRQKKVLRGFDEEVRDFVAEQMSLRGITFHTEQSPQAITKSNDGLLSLKTNKENFGGFSHVMFATGRRPNSKNLGLEAVGVEMDKNGAIVVDEYSRTSVDSIWAVGDVTNRVNLTPVALMEGGAFAKTVFGNEPTKPDYRAIPSAVFSQPPIGQVGLTEEQAIEEYGDVDVFVANFRPLKATLSGLPDRVLMKILVCATSNKVVGVHMCGDDAPEIIQGIAIAVKAGLTKQDFDATIGIHPTSAEEFVTMRSPTRKIRKSSTDQVESKDEVVSKQ

SEQ ID NO: 20251 - protein, 356 aa, Verticillium fungicola
MSRANPPNNASASRKISFNVSEQYDIQDVVGEGAYGVVCSAIHKPSGQKVAIKKITPFDHSMFCLRTLREMKLLRYFNHENIISILDIQKPRGYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 20252 - protein, 482 aa, Oryza sativa (japonica cultivar-group)
MAAAANGAACCGGATGPGYATPLEAMEKGPREKLLYVTCVYNGTGINKPDYLGTVDVDPNSPTYSQVIHRLPVTHVGDELHHSGWNACSSCHGDPSASRRFLILPSLLSGRVYVVDTLKDPRAPALHKVVEAEDIAEKTGLGFPHTSHCLASGEIMISCLGDKEGNAAGNGFLLLDSEFNVKGRWEKPGHSPLFGYDYWYQPRHKTMISSSWGAPAAFRTGFDLQHVQDGLYGRHLHVYDWPGGELKQTLDLGSTGLLPLEVRFLHDPSKDTGYVGCALTSNMVRFFKTADGSWSHEVAISIKPLKVRNWILPEMPGLITDFVISLDDRYLYLVNWLHGDIRQYNIEDPAKPVLAGQVWAGGLLQKGSEVVYVTEDDKEEQYSVPQVKGHRLRGGPQMIQLSLDGKRIYVTNSLFSRWDEQFYGQDLVKKGSHMLQIDVDTEKGGLSINPNFFVDFGAEPEGPSLAHEMRYPGGDCTSDIWI

SEQ ID NO: 20253 - protein, 416 aa, Pichia pastoris
MSLSNKLSVKDLDVAGKRVFIRVDFNVPLDGDKITNNQRIVAALPTIQYVLDHKPKVVVLASHLGRPNGEVNPKFSLKPVAAELSSLLGKKVTFLNDSVGPEVEKAVNSASNGEVILLENLRFHIEEEGSQKKDGQKIKADKEAVARFRKQLTALADVYVNDAFGTAHRAHSSMVGFELEQRAAGFLMAKELTYFAKALENPVRPFLAILGGAKVSDKIQLIDNLLDKVDSIIIGGGMAFTFIKVLDNVAIGNSLFDEAGAKLVPGLVEKAKKNNVKLVLPVDFVTADAFSKDAKVGEATVESGIPDGLQGLDAGPKSRELFAATIAEAKTIVWNGPPGVFEFDKFAEGTKSMLAAAIKNAQNGGTVIVGGGDTATVAKKFGGADKLSHVSTGGGASLELLEGKELPGVVYLSKKA

SEQ ID NO: 20254 - protein, 184 aa, Oryza rufipogon
FGSVYRGRLSIKGTVTEAAVKQLDRNGMRGNREFLVEVLMLSLLAEHPNLVTLLGYCTDGDHRILVYEYMARGSLEDHLLDLPPGAAALDWTTRMRIAQGAARGLEHLHDAARPPVIYRDFKASNILLDSSFQARLSDFGLAKVGPVGDKTHVSTRVMGTYGYCAPEYALTGKLTTCSDVYSFG

SEQ ID NO: 20255 - protein, 336 aa, Lotus corniculatus
MGSVPETVCVTGAAGFIGSWLVMRLMERGYMVRATVRDPANMKKVKHLLELPEAKTKPTLWKADLAEEGSFDEAIKGCTGVFHVATPMDFESKNPENEVIKPTINGVLDIMKACQKAKTVRRLVFTSSAGTLNVIEHQKQMFDESCWSDVEFCRRVKMTGWMYFVSKTLAEQEAWKFAKEHGIDFITIIPPLVVGSFLMPTMPPSLITALSPITGNEAHYSIIKQGQYVHLDDLCLAHIFLFEHPESEGRYICSASEATIHDIAKLINSKYPEYNIPTKFKNIPDELELVRFSSKKIKDMGFEFKYSLEDMYTGAIDTCKEKGLLPKAAENPSNGK

SEQ ID NO: 20256 - protein, 473 aa, Sinapis alba
MSPQTETKASVGFKAGVKDYKLTYYTPDYQTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHVHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMD

SEQ ID NO: 20257 - protein, 341 aa, Oryza sativa (indica cultivar-group)
MDHRELWPYGLRVLVIDDDCSYLSVMEDLLLKCSYKVTTYKNVREAVPFILDNPQIVDLVISDAFFPTEDGLLILQEVTSKFGIPTVIMASSGDTNTVMKYVANGAFDFLLKPVRIEELSNIWQHIFRKQMQDHKNNNMVGNLEKPGHPPSILAMARATPATTRSTATEASLAPLENEVRDDMVNYNGEITDIRDLGKSRLTWTTQLHRQFIAAVNHLGEDKAVPKKILGIMKVKHLTREQVASHLQKYRMQLKKSIPTTSKHGATLSSTALDKTQDHPSRSQYFNQDGCMEIMDYSLPRDDLSSGSECMLEELNDYSSEGFQDFRWDSDKQEYGPCFWNF

SEQ ID NO: 20258 - protein, 341 aa, Oryza glaberrima
MDHRELWPYGLRVLVIDDDCSYLSVMEDLLLKCSYKVTTYKNVREAVPFILDNPQIVDLVISDAFFPTEDGLLILQEVTSKFGIPTVIMASSGDTNTVMKYVANGASDFLLKPVRIEELSNIWQHIFRKQMQDHKNNNMVGNLEKPGHPPSILAMARATPATTKSTATEALLAPLENEVRDDMVNYNGEITDIRDLRKSRLTWTTQLHRQFIAAVNHLGEDKAVPKKILGIMKVKHLTREQVASHLQKYRMQLKKSIPTTSKHGATLSSTALDKTQDHPSRSQYFNQDGCMEIMDYSLPRDDLSSGSECMLEEQNDYSSEGFQDFRWDSDKQEYGPCFWNF

SEQ ID NO: 20259 - protein, 443 aa, Wigglesworthia glossinidia endosymbiont of Glossina brevipalpis [sequence omitted]

SEQ ID NO: 20260 - protein, 234 aa, Wigglesworthia glossinidia endosymbiont of Glossina brevipalpis
MSIIKLVLMRHGSSIWNDQDRFTGWTDIDLSEKGKNEVKYAGKMLKSFGYSFNFAYTSLLKRAIHSLWVILKEINQSWIPVEKSWRLNERHYGALQGFSKYEIEKKYGKNQLNEWRRGFSISPPKINEKDNYFILNDKRYLNLKTKKLLPFSESLKSTIDRIMPYWDGNIFPRLQNKEKIIIVAHGNSIRAIIKILCNLNEKEIIKINIPTGIPLIYEFDYNMVFKKKYFLFDR

SEQ ID NO: 20261 - protein, 210 aa, Wigglesworthia glossinidia endosymbiont of Glossina brevipalpis
MRIILIGSPGSGKGTQAKIMSKKYNLPHISCGDILRKQNKCCDINKLIKKGELINDKLVTNIVLEKLKNINLFKGFILDGFPRTLYQANSIKENKIKIDYVLELFLQEKYIYERVLGRIIDKVSGEIYHLKFNPPKFITEKSNKNKILVRRLDDKKSALQKRINDFFKNSCLISEFYKKESLEKKLKYKIINADFDINTISNKIFNIINV

SEQ ID NO: 20262 - protein, 496 aa, Shigella flexneri
MSTTTQNIPWYRHLNRAQWRAFSAAWLGYLLDGFDFVLIALVLTEVQGEFGLTTVQAASLISAAFISRWFGGLMLGAMGDRYGRRLAMVTSIVLFSAGTLACGFAPGYITMFIARLVIGMGMAGEYGSSATYVIESWPKHLRNKASGFLISGFSVGAVVAAQVYSLVVPVWGWRALFFIGILPIIFALWLRKNIPEAEDWKEKHAGKAPVRTMVDILYRGEHRIANIVMTLAAATALWFCFAGNLQNAAIVAVLGLLCAAIFISFMVQSTGKRWPTGVMLMVVVLFAFLYSWPIQALLPTYLKTDLAYNPHTVANVLFFSGFGAAVGCCVGGFLGDWLGTRKAYVCSLLASQLLIIPVFAIGGANVWVLGLLLFFQQMLGQGIAGILPKLIGGYFDTDQRAAGLGFTYNVGALGGALAPIIGALIAQRLDLGTALASLSFSLTFVVILLIGLDMPSRVQRWLRPEALRTHDAIDGKPFSGAVPFGSAKNDLVKTKS

SEQ ID NO: 20263 - protein, 496 aa, Escherichia coli O6
MSTTTQNIPWYRHLNRAQWRAFSAAWLGYLLDGFDFVLIALVLTEVQGEFGLTTVQAASLISAAFISRWFGGLMLGAMGDRYGRRLAMVTSIVLFSAGTLACGFAPGYITMFIARLVIGMGMAGEYGSSATYVIESWPKHLRNKASGFLISGFSVGAVVAAQVYSLVVPVWGWRALFFIGILPIIFALWLRKNIPEAEDWKEKHGGKAPVRTMVDILYRGEHRIANIVMTLAAATALWFCFAGNLQNAAIVAVLGLLCAAIFISFMVQSTGKRWPTGVMLMVVVLFAFLYSWPIQALLPTYLKTDLAYDPHTVANVLFFSGFGAAVGCCVGGFLGEWLGTRKAYVCSLLASQLLIIPVFAIGGANVWVLGLLLFFQQMLGQGISGILPKLIGGYFDTDQRAAGLGFTYNVGALGGALAPILGALIAQRLDLGTALGSLSFSLTFVVILLIGLDMPSRVQRWLRPEALRTHDAIDGKPFSGAVPFGSAKNDLVKTKS

SEQ ID NO: 20264 - protein, 256 aa, Wigglesworthia glossinidia endosymbiont of Glossina brevipalpis
MKLKPLILSNWKLNGNCLLVKKILLKLNEKLKNKNNLKVVIAPPVIYLSEFKKYVLKKNIFLAAQNVDVNLTGSFTGEISPIMLYEFGVKYVIIGHSERRLYHNESIEDVTKKFLILKKFNLIPVLCIGETKKNKDDKCIENEIVKQIDFILKKIGIEGFINTVIAYEPTWAIGKKDSASPKYIQKIHKFIRNYLSKYDNDISKKIILQYGGSVNSKNVKKIISQKDVNGVLLGRSSTNIEEFLYILDIIEKTKKS

SEQ ID NO: 20265 - protein, 375 aa, Oryza sativa
MTDAELRVEALSLSGASAIPPEYVRPEEERADLGDALELARAASDDDATARIPVVDISAFDNDGDGRHACVEAVRAAAEEWGVMHIAGHGLPGDVLGRLRAAGEAFFALPIAEKEAYANDPAAGRLQGYGSKLAANASGKREWEDYLFHLVHPDHLADHSLWPANPPEYVPVSRDFGGRVRTLASKLLAILSLGLGLPEETLERRLRGHELAGVDDDLLLQLKINYYPRCPRPDLAVGVEAHTDVSALSFILHNGVPGLQVHHAGSWVTARPEPGTIVVHVGDALEILTNGRYTSVLHRGLVSRDAVRLSWVVFCEPPPESVLLQPVQELLADGAGKPLFAPRTFKQHVQRKLFKKLKDQQDNNAAAASNGMITK

SEQ ID NO: 20266 - protein, 290 aa, Oryza sativa
MGKDEVMESGGAAGEFAAKDYTDPPPAPLIDAAELGSWSLYRAVIAEFIATLLFLYITVATVIGYKHQTDASASGADAACGGVGVLGISWAFGGMIFILVYCTAGISGGHINPAVTFGLFLARKVSLVRAILYIVAQCLGAICGVGLVNAFPNAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 20267 - protein, 351 aa, Schizosaccharomyces pombe
MATSGIQTKVPGIVSGFIGAIGRTPLIRLNTLSNETGCNILAKAEFQNPGGSVKDRAAYYVVRDAEKKGKLSRGGTIVEGTAGNTGIGLAHIARARGYKCVIYMPNTQSQAKIDTLKFLGAEVHPVPVAPFSNPLNYNHQARRHAESTPNASWTDQFDNVANLLSHYETTGPEIWDQTKGTVDGFTCSTGTGGTFAGVTKYLKEKSDGRVASFVADPPGSVLYSHIKTKGKHPDNKGSSFTEGIGQGRITGNVQPVYDLIDDAMKIPDEKSINMFFRLLDQEGLFLGGSSCLNVVAAVEMAKILGPGKTVVTILCDSGHKYATRLFSRSFLESKKLFDVIEPQYKKYIVLP

SEQ ID NO: 20268 - protein, 500 aa, Schizosaccharomyces pombe
MTIDLNVIQSDIISARRAPENSLFIDGKFVSPIEPAAKPIPLINPATEEIIGTCANASAKDVDSAVENAYNTFRSGIWAKWPGKQRGLVLRKIAKMMREKRELLAGIDTINCGKPTPYALFDIDSCADMFEYYAEVAETDNPTVKVPLPNNPGFCAFEKRFPRGVIGVITPWNFPLKMALWKLVPAIASGNCVVLKPSELAPWSCLEFALICKEAGLPDGVLNVIIGSGKESGAALSCHPKIAYLAFTGSLATGKKIMHAAAENIVPLTLELGGKSPLIICEDADLSLAIPSAAFAIFFNQGEACTAASRLIVHESVADEVLGGLVSEANKLIIGNGLDPQVTLGPVVSKTQFEKIVSYIQSAINEGCKCVVGGLPRSEQKGYFIPPTVFTNVQTHNKIWREEIFGPVLAVKTFHTNEEALELANDSEYGLGSGVFSTNPKTLEFFSNNIEAGMCSLNNYHVVTHELPWIGWKHSGLGVGLSKHGYNEYMRLKQITQYVG

SEQ ID NO: 20269 - protein, 444 aa, Arabidopsis thaliana
MVGSHKASGVLLVLLVVMATTIANGTPVVDKAKNAATAVEDTAKNAATAVGGAAASVGAKVSGAKPGAAVDVKASGAKGDGKTDDSAAFAAAWKEACAAGSTITVPKGEYMVESLEFKGPCKGPVTLELNGNFKAPATVKTTKPHAGWIDFENIADFTLNGNKAIFDGQGSLAWKANDCAKTGKCNSLPINIRFTGLTNSKINSITSTNSKLFHMNILNCKNITLSDIGIDAPPESLNTDGIHIGRSNGVNLIGAKIKTGDDCVSIGDGTENLIVENVECGPGHGISIGSLGRYPNEQPVKGVTVRKCLIKNTDNGVRIKTWPGSPPGIASNILFEDITMDNVSLPVLIDQEYCPYGHCKAGVPSQVKLSDVTIKGIKGTSATKVAVKLMCSKGVPCTNIALSDINLVHNGKEGPAVSACSNIKPILSGKLVPAACTEVAKPGP

SEQ ID NO: 20270 - protein, 339 aa, Fragaria x ananassa
MPADHSSSLSGHGQTVCVTGAGGFIASWLVKLLLERGYNVRGTVRNPEDPKNAHLRELEGAKERLSLRKADLLDFESLKEAINGCDGVFHTASPVTDDPEQMVEPAVNGTKNVIVAAAEAKVKRVVFTSSIGAVYMDPARGPDVVVDESCWSDLEFCKNTKNWYCYGKAVAEQAAWEEAKERGVDLVVVNPVLVLGPLLQPTINASIIHILKYLTGSAKTYANSVQAYVHVKDVALAHILVYETPSASGRYLCAESVLHRGDVVEILAKFFPEYPIPSKLKDDGKPRAIPYKFSNQKLQDLGLEFTSVKQSLYDTVKSLQEKGHLKVPTKQEEESIKIQ

SEQ ID NO: 20271 - protein, 50 aa, Zea mays
QLSNGEDNRDGENHNLSWNCGEEGEFASLSVRRLRKRQMRNFFVCLMVSQ

SEQ ID NO: 20272 - protein, 50 aa, Zea mays
  misc_feature (35)..(35): Xaa can be any naturally occurring amino acid
NLSNGEDNRDGENHNLSWNCGEEGEFASLSVRRLXKRQMRNFFVCLMVSQ

SEQ ID NO: 20273 - protein, 50 aa, Zea mays
NLSNGEDNRDGENHNLSWNCGEEGEFASLSVRRLRKRQMRNFFVCLIVSQ

SEQ ID NO: 20274 - protein, 50 aa, Zea mays
NLSNGEDNRDGENHNLSWNCGEEGEFASLSVRRLRKRQMRNFFVCLMVSQ

SEQ ID NO: 20275 - protein, 468 aa, Escherichia coli
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWELNYGEIAKIFRAGCIIRAQFLQKITDAYAQKAGIANLLLAPYFKQIADDYQQALRDVVAYAYQNGIPVPTFSAAIAYYDSYRSAVLPANLIQAQRDYFGAHTYKRTDKEGVFHTEWLE

SEQ ID NO: 20276 - protein, 471 aa, Escherichia coli
MLLPVIMAGGTGSRLWPMSRELYPKQFLRLYGQNSMLQETITRLSGLEIHEPMVICNEEHRFLVAEQLRQLNKLSNNIILEPVGRNTAPAIALAALQATRYGDDPLMLVLAADHIINNQSAFHDAIRVAEQYADEGHLVTFGIVPNAPETGYGYIQRGMALTDSAHTPYQVARFVEKPDRDRAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRVEHWVILAGTGQVTVNGKQFLLSENQSTFIPIGAEHCLENPGCIPLEVLEIQSGSYLGEDDIIRIKDQYGRC

SEQ ID NO: 20277 - protein, 452 aa, Escherichia coli
RELYPKQFLRLFGQNSMLQETITRLSGLEIHEPMVICNEEHRFLVAEQLRQLNKLSNNIILEPVGRNTAPAIALAALQATRYGDDPLMLVLAADHIINNQSAFHDAIRVAEQYADEGHLVTFGIVPNAPETGYGYIQRGVALTDSAHAPYQVARFVEKPDRERAEVYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGHVTVNGKQFLLTENQSTFIPIGAEHSLENPGRIPLEVLEIQSGSYLGEDDIIRIKDQYGRC

SEQ ID NO: 20278 - protein, 452 aa, Escherichia coli
RELYPKQFLRLFGQNSMLQETITRLSGLEIHEPMVICNEEHRFLVAEQLRQLNKLSNNIILEPVGRNTAPAIALAALQATRYGDDPLMLVLAADHIINNQPAFHDAIRVAEQYADEGHLVTFGIVPNAPETGYGYIQRGVALSNSAHSAYQVARFVEKPDRERAEAYLSSGEYYWNSGMFMFRAKKYLIELAKYRPDILETCQAAVNAADNGSDFINIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLSENQSTFIPIGAEHCLENPGCIPLEVLEIQSGAYLGEDDIIRIKDQYGRC

SEQ ID NO: 20279 - protein, 452 aa, Klebsiella pneumoniae
RELYPKQFLRLYGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 20280 - protein, 460 aa, Oryza sativa (japonica cultivar-group)
MSSSSPSLLSRRSTAELELPVPPEFRCPISLELMRDPVVGPTGITYDRAGIEAWLLAAGAGKTAAASSTCPVTKGDLRADDLVPNHALRRVIQAWCVANRCRGVERIPTPRVPVTPAQAGEVLGEVEAAARAGDAARCVAAVREVGRLARESDRDRRCLASAGAARALAAAVASFPAASDSASASSVLLDDVLAALVLVMPLDEEAIVAIGSSAASVALLANVAKHGDLQRRLQAVVVIREIVALSSCCSRNGGAATAIDLSDNLDGIIEVLVNTIRDPISPQATKASLVAAYHLALADGHAAARLAEAGLVPSLVELLIDGDRSTAEKALAALDATLASEAGRARAQADALAVPVLVKKMFRVSDTATELVVSALHRICKKWHDGDDDEVGSPAARRSAVVEAVQVGAFQKVMMLLQVGCRDATKEKATELLKLMIKYETRGGAHCIDAMDFRGLKRVS

SEQ ID NO: 20281 - protein, 391 aa, Oryza sativa (japonica cultivar-group)
MEPAHAPGRDRLSALPDNVLRRIMSFLNARQSVQTCVLSRRWRHLWRSLPRINADYTEFCFACLDEKKEKVQEARFKKFVSTLLLRRDPVPLLDKFWLRYQVSDGNNNEKASAEAGLWISHALQLQTPVVEVLTFQFPLMLDHAVFTSDYLRKLGLSNAYLRMGFFEQLSRGCPQLEDVFLNDCIILDDEISSTTLKTLNIYASRFSEDYRASISTPSLTSLTLYKPDASVPSLKDMKSLVSASIILDDNTDIHELLMSLSGVRNLDLECPQKMVTIAKNTQWCPEFKDLVNLSLGQFCLGSKLYALTVFLKNSPKLEKLTLDPPEVIIDKLEERSFECEHLKIVEVICSEDDSTLLKLVEDIFVTSGMNSLQINRKSSYKQYYSDDFFQI

SEQ ID NO: 20282 - protein, 337 aa, Oryza sativa (japonica cultivar-group)
MDATAIGNGALHSNGAGADTKGKPIKCKAAVAHGPGEALVMEEVEVAPPARMEVRLKVLFTSICHTDLSAWKGENELQRKFPRILGHEAAGVVESVGEGVEDLAPGDHVVPIFTGECGACTYCESSKSNLCKTYRVNPFKSTMVTDGGTRFTMIDRSSGARNPVYHFLNTSTFAEYTVIDSACAVKINPKAPLEKMSLLSCGVSTGVGAAWNTANVSKGSTVAIFGLGAIGLAVAEGARLRGASRIIGVDINPEKFSKECALVQNDKDYQPEGVQWYQNIGLASSPLGAIDFVHPYLIQWLKIANGIMDHCSSLPFEFEWQRIQTPKHEHFSIADVH

SEQ ID NO: 20283 - protein, 269 aa, Oryza sativa (japonica cultivar-group)
MSSSVVVSASGSGSGGGGGGGGGGAGGGGGGGPCGACKFLRRKCVQGCIFAPYFDSEAGAAHFAAVHKVFGASNVSKLLQQIPAHRRLDAVVTICYEAQARLRDPVYGCVAHIFHLQHQVAGLQSELNYLQGHLSTMELPSPPPYVAGPTLAPPQPQPLMPMTAAANFNFSDLPSSSAANIPVTADLSTLFDPLPAAQPQWGLYQQQQHHHQQLHHHPYDRMGDGSSSSRGGDDDGSDGGDLQALARELLDRHGRSSSSSKLEPPPHTQ

SEQ ID NO: 20284 - protein, 428 aa, Oryza sativa (japonica cultivar-group)
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQAEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATLLRIEEELGAAAVYAGAKFRAPVEPY

SEQ ID NO: 20285 - protein, 479 aa, Oryza sativa (japonica cultivar-group)
MANLIYYSLLIILPFLLLINFYKAMFSSRKQAGRLPPCPWQLPIMGSIHHLIGDLPHRSLHDLSRRYGPVMLLKFGQVPFIIVSSPEAAKDIMKTHDSIFAMRPQSEIMKIITKRGQGLVFAPYDDQWRQLRKICIRELLCAKRVQSFCAIREEEAARLVKSISSDQAHLVNLSKKLADYATDAAIRIITGTRFENQEVRDKFQYYQDEGVHLAASFCTANLCPSLQLGNTLSRTARKAEIYREGMFAFIGGIIDEHQERRAQDMYHKEDLIDVLLRIQQEGSLESPDILAGGSETVTTVLQWAMTELMRNPTVMSKAQDEVREVFKWKKMFVIKETVRLHTPGPLFMRECQEQCQVMGYDVPKGTKFLLNLWSISRDPKYWDDPETFKPERFENDARDFKGNDFEFIPFGAGRRMCPGMLFGLANIELALANLLFYFDWSLPDGVLPSELDMTENFGVTVRKKEDLLLHASLYAQLSC

SEQ ID NO: 20286 - protein, 403 aa, Oryza sativa (japonica cultivar-group)
MMGDFLSRVLLLAFGYAYPAYECYKTVELNKPEIEKLIFWCQYWILVALLTVLERFGDFAISWLPLYSEAKLMFFIYLWCPRTKGTSYVYETFFRPYISQYENDIDCSILDLRVRAGDMLVVYWQKVAIIGQTTFFNILKYASAQSPAHSSRSRSTQEIQTPETKICPRNRVDYLPSYINNKIICSTQDLGGISVDHSSAVIYLFLFITLPYQQSYPQKQQQAQPQQPKQSLPQQQQKQSLPQQQQQQMPHEKPTTLRRAASAAARTAGIMQQSEDTKIAYSNPKTRRLLPTKSAPTASTRSTVAATKPVEDLKSSGMKLATEEAPSPSSNAAMPGSEPSAPPLPKSAEDDMSIDEVDIPIEDMDEPVATPEETPMEEAIRVTRGRLRKRIAAVSTADGGAAN

SEQ ID NO: 20287 - protein, 1023 aa, Oryza sativa (japonica cultivar-group)
MGHLNIMLAFLSFVLLGLAEVEGTVALSQILSNSHLITPYREVTARKFERRSLLQDHSSDDRRSSNASLPSAATLANCPKRCGNLSFDYPFGIGDGCFRHPDFSLTCNATTQPPKLLLHINESVEVIDNIEVVGKDIAEFFYFNFFMVAFNHLIPIKAGVDVYNLTWKAPGISFTISEMMIITVVSCDLDVFLIGQDNTPKLLCMVACPNKEIADMVYMQDCEGPGCCTVLSETPVQAVQLQFVRHETSNAGKISNLSMLWDRINITIGAPLVWSIVDQTRCSRNMEDNFACVSNHSGCITSVFRDIGYACQCNSGYKGNPFILDGCKHDSGSSIFLFNSRELTKKRIIQQPHEKAYVYTIMFPTCIPFYQKQREHLEMGHNMEFLLMPGYNPRPEKHNCARQCGTITVPFPFGLEEGCSARKRFQLNCSDKTNSVLKFNDYFQVTYINVSEGLLGIKHNSSLEEQLFNIMMEMMTSDNEPDLFVDPLESVSVQWAVANLTCQEAQHNTSGYACVSTSSSCLNVLSSMDGYVGYRCSCLPGYRGNPYILDGCEDIDECRETPGICKGVCKNTVGNYSCTKCPDHTEYDILRMQCTPIRKKSFYLGIIIGLSSGFGMLLLGLSGIVLIRRWKRHAQKRLQTKYFRKNQGLLLEQLISSDENASEKTKIFSLEELKKATNNFDTTRILGRGGHGTVYKGILSNQHVVAIKKAKVIRECEINDFINEVSILSQINHRNIVKLFGCCLETEVPLLVYDFIPNGSLFGLLHPDSSSTIYLSWGDCLRIAAEAAGALYYLHSAASISIFHRDVKSSNILLDANYTAKVSDFGASRSVPIDQTHIITNVQGTFGYLDPEYYQTRQLNEKSDVYSFGVVLLELLLRKQPIFTINSGMKQNLCSYFLSEIKTRPITDMVDAQVLEEANEEDIKEVASLAEMCLKLKGEERPTMKKVEMTLQLLRTKTMNSSQVDPTIDQEIQTVLTEGASDPEIQPLVTNLDVDRANAASQRFQISCYSLEQEFLSSASLPR

SEQ ID NO: 20288 - protein, 218 aa, Oryza sativa (japonica cultivar-group)
MAAASATQATAAEAAAPCSTTKTESTSSSSFLRARCATTRYPDVCYDSLLPYASTFQTSHVKLAVAAADVAAAHLRAFSARVKDMLLHRGGGSEEAAASSGGGAARVDAVLHDCASTISAAANLAKRSSAELTRLDADTAASTETSTSGGSRQARWQLSNAKTWLSAAMTNEGTCSDGFEDAGAAATASPAGKEVAAGVASVTQHTSNALALVNGIPL

SEQ ID NO: 20289 - protein, 212 aa, Oryza sativa (japonica cultivar-group)
MAPLPPRAISLVFLFLFFTAASATRRLDDAGGQPTAASSATAFLRSRCATTRYPDVCYDSLLPYASTFQTSHVKLAVAAANVAAAKLRAFSARINDLLAQGGAARVDAALKDCKSTISDAGDLARQSSAELGQLDAGAAAAGVSSRQARWHVSNVQTWLSAAITDEGTCTDGFEEAGEAAAGSPAGKEVAAGVARVKQHTSIALALVNGIPL

SEQ ID NO: 20290 - protein, 221 aa, Oryza sativa (japonica cultivar-group)
MPSSRAGPRHVVLVMLFFAAAVAARGADAASPVTTRPCGAAAAASFLCSRCATTVYPAVCYDSLLPYAGAFQDSRVRLARAAADVAAARLRDFSASLDELVHGSGDVGAVTTPPRVAAAVRDCVGTVSSAAGLARRSSAALDRLDAGAAAGGGGSRLARWEVSNAKTWLSAAMANVATCADGFADADSWSAAGIEEVVAGEAANVSKYTSNALALVNGIPL

SEQ ID NO: 20291 - protein, 354 aa, Oryza sativa (japonica cultivar-group)
MAAECGSGNCDAWAARDPSGILSPYKFNRRAVQSDDVSLRITHCGVCYADVAWTRNILNNSMYPLVPGHEIAGVVTEVGADVKSFKVGDHVGVGTYVNSCRDCENCNSSLENYCSQHVFTFNGVDTDGTVTKGGYSTHIVVHERYCFKIPDGYPLEKAAPLLCAGITVYSPMMRHNMNQPGKSLGVIGLGGLGHMAVKFGKAFGLKVTVISTSESKRKEAIDLLGADNFVVSSDENQMETLKSSLNFIIDTASGDHPFDPYLTLLKVGGVMALLSFPSEIKVHPANLNLGGRSLSGSVTGGTKDIQEMINFCAANKIYPDIEMIKIDYINEALQRLVDRDVRFRFVIDIENSFK

SEQ ID NO: 20292 - protein, 311 aa, Oryza sativa (japonica cultivar-group)
MVMRKHLSMVAFNNITRLTFGKRFIDAAGELDEQGSELKAIVNNGIKIGASLTIAEHIRVLRWLNPVDEELYNAHSARRDRFTRRIMDEHARELERHGAKQHFVDALFTLRDKYDLSDDTVIGLLCDMIAAGTDTTVITVEWAMAELVRNPRVQMKAQEELDRVIGRGRVMLEADIPNLPYLQAVVKESFRLHPPTPLMLPHKASTSVKIAGYDVPKDASVVVNVDYRVLPFGAGRRVCPGAQLGISLVASMIGHLLHQFTWALQDGTRPEDLDMMESPGLVTFMATPLQVVAMPRLDKEELFKRVPVDMS

SEQ ID NO: 20293 - protein, 413 aa, Oryza sativa (japonica cultivar-group)
MAFARTPMVHMIANAIGVTKTVVIQKNNPAAQSITLGISFLIVGLLFILMMRQKRRMNEYFRKNGGSVLQKVENIKIFTKDELKKITKNNSEVLGQGGFGKVYKGILEDNTLVAVKASIEVNDARKEDFTNEVIIQSQMIHTNIIKLLGCCLEVDVPMLVYEFAANGNLQDILHGDNNRRVPLPLDLRMDIAVEAAEGLRYMHSSANRTIRHGDVKPANILLNDKFKPKISDFGTSKLLTVDKDFTMFVVGSMGYIDPVFHKTGRLTQKSDVYSFGVVLLELITRKPTIYDANCSLLIDFQKAYEQENSGRAMFDKDFTIEEEIFILEEIGRLAMECLKEKVEERPDMKEVAEQLVILRRSRKSRQGNYNISPQQFEEMSTEGTPLSLETAVSVSSSVLSAPSTPANNDFSNA

SEQ ID NO: 20294 - protein, 389 aa, Oryza sativa (japonica cultivar-group)
MGKKTTTSSSPSWSSLFGLGCFTSSHSDGGSAAAKNPGTPLPARPSSCNSNDGVAAAVMPSPEDLSQSLAGSGVEAFTVEELRRATRDFSVSNFVGEGGFGPVYKGYVDERLKPGVRAQAVAVKLLDLEGSQGHKEWLAEVIFLGQLRHHHLVKLIGYCYEDEHRLLVYEFMARGSLEKHLFKKYSASLPWSTRLKIAIGAARGLAFLHEAAKPVIYRDFKTSNILLNSDYEAKLSDFGLAKDGPQEDETHVSTRVMGTQGYAAPEYIMTGHLTTKSDVYSYGVVLLELLTGRKAVDKKRPPREQNLVEWARPCLHDSRRLNRVIDKSLNGQYSTRAVQKAAAIAYQCLSVSPKSRPRMSAVVEALEPLLAMDDGIVEPFVYMAPPESK

SEQ ID NO: 20295 - protein, 147 aa, Oryza sativa (japonica cultivar-group)
MTFFVVSLITRSMLVSQMEMGMNSVQPNAQFPVPHKSLSLDINGNKTDIVISKYEDNFMVMVTQIGCMGTILAARKDESVFSDPTYNVSVLFGKRDEPLLLACARQLIEHISGSGSARSLMISLGLKDHSQATMKYIVSTIIENRLW

SEQ ID NO: 20296 - protein, 508 aa, Oryza sativa (japonica cultivar-group)
MASSVALVLMKASLPRRQRMDRPRRSPAAVQLVAGVDAADDMFGSLAGCPPRPLEYPVVPDLDDYDVDDAPVAGRPAPASDKTLAVHAGEKLGSGAAAAETDSIATPIVGGTTHWFRDSADLIAFREGRRRSFEYGRYGNPTVKVLEEKISALERAEATLVTSSGMNAIVATLLALVPPGGHVVATADCYSEARAFIRDKLSNMGITVCKVVNTINGSFIKASAWHCLQSDSNNGVRSMDLQSTFVDLDDDMEALESVLDEGEVTMFYADSMTNPHLKVVDVTRVAELCHRRGALVCIDSTLASPINQKPLALGADVVLHSATKYIAGHHDVIAGCVSGSEALVSRIRTWHHDLGGAISPNAAYMIIRGLKTLALRVQAQNRTALRMAQLLEKHPKIERVYYPGLESSPWHGVATRQMAGAGGVVGLEVASDMRGAMRFVDALELPLIATSLGGCESLVQQPAIMSYWGKCDEEKAKNGIKDNFVRFSFGIEKFEDLRDDILQALGKI

SEQ ID NO: 20297 - protein, 472 aa, Oryza sativa (japonica cultivar-group)
MAKSSSLVTKVLVQRRRRVHRSRRSPTKPERAAAADTFGSLAGCPSSPEYPVVPDLDDCVVDTAVDDAPVVAAEAAGRRASDETLAVHAGEKLGSGAAETDSIATPIVSGTTHWFRDSADLIAFREGWRRSFEYGRYGNPTVKVLEEKISALERAEATLVTSSGMNAIVATLLALVPPGGHVVVTADCYSEARAFIHDKLSKMGITSTFVDLDDDMEALESVLDEDEVTMFYADSMTNPHLKVVDVARVAELCHRRGALVCIDSTLASPINQKPLALGADVVLHSATKYIAGHHDVIAGCVSGSEALISRIRAWHHDLGGAISPNAAYMIIRGLKTLALRVEAQNRTALRMARLLEKHPKIERVYYPGLESSPWHGVATRQMAGAGGVVSFEVASDMRGVMRFVDALELPLIATSLGGCESLVQQPAVMSYWGKSEEEKAKNGIKDNFVRFSFGIEKFEDLRDDILQALEKI

SEQ ID NO: 20298 - protein, 486 aa, Oryza sativa (japonica cultivar-group)
MAKSSSLVTKVSAQRRRRVHRPRRSPTKPERSAAAVALSHEKILLAGVDAAADMFGSLAGCPSSPEYPVVPDMDDRYVDGAVDDAPAAAAGRRASDETLAVHAGEKLGSGAAETDSIATPIVSGTTHWFRDSADLIAFREGRRRSFEYGRYGNPTVKVLEEKISALERAEATLVTSSGMNAIVATLLALVPPGGHVVATADCYSEARAFIRDKLSNMGITSTFVDLDDDMEALECVLDESEVTMFYADSMTNPHLKVVDVTRVAELCHRRGALVCIDSTLASPINQKPLALGADVVLHSATKYIAGHHDVIAGCVSGSEALISRIRAWHHDLGGAISPNAAYMIIRGLKTIALRVEAQNRTALRMARLLEKHPKIERVYYPGLESSLWHGVATRQMAGAGGVVSFDVASDLRGVMRFVDALELPLIATSLGGCESLVQQPAVMSYWGKSEEEKAKNGIKDNFVRFSFGIEKFEDLRDDILQALEKI

SEQ ID NO: 20299 - protein, 405 aa, Oryza sativa (japonica cultivar-group)
MESSRNGDVTVTYEHQLFGRRRNVAGGGGGFATYLDLVREEGDAGKMPPRRPLPAPPPHGVASWRRTYADGELDVFAAERYFKGAMDGADGYNKVDLASPVMAAAAARPAVAVSRPAPWTTRASVASAGSSGSTANSQAVLLREQRRRDKCCAHVGGILRSCSGKRSVHVGGAAVAATEPAGDPGDELPPATASRIEWYRDLRLDKAGDGVSHGGVVAAGLPPNLNSIGAARVAAIGREEGTAATSEYSSSSFRSNFTLLAPVKVTIPASGGDDDDDDVGSESSSDLFEIKSLMIDDCRGYEPSEASVQWSVVTASAADVSVAASGRGGGGGGKGRPAAAVAVRQQQHRRQADRPVGLLAGCVSHRAVDVSAVAAVCRPPPPPGAPATATRRRSDLSRFAHSGHL

SEQ ID NO: 20300 - protein, 434 aa, Oryza sativa (japonica cultivar-group)
MEHVQIPRVKLGTQGLEVSKLGFGCMGLTGVYNAPVAEEDGVAVVRRAFEAGVTFFDTSDAYGPHTNEVLLGKALKQLPREKVQVATKFGIAGFDANGMLVKGTPDYVRACCEASLERLAVDYIDLYYQHRIDQSVPIEETMGELKKLVEEGKVKFVGLSEASADTIRRAHAVYPITAVQMEWSLWTRDIEEEIIPLCRELGIGIVPYSPIGRGFFAGRAAVQSIPSESWLTRHPRYNGENLEKNKVFYTRIEELATKYGCSPAQLALSWVLHQGDDVVPIPGTTKVKNLDDNIGAVKVKLSKEDLKEISAAVPAGEVAGSRLIGVLEPYSWRVANTPPPKSLSRTCATPSIMGFEGIVLGLRCPCITHLEHRGMRVDRGTMAMMVEPLVLFLDHHHSQILLLQCNAMPGPKTLMQLKAMQQGTVYIFLSMVQH

SEQ ID NO: 20301 - protein, 230 aa, Oryza sativa (japonica cultivar-group)
MENEFQGWGWFEFSGSREILEGEVRNERAFSCIRQFIDGKTEVIEAWYMDDSEEDQRLPHHREPKEFIHVDKLTELGVISWRLNPDNWENCENLKRIREARGYSYVDICDVCPEKLPNYETKIKSFFEEHLHTDEEIRYCLEGSGYFDVRDQNDQWIRIALKKGGMIVLPAGMYHRFTLDTDNYIKAMRLFVGDPVWTPYNRPHDHLPARKEFLAKLLKSEGENQAVEGF

SEQ ID NO: 20302 - protein, 420 aa, Oryza sativa (japonica cultivar-group)
MATAEAAAAAARRGGGGGSNRGEASDGAGRRQRRAAAGARTARGGGEAAAAAAEEASGGGVQRRRQRRRRGEAVGEPGRAAPPPRRTHRRSTGDDDVAIKILFCGICHSDLHCIKNEWKHSIYPLVPGHEIAGVVTEVGKNVTRFKAGDRVGVGCMVNSCRSCESCNNGFENHCPEGVFTYNSVDKDGTVTYGGYSSMVVVHERFVVMFPEAMPLDVGAPLLCAGITVYTPMKYHGLNAPGKHVGVLGLGGLGHVAVKFARAFGLKVTVISSSPGKKREALERLGADAFVVSSSAEEMEAARSTMDGVINTVSANTPMAPYLALLKPNGKMILVGLPENPLEVPPFSLVHGNRTLAGSNIGGMADTQEMIELAAKHGVTADIEVIGADDVNTAMERLAKADVRYRFVIDVGNTLHAAAAE

SEQ ID NO: 20303 - protein, 1192 aa, Oryza sativa (japonica cultivar-group)
MDGVVALARPAGEGEEPGPRRCAHPALPRGHGGGGLQVEVGRVRDGRVVPIPWARLDEDRCYVLDGGVGEQLAAPLPAFVAVSPEVPSGAADDEEMVAASHGVPLRRSGRHVSHPPRSSKSVSFTDAFRWKSSESSEEAVGLTVLTVRISGWRGWVNAGLVLGVKSWPWHCPAHQRGCEFVIMEILELVSQSYRFNVFVYHKTTGYNRIMGKKNSVNKDALLYFFHMSATSNNAGGVGTISNENSGTDLKNLRVKLVLLGDSGVGKSCIVLRFVRGQFDPTSKVTVGASFLSQTLALEDSTTVKFEIWDTAGQESICVAIRYQRSHENWLIFRYAALAPLYYRGAGAAIVVYDITSSESFNKAQYWVKMYVDHGLHLTSINHELQKHGSPDMIMALVGNKADLHDNRSVSSQDAQEYAERNTMFFIETSAKTADNINQLFEVCIRSISESVGLNRNWSMTVETMINFSCVQFLSCSLRAFISSAKLVLLHLKNSETYGLPLMIDDPSMHLKPHSIVSFLVLLLLFHAAAAGGDGDQFRYDGFAGAALDLDGMAVVEPDGKLMLTNVTSQMKGHAFHPAPLRFHHPPPANGTAAAARSFSTAFVFAIAADYVTVSGNGLAFFVAPSKNMSTASPSQFLGLFNSENNGNASNRVFAVELDTILNPEFRDINSNHVGVDVNGLVSVAAEPAGYYDDATGGAFKNLTLFSGAAMQVWVDYDGRAAVVNVTLAPVEVAKPRRPLISVAVDLSPVVNGTAYVGLSSSTGPFHTRHYVLGWSFAMDGPAPPLDYAKLPKMPVVSAKRRSKALDVVIPVAAPLLALAVVAGVSFLVWRRLRYAELREDWEVEFGPHRFAYKDLFVATAGFDGKRLLGVGGFGRVYRGVLPASGTEVAVKIVSHDAKQGMRQFVAEVVSIGRLRHRNVVPLLGYCRRRGELLLVYDYMPNGSLDRWLHDHGAPPLGWAQRLHAVRGVAAGLLYLHEDWEQVVVHRDVKASNVLLDGEMNARLGDFGLARLYDRGADPQTTRVVGTMGYLAPELAHTRRVTPATDVFAFGSFVLEVACGRRPIERGGAMTAAADEDGQLVLADWVLDRWHKGDIAAAADARLCGDYDAKEAALVLKLGLLCSHPVAAARPTMRQVVHFLDGDAPLPEPEPTYRSFTTLAMMQNADGFDSCAVSYPSTATSIDGASSVLSGGR

SEQ ID NO: 20304 - protein, 445 aa, Oryza sativa (japonica cultivar-group)
MSKAMQCFGFAGWERDERRGRSSAVASAAAATTRSLSARSNSSTSTDRDARRSGSECSLNVSSEISAESFGRYRQLSLPQRASNNLRIFTFQELKSATRGFSRSLVLGEGGFGCVYRGTIRSVLEPRRSVEVAIKQLGRKGLQGHKEWVTEVNVLGVVDHPNLVKLIGYCAEDDERGMQLLLVYEFMPNGSLADHLSSRSPRPASWAMRLRVALDTARGLKYLHEESEIKIIFRDLKPSNILIDENWNAKLSDFGLARLVSQDGSHVSTAVVGTIGYAAPEYIHTGRLSSKNDIWSYGVVLYELLTGRRPLDRNRPRGEQNLIEWVKPYSTDSKKLEIIMDPRLEGSYSLKSAAKLASVANKCLVRHARHRPKMSEVLEMVQKIVDSTDLGTPEHPLISKSRELTRDEKKRKGLDLKRRFADIKAGGDQRWFTWQRWRPKLVRTQ

SEQ ID NO: 20305 - protein, 294 aa, Oryza sativa (japonica cultivar-group)
MPCKPDYRKDESGLTTEDGQYDGWDDQQSAGGSSNWNSRANRSFGLADIPEWTGKPSLPYEDPDMLRFLGEPILTPKNNEVFDDTIGKGRPDKCNCEVPGSTSCVRFHVAEKKTELKREMGSSYYAMKFDEIGQDAALTWQKDEEKKFETIVQQNLPSSKYNFWDKLRAAFRYKGERALVSYYNNVFQPRRRAFQNRVAQHANGVDSDDDSIEPAFLRLRQDGVQLHLELKTQKVHLFLSSPIGYWTGDDYLKRLFYHYLGVLGGMSGCFMLILSQRSGQMFLRIFSCKVTTET

SEQ ID NO: 20306 - protein, 465 aa, Oryza sativa (japonica cultivar-group)
MEVATMLTLTLLAYSAAMLARLLVARSRRRRCYLLDYVCYKATDDRKLPTDLCGEIIQRNKLLGLEEYKFLLKVIVNSGIGEETYGPRNIIGGGDARPDRLAEGMEEMDETFHAVLDELFARSSAAGGGGVRPADVDLLVVNVSMFSPAPSLSARVVRRYNLREDVKVYNLTGMGCSATLIALDLVNNFLRTHANKVALVMTSESIAPNWYAGNKRSFMLGNCLFRSGGCAYFLTNDPRHRRHAKLRLRHLVRTHTGASDDAYSCALQMEDDAGRPGFHLGKDLPRAAVHAFVKNLRLLAPRVLPLPELLRLAFATFLSSGRRSGGKKTSPSQQPLTIRMKAGVDHFCVHTGGAAVIDGVGKGLTLTEHDLEPSRMTLHRFGNTSASSVWYVLGYMEAKRRLRPGDRVLMLTFGAGFKCNSCVWTVEKPVSDAGVWKDCIDHYPPKELANPFMEKYGFVKDMMNL

SEQ ID NO: 20307 - protein, 214 aa, Oryza sativa (japonica cultivar-group)
MARSLSLLLLLVACFLVAGATAARPAPSTSGAAAISSFVRSWCAGTKYPALCDATLAPYSAAVGASPAKLAWAALTVTLSAARNATSAVRSIAARSSSSHLPPVAAEAAGDCASELGDGVDALRRCVDAMARVAVGEESSSTAAAARRKVRFEVDNVRTWASAALTDDNMCMEGFKGEAAGGGGAREAVRGHIMGLLHLTANALGILNAMAKQI

SEQ ID NO: 20308 - protein, 158 aa, Oryza sativa (japonica cultivar-group)
MEVFGKSVIAEPSNVIYLSSILNTEGPIPSHKCDKNCQNEHVFGNMYRCKLTGTTHICDKNCNQRILYDNHSSLCRVSGQLFPLSPLEQQAVRGIRRKHEVDSNEGCSFKRRRGAQLHPSPFERSYTAVSPIPSQPNLITTSRAEQHDFQFQIMTQKT

SEQ ID NO: 20309 - protein, 241 aa, Oryza sativa (japonica cultivar-group)
MQLVFFPYLMLHVCLGAEFVGTFILIFFATAAPIVNQKYGGAISPFGNAACAGLAVTTIILSTGHISGAHLNPSLTIAFAALRHFPWLQVPAYVAVQVLGSICAGFALKGVFHPFLSGGVTVPDPTISTAQAFFTEFIITFNLLFVVTAVATDTRAVGELAGIAVGAAVTLNILIAGPTTGGSMNPVRTLGPAVAAGNYRQLWIYLIAPTLGAVAGAGVYTAVKLRDENGETPRPQRSFRR

SEQ ID NO: 20310 - protein, 512 aa, Oryza sativa (japonica cultivar-group)
MDNLVILAGVLLLPLLFLLRNAASSRRRRLPPGPPAVPLFGNLLWLRHSAADVEPLLLTLFKKYGPVVTLRIGSRLSIFVADRHLAHAALIAAGAKLADRPQAATSTLLGVSDNIITRANYGAMWRLLRRNLVSQTLQQSRVDQFAPARVWVRRVLMEKLRGSGEEAPNVMEAFQYTMFCLLVLMCFGERLDEPAVRDVEEAERAWLLYISRRMSVFFFFPWITKHLFRGRLEAAHALRRRQKELFVPLIEARREYKRLASQGLPPARETTFQHSYVDTLLDVKIPEEGNRALTDDEIVTLCSEFLNAGTDTTSTGLQWIMAELVKNPAVQEKLYAEINATCGGDDELLERNVRDKDNKMPYLNAVVKEGLRKHPPGHFVLPHKAAEDMDVGGYLIPKGATVNFMVAEIGRDEREWENPMQFMPERFLDGGHGAGVDMHGTKGIKMMPFGVGRRICAGLNIAMLHLEYFVGSMVMEFEWKEVEGHEVEFAEKREFTTVMAKPLRPRLVPRRS

SEQ ID NO: 20311 - protein, 386 aa, Oryza sativa (japonica cultivar-group)
MDSSSGGAGGGGGAQIKGMGTHGGRYVLYNVYGNFFEVSSKYAPPIRPIGRGAYGIVCAAVNSENGEEVAIKKIGNAFDNHIDAKRTLREIKLLRHMDHENSDGDFNTGSQIIAIKDIIRPPRRDNFNDVYIVSELMDTDLHQIIRSNQPLTDDHCQYFLYQLLRGLKYVHSANVLHRDLKPSNLFLNANCDLKIADFGLARTTTETDLMTEYVVTRWYRAPELLLNCSQYTAAIDVWSVGCILGEIVTRQPLFPGRDYIQQLKLITELIGSPDDSSLGFLRSDNARRYMKQLPQYPRQDFRLRFRNMSAGAVDLLEKMLVFDPSRRITVDEALHHPYLASLHDINEEPTCPAPFSFDFEQPSFTEEHIKELIWRESLAFNPDPPY

SEQ ID NO: 20312 - protein, 301 aa, Oryza sativa (japonica cultivar-group)
MLPYATAAEAEAALGRAMTAAESLWFRYSAGIPDYVLFWHNILFLFVVFTLAPLPVALLELRAPAAVGPFKLQPKVRLSREEFFRCYRDVMRLFFLVIGPLQLVSYPTVKMVGIHTGLPLPSLGEMAAQLLVYFLVEDYLNYWIHRLLHGEWGYEKIHRVHHEFTAPIGFAAPYAHWAEVLILGIPSFVGPALAPGHMITFWLWIVLRQMEAIETHSGFDFPFNLTKYIPFYGGAEYHDYHHYVGRQSQSNFASVFTYCDYLYGTDKGYRYHKAYQAKMKALGQTEGEKADSNGLSYAKLD

SEQ ID NO: 20313 - protein, 382 aa, Oryza sativa (japonica cultivar-group)
MDLKTSNSPVIADPLPKLALPSAVMTYTTPTSFPSTGLYLNTPKKKPLPGKIEEVRAAGWLDLMLASSPPRKRQTKDFANDVQADELDLLYRNWVVNHPSALTSFEDIVNLARGKRLALFLDYDGTLSPIVDNPENAVMSDEMRSAVKHVASLFPTAIISGRSRDKVFDFVKLTELYYAGSHGMDIMGPVRKSDSSGQHVECIRSTDSEGKEVNLFQPASEFLPMISEVYKKLSESIKDIDGARMEDNKFCVSVHYRNVAPHDYGEVHQRVTAVLKNYPCLRLTHGRKVLEVRPVIDWNKGKAVEFLLESLGLCGKEDVLPIYVGDDKTDEDAFKVLKANSIGFGILVSSVPKDTDAFYSVRDPAEVMEFLKKLASWKEEST

SEQ ID NO: 20314 - protein, 427 aa, Oryza sativa (japonica cultivar-group)
MPSPSLRLAVVGAGAAGLVAARELRREGHSPVVFERAASVGGTWLYDAAPATSDPLAAGAAHSSLYASLRTNLPREVMGFLDFPFASSAAEAGGGGDTRRFPGHDEVLRYLEEFARRFDLYGLVRFGTEVVRVRRDGGGGGGRWAVTSRKIGEKGRREEEEEVYDAIVVCNGHYTEPRVAHIPGVEAWPGKQMHSHNYRVPEPFHDQVVIIIGASASAVDISRDLAGVAEEVHVADRSAPACTCKRQPGYDNMWLHSMVNALFSCYLYDFPFLEDDSAITVDDNCVDPLYKHVFPPEVAPHLSFIGLPWKVIPFPLFELQSKWVAGVLSGRVKLPSSEEMMEDVKAFHSKMEARGWPKRYAHNFSDCQFEYDDWLAEQCGHPPIEQWRKLMYAANSENKAARPESYRDEWDDDHLVAEAAEDFKKYL

SEQ ID NO: 20315 - protein, 280 aa, Oryza sativa (japonica cultivar-group)
MSGAYRDRGFGGAAAEMDRKRIKDVLEKHLDRSSPSTSRGAAVAKERDRLAAAGGKLPAPLGKAGKVSDGAEEFETDSEDSDVSGSEGEDTSWISWFCSLRGNEFFCEIDDDYIQDDFNLCGLSNQVPYYDYALDLILDIESSNGDVFTEEQNELIESSAEMLYGLIHARYILTSKGLAAMLEKFKNYDFGRCPRVYCCGQPCLPAGQSDIPRSSTVKIYCPKCEDLHYPRSKYQGNIDGAYFGTTFPHLFLMTYPHLKPQKPSQQYVPKVFGFKLHKQS

SEQ ID NO: 20316 - protein, 370 aa, Sclerotinia sclerotiorum
MHRDFSIPGLLALTLAGVCTAQTACTASVYSQIAPCVASSTAIVLNNIYAPSGSSIDLTKVKAGTKITFAGKTTFGFTNDSSFDPIKLSGSGIHVTGAPGAVIDGNGQAYWNGYGSNDDVPKPNHFIAASKLVGGSVIENLYIQNWPVHLFTITGAVGLTVQNLILNNTAGDVPNAASGTLPAAHNSDGFDLSSSVDTIIRNSSVYNQDDCVAVTSGNNITIDGLYCSGGHGLSIGSVGGKSNNNVTNITFKNSQIVNSSNGARIKSNEGTTGFISNITYSNIKLTNIDTYGIDVQQDYLNGGPTGNPTNGVLIQNILFQNVTGTAAASARNYYVLCGSGSCNNITFSGVKITGGAVASTCNYPSTGCPK

SEQ ID NO: 20317 - protein, 392 aa, Sclerotinia sclerotiorum
MQLASATTSVTALTHVAVTTSASSTAVASSASAASAVITPAPSAPAGCTATAYADIAFVVASCTNIVLDNISAPASSTIDLQKLKDGTTVTFSGKTTFGTTSDDSFNPIVVKGKNITLTGAPGHVIDGNGPAYWDGEGSNGGTKKPDHFFVVKDIVNGVISNLNIQNWPTHCFDITGAKGLTVSGLTLDNSAGDAPNSASGSKAAAHNSDGFDISNSDSVTLKNIVVKNQDDCVAVTSGSNILVTGMACSGGHGLSIGSVGGKSNNTVSGVTFSDSTITNSQNGCRIKSNSGKTGTIENVTYSNIQMSNISNYGIDVQQDYLNGGPTGEPTNGVTISNIAFSGVTGTTTSNAYNYYILCGSGSCSNFKFTDVSISGGGKTSSCNFPSSGCPA

SEQ ID NO: 20318 - protein, 485 aa, Brassica napus
MKSFNTDQHGHSAAESGDVYAMSDPTKNVDDDGREKRTGTWLTASAHIITAVIGSGVLSLAWAIAQLGWIAGTLILIIFSFITYFTSTMLADCYRAPDPLTGKRNYTYMDVVRSYLGGRKVQLCGVAQYGNLIGITVGYTITASISLVAIGKANCYHNKGHHADCTISNYPYMAAFGIIQILLSQIPNFHKLSFLSLMAAVMSFAYASIGIGLAIATVAGGKVGKTNMTGTVVGVDVTAAQKIWRSFQAVGDIAFAYAYATVLIEIQDTLRSSPAENKAMKRASFVGVSTTTFFYILCGCLGYAAFGNKAPGDFLTNFGFYEPFWLIDFANACIAFHLIGAYQVFAQPIFQFVEKKCNRNWPDNKFITSEYSVNIPFLGKFSINLFRLVWRTAYVVITTLVAMIFPFFNAILGLIGAASFWPLTVYFPVEMHIAQTKVKKYSSRWIGLKMLCWVCLIVSLLAAAGSIAGLISSVKTYKPFRTIHE

SEQ ID NO: 20319 - protein, 481 aa, Brassica napus
MEKKSMFIEQSFTDHKSGDMNKNFDDDGRQKRTGTWMTGSAHIITAVIGSGVLSLAWAIAQLGWVAGPAVLMAFSFITYFTSTMLADCYRSPDPVTGKRNYTYMEVVRSYLGGRKVMLCGLAQYGNLIGITIGYTITASISMVAVKRSNCFHKNGHNVKCSTSNTPFMIIFACIQIVLSQIPNFHNLSWLSILAAVMSFSYASIGIGLSIAKVAGGGVHARTALTGVTVGVDVTGSEKVWRTFQAVGDIAFAYAYSTVLIEIQDTLKASPPSENKAMKRASLVGVSTTTFFYMLCGCVGYAAFGNNAPGNFLTGFGFYEPFWLIDFANVCIAVHLVGAYQVFCQPIFQFVESQSAKRWPDNKFITGEYKMNVPCGGDFGISLFRLVWRTSYVVVTAVVAMIFPFFNDFLGLIGAASFWPLTVYFPIEMHIAQKNMKKFSFTWTWLKILSWACFLVSLVAAAGSVQGLIQSLKDFKPFQAPE

SEQ ID NO: 20320 - protein, 123 aa, Panax ginseng
MGSNKAFLLLGLSLAIVLLISSEVAARELAEAQTTTTNKNTEAATVDGRSGYNGYGGGGYHGGGGYHGGGGYHGGGGYHGGGGYHGGGGHGGGGCSHGYCRYRCCNYAGEVVDAETTGVKPQN

SEQ ID NO: 20321 - protein, 386 aa, Arabidopsis thaliana
MVGQWEEEVDEEVVIRCYDDRRDRIQMGRMEKSCEIGHDHQTLLFTDTLGDPICRIRNSPFFIMLVAGVGNKLVGSIQGSVKPVEFHDKSVRVGYVLGLRVVPSYRRRGIGSILVRKLEEWFESHNADYAYMATEKDNEASHGLFIGRLGYVVFRNPAILVNPVNPGRGLKLPSDIGIRKLKVKEAESLYRRNVAATTEFFPDDINKILRNKLSIGTWVAYYNNVDNTRSWAMLSVWDSSKVFKLRIERAPLSYLLLTKVSKLFGNFLSLLGLTVLPDLFTPFGFYFLYGVHSEGPHCGKLVRALCEHVHNMAALNDGCACKVVVVEVDKGSNGDDSLQRCIPHWKMLSCDDDMWCIKPLKCEKNKFDLSERSKSRSSLFVDPREV

SEQ ID NO: 20322 - protein, 485 aa, Cunninghamella elegans
MVEAVADIGLIGLAVMGQNLILNMNDHGFVVCAYNRTTSKVDDFLANEAKGTNVVGAHSVEELCAKLKRPRKVMLLVKAGSAVDAFIDQLLPHLEEGDIIIDGGNSHFPDSIRRTKELEAKGILFVGSGVSGGEEGARYGPSLMPGGNSKAWEHIQPIFQAIAAKAPDGASCCEWVGETGAGHYVKMVHNGIEYGDMQLITEVYQILHEGLGLSHDEMADIFEEWNKGDLDSFLIEITRDILRFKDTDGQPLVTKIRDTAGQKGTGKWTAIDSLDRGIPVTLIGEAVYSRCLSSLKDERVRASKILQGPSSSKFTGDKKTFIAQLGQALYAAKIVSYAQGYMLMRQAAKDYEWKLNNAGIALMWRGGCIIRSVFLGKIRDAYTKNPELENLLFDDFFKDATAKAQDAWRNVTAQAVLMGIPTPALSTALNFYDGLRHEILPANLLQAQRDYFGAHTYELLHTPGKWVHTNWTGRGGNVSASTYDA

SEQ ID NO: 20323 - protein, 217 aa, Neurospora crassa
MKSIFLSLSLLASATVGVLAAEELGIDVTVPVECDRKTRKGDKINVHYRGTLQSNGQQFDASYDRGTPFSFKLGGGQVIKGWDEGLVDMCIGEKRTLTVPPSYGYGQRSIGPIPAGSTLIFETELIGIDGVPKPESIVYKQAAEKAEEAASAVEEKVAEATDKAGGKIADATKKVEEKAEEASANVVEKVASVVSGAAEAVKTVVADTDDVQEHNEL

SEQ ID NO: 20324 - protein, 405 aa, Phaffia rhodozyma
MISDTVIAILAVALVGSTVQAAPVDATATSTSGIIAVPISKSAAQLAREADPVVSLDWLKKTKAQAQYKHKQANARLHSKRATGASVLTDQGSESLWTGPITIGGQSFTVDWDTGSSDLWVPSSACSSAACNAHHKYTLTSTGKKQSGTFSISYGDGSSASGPVYKDNVVASGLQATSQVFGAVTSESSSFSSDPSDGISGLGWPALAQLSGTSYFWSLINQGTVTSPVFSFRLATTNSELYLGGINSAHYTGAITYTPVTQKAYWTIALGGVSVNGAAINPSVSSAIIDTGTTLVYGPTAGVAALYAKIPGSASMADTYGSDYQGYYTFPCSAVPTVALTFGGSSFSVPTSAFNLGTVSSGSKQCVGGIVGQGDGSWLVGDVFLQGVYSIYDVGNARVGFAKTV

SEQ ID NO: 20325 - protein, 187 aa, Capsicum annuum
MASSVMSTATVATGANAAQASMIASFNGLKSAASFPVTRKQDLDITSIASNGGRVECMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEATKFSMFNV

SEQ ID NO: 20326 - protein, 434 aa, Staphylococcus aureus
MPIITDVYAREVLDSRGNPTVEVEVLTESGAFGRALVPSGASTGEHEAVELRDGDKSRYLGKGVTKAVENVNEIIAPEIIEGEFSVLDQVSIDKMMIALDGTPNKGKLGANAILGVSIAVARAAADLLGQPLYKYLGGFNGKQLPVPMMNIVNGGSHSDAPIAFQEFMILPVGATTFKESLRWGTEIFHNLKSILSQRGLETAVGDEGGFAPKFEGTEDAVETIIQAIEAAGYKPGEEVFLGFDCASSEFYENGVYDYSKFEGEHGAKRTAAEQVDYLEQLVDKYPIITIEDGMDENDWDGWKQLTERIGDRVQLVGDDLFVTNTEILAKGIENGIGNSILIKVNQIGTLTETFDAIEMAQKAGYTAVVSHRSGETEDTTIADIAVATNAGQIKTGSLSRTDRIAKYNQLLRIEDELFETAKYDGIKSFYNLDK

SEQ ID NO: 20327 - protein, 271 aa, Mycobacterium intracellulare
MTVKQSEASRLGPIFDVCRDDGRAALIGYLPTGYPDVTTSVHAMVALVESGCDIVEVGVPYSDPGMDGPTIVKATEAALHGGVRVRDTLAAVEAISAAGGHAVVMTYWNPVLRYGIDAFARDLASAGGYGLITPDLIPDEAGQWLAASEEHRLDRIFLVAPSSTPQRLAMTVEASRGFVYAASTMGVTGARDVVSNAAPELVGRVKEISDIPVGVGLGVRSGEQAAQIGGYADGVIVGSALVSALGDGGLTALRALTEELAAGVRQRAAAS

SEQ ID NO: 20328 - protein, 201 aa, Mesembryanthemum crystallinum
MGCASSAPDRTVSRGSSSLNSANEGASDAKNLKVKLVLLGDSGVGKSCIVLRFVRGQFDPTSKVTVGASFLSQTIALQDSSTVKFEIWDTAGQERYAALAPLYYRGAAVAVIVYDITSPESFTKAQYWVKELQKHGSPDIIMALVGNKADLQERREVPAQDGIEYAEKNGMFFIETSAKTADNINQLFEEIAKRLPRLLPS

SEQ ID NO: 20329 - protein, 409 aa, Sphingomonas sp.
MRSADVVIVGAGHAGAQCAIALRQAGYEGSIALVGRENEVPYERPPLSKEYFSREKSFERLYIRPPEFWREKDIHLTLGIEVSAVDPGSKVLTLSDGSAFAYGQLVWATGGDPRKLACPGAELSGVHAIRTRADCDRLMAEIDRGLTQVVVVGGGYIGLEAAAVLTKLNCHVTLLEAMPRVLARVAGTELSTFYENEHRGHGVDLRTGITVAALEGQESVTGVRLGDGSVLPAQAVIVGIGIVPAVAPLIEAGAAGDGGVTVDEYCRTSLPDVFAIGDCASFSCSFADGRVLRVESVQNANDQASCVAKTICGDPQPYRAFPWFWSNQYDLRLQTAGLSLGYDQTVVRGDPAVRSFSVLYLKQGRVIALDCVNMVKDYVQGRKLVEANVCVSPEQLVDTGLALKDLIPV

SEQ ID NO: 20330 - protein, 400 aa, Xanthomonas campestris
MAPKPKNTNAAGGTAKSATKASSKKATKLAGKDSAKPLATAAPVLADVRAKIDEIDRGIQALIAERANFAHQVGKAKGKLAAAVDYYRPEREAQVLRMVVDRNEGPLSDEVLVHVFREIMSACLAQQEPLKIGYLGPEGTFSQQAVLKHFGRSAVGLPMATIEEVFQEVEAGNADFGVVPVENSGQGTIQVTLDMFLTSNLKICGEVELRVHQYLLSRNGRLEDIERIYAHSQSFAQTAGWLRSHLPKVEKIAVSSNAEGARRARNAEDAAAIGGESAAHVYGLKKVIMKSIEDDDDNTTRFLVIGRQIFPSSGHDRTSVLVFIHDKPGALFDVLSPFARHGISMNRIESRPSHQAKWEYGFFIDLAGHVEDESMKQALAELEAHSAQIKVLGSYPVAIP

SEQ ID NO: 20331 - protein, 135 aa, Viola cornuta
PEDKRDLSIWPTKPSNYTEVTSEYARQLRGLATKIFSALSVGLGLEESRLEKEVGGLEELLLQMKINYYPKCPQPELALGVEAHTDISALTFILHNMVPGLQLFHEGKWVTAKCVPNSIIMHIGDTIEILSNGKY

SEQ ID NO: 20332 - protein, 182 aa, Mycoplasma gallisepticum R
MMSKLNYTIEKILITNEQINEAAIKAANWINQTYKDDEIILVGILKGCIPFIGKIIDKIECEMILDFMTLSSFKGETKSQGTPKIVMDLAYDVMDKNVLLVEDIIDSGNTIKIVLDLLKQRGAKSVRLLTFLDKPSGREVDVKADYVCFEVPHGFLVGFGLDYKDKLRNLPYVAHMVSNDKK

SEQ ID NO: 20333 - protein, 220 aa, Mycoplasma gallisepticum R
MRGEPTVIRLIFLGAPGTGKGTISSYLKEQHGFFHISSGDLFRFYAKEEKTALAEEIKSYINNGLYVPDELTNRTVADFYHKNQSQDKIIFDGYPRTLNQCEYIDEIIKFTHVILLQPTDWDMIINRLSLRRSCPQCKRIYNINSVDFKPKVANLCDLCKVELIHRKDDDPSVVSTRINVYNEQTKPVIEYYKKKNLLHVVDANKSFEELYKLVLEIVNK

SEQ ID NO: 20334 - protein, 396 aa, Mycoplasma gallisepticum R
MNKYYMSSKRDYYEILEVSRSATQQDIKKAFRKLAMKYHPDRNKDSDAEEKFKEVNEAYEVLSDEEKRKLYDTYGHEGLNASGFHQGGFNPYDVFNSVFSGFDFEGGFGDVFSQFFGGGGSGFHNQEYIEEVDVNLVHEIKINFLEAANGCIKNVKYTRQVTCPDCNGSGSADGDVITCSDCNGEGFLVEQRRTLLGMFQTKKTCPSCKGEGQTIKNKCKKCKSRRMVDEVVERKVSIDSNVFYQDVVIVRGEGHIYKNLVGDLFLRVKIEPSRVFELRDNHVVVNVLVDPLVAITGGTILIPTLKEIKEINLKAGTKNGDIITIANGGINLKLDSRVYGANYNQKGDLIVVINYARPSEYSKQEITKLKEFIKPNKEVNLYETLMKKELNNKDSQ

SEQ ID NO: 20335 - protein, 413 aa, Mycoplasma gallisepticum R
MINYNKKTLKDVDLKDKTVIVRVDFNVPIKDNKVIDDTRIVQALDTIKYLIEQNCKIVLLSHLSRIKSLEDISSKKKSLRPVYENLKTKLNNVKFLEENVGYDVVEAVKQLKHQEVLLLENTRYNDVDNQGEVVKKESKNSPELGRFWASLADVFVNDAFGTSHRAHASNVGIAANISQSCIGFLVQKELEALSKLTNNPQRPFVVILGGAKVSDKLKVIESLLKSADQILIGGGMVNTFNKAKGYHIGKSLFEPEMLETAKKILAEDKDNKIILATDQMVTKASTITDIKTAPAGKCVFAKDEAENEDFEALDIGDESIKTFKSYIAKAKSIFWNGPLGVFENPNYERGSYEIAKAISESDSYSVIGGGDSAAAANQFKLADKFSFVSTGGGASLTFMEQTVLPGIEAIQSK

SEQ ID NO: 20336 - protein, 1157 aa, Mycoplasma gallisepticum R
MIKSEDFMAEKRDYYEVLQIDRDAEEQEIKRAFRKLAKKYHPDTNKDDANAESIFREINEAYEVLSNPEKKERYDKYGHDGLDREDDLDFDPNIFNSFFETINAADEFDDITFDGDWLDDDKPSKKKKKKTKKGGFWAKSKEASKTIETEPEIIDVGASVNQANETRLFDDTLDDQLEESVSTQSTDDGERLFDDNKEPSFTAGLDEEVQSEPQPEEDLSWTRFIGNPDYGHYDENNEWIWEGYFDDDDNFISTRELEQKVEPEQAQPQDDRSEQEEEEEALDSKPQDDSEDDYVIPDAEIISSPTLEVTAPKEVEQPLQPEQVAHVEQKEAEEESVAQTKAEEVSQPTQTVETKPTSAVESTSTFDLKQLLKVMQEQPTEEALTTTELTNETTSPTTEVSELEQTQDKSEDQQEEKAEKIDDAFVESNLPEIVDFSTKSSASLGTANLYDLSFLIKNQPTQAVQPTSETISTTPVEPTDQLKPKEVDQIQEELKRAAEELVEDNLIDDSSMITPPSVIKTKEIEVEELPTKKNDLVEINFDDLEELKFELVQTNQEKLPEKAVENWAQDYQLDEPTQSNIDWYKQEDPKDLEQLVQDQATLEITEENQISERKVEEQPSVESTKVEDQVVQAIKEEEELLEQKKAAEFAELFGEQTPTTKEDDDYLSIEELLNNEQTQPTEFNEIIIENNLDNVSVADDQNYQLKDDNKKFINISEPTIVSSNLSFDQQLVNEIESDDLIKHQEENQEEYQTVDYDPLQQPVRPMHTSDSEMYDFSIKLLRKQVGAKMEGNDSSNKNLANKINDLSDFKSRLLKRLSETNPSSQPPASKYQEPNLIQIERLTEINVVKEVEVHQVLLFNNAIKRIKYTRHTPCNNCSATGIDLTSSQPYKLCPACRNVEGNVESCMVCNQYGKLIRIPCKNCLGKSYTNEAITLDIKLPITSQLNISVNYPGFGHIFPNNLKGDLTVVFKVIPSNFFVIKNNDIHVKALVDPILASIGGIIKVPTINKLINVRIPPGTKVGDQVIIKDMGLDARYDLETKTYYDKGSLIIQVVYADIMKSNDRSLGLEEAAKLPNVQVEHFNKLALREIKELKYNQQELQQEQQNWNFQSNDSNGFDSLNDQKAHQNLAFNRVLNTIKDIRTLDDIKKIREKANKK

SEQ ID NO: 20337 - protein, 508 aa, Mycoplasma gallisepticum R
MNKKHKDFDLNFLKKTKIVATCGPSITYKLFSLADLEDPSKQEIVQKAKENLRQLFLNGVSTVRLNFSHGNQEEQAVRMILARSVANELNLPISIMLDTNGPEIRLNQISETDNTVKKDQIVKIYTNREIVGNATEFSVSDSSKKYNMAKDVSLGSIVLVDDGKLTLQVIEVAEDFSYIRAIAKNEHKIITKKRINLPNAKYSIPFLSQKDYNDITFGLKNKVDYIAASFVNSADDIYEIKAILKQYGMEHVQVIAKVETRHAIKNLDEIIDVSDGVMVARGDLGLEIPYYEVPYWEKYIIKACRFKNKRVIVATQMLDSLEKNVQPTRAEVTDVFFAVERGCDATMLSGETANGMYPIIAVETMKKINKQSELLFDYKRAITHYFPMTDVCKTAFGERVLDIAKKICPNREIENEDFSTHFLVHFTNNREEIFALSNAKLAASVIIVTDDQNVYTGHGVDYGVFTYKVDDLTKALSNYQLVAKKAILHYSELFEIKPDNKTNFVLLK

SEQ ID NO: 20338 - protein, 467 aa, Mycoplasma gallisepticum R
MVLNMYNYDLIVIGAGPGGYVAGEHAAKNGLKTLVIERGTYGGVCLNVGCIPTKTLLQSSKVKHYIEKAAEYGLDLVNNQLSVNWANILKRKEAVVNKLVNGVKTILKVAKADTIVGEARIVDGHTVTVNNQTFYITTKDIIVATGSSPRKLPLPGFDQGRAEGVIIESTKALELPQIPQSLVVIGGGVIGIEFAMLYASLGTKVTILQAVDRLCELLDQDASDFIAKRMKSLGVNVVYNAKILGYQNNAIIYEDNGTAYQLPSQYILESVGRVVNDQVFGSFNVARDDRNRIKLNDKLQTSTDSIYVIGDAAGQIMLAHYAYHQALYAVDTILNRKTKKLSSLTTPGCIYTYPEIATIGYTEQQLKEKNIEYVVSKMPMAVNGKAIADGSTEGFIKFMFGKKYGEILGCVLIASTASDMISEIALAMENELTVFELEQAIHPHPTIAEIISECAKQAIYNHFNKKH

SEQ ID NO: 20339 - protein, 472 aa, Mycoplasma gallisepticum R
MKVIVVGINHAGTSAIRTMLAENPKLDVVAFDRNDNISFLGCGIALAVSGVVKDTTDLFYSNPEQLRSMGAKVHMKHEVLSVDHNRKVVVVCNLEKNSTFEESYDKLILATGAWPITTADASLPFTEKYCGGIEGLVACKTYQHALEIIDQFKKPDVNNIVVIGAGYIGVELVEAAHQKGKKTLLVDMLPRPAANYFDKEFGTDLMTTMKKEGVDVRCGTKVMGYLVDTEGGKKVIRGITLEKDGVQTKVEADLVIQCIGFLPNTSLLADAHKVKNGALIIDQYCQTSVKDVYAIGGAAAIMNAATGEYQNIDLATNAVKTGVVAASHINGMTNIKLENVVGTNAIHVFGHHLASTGISEEVAKIRGIQAVASYFEDADRPEWMNTYDRVKIKLVYDPKTLRLLGAQVGSTKNNHSEVIYLLALAIQRKLTLVDVAFADVFFLPHYNKPFNFIISAILQALGLNYFKESIKK

SEQ ID NO: 20340 - protein, 475 aa, Mycoplasma gallisepticum R
MAKTNSTSKNNKLEIKSVFAYQAFDSRGFPTVACEVVLNDGSKGLSMVSSGASTGEKEALELRDGGTKYHGKGVTKAVNNINKKIGPKILGVDATLQTQIDEFMIELDGTKTKAKLGANAILAVSMAVCRAAAKSLNLPLYQYIAKKVAKVKGADFILPVPMLNVINGGAHADNTIDFQEFMIMPVGAKTMAKALQMASEVFHSLQKLLKAKKFNTNKGDEGGFAPNLKSAEEALDLMSQAVVDAGYALGKDVAFALDCAASEFYSKEKQAYVFKKAVKAGILSEEKGTKTTEQLISYLEDLTKKYPIVSIEDGLDENDWKGMESLTKKIGKKVQIVGDDTYCTNPELTSKGVSLSATNSVLIKLNQIGTLTETIQTINIAKKANWTAVVSHRSGETEDAFIADLAVALSTGQIKTGSMSRSERIAKYNRLLAIEMQLGNKAKYLGSKTFYNLSTPAATPKKSPAKKTTKAKSKK

SEQ ID NO: 20341 - protein, 503 aa, Mycoplasma gallisepticum R
MKKALLMILDGYGISSTTHGNAVKNAKTPHLDNLMNNNPTIMLQASGEAVGLPKNQIGNSEVGHLNIGAGRIIYTGLSLINKEIENKKFFTNQALLNAIDHAKKNNSKLHILGLVSNGGVHSHINHIYAIMELANQHNVPAILHIFGDGRDVPPTQLLADLDQLIKKAETTKTKIGTISGRFYAMDRDQRWDRIDLAYNNLLSNTGKSFADLKTYVKDSYQQNITDEFIVPAYNNNYKSDEITIQDNDSVVFANFRPDRARQLSHYVFGSNYYDHHPQLRRKNLYFVIMMQYEGINPSAICYPPKIEKNTLGEVLKNANKKQLRIAETEKYAHVTFFFDGGVEVEYQNEDKVLVPSRKDVKTYDLAPEMSAAAIVDQLLKVYTKYDLTVLNFANPDMVGHTGNYEATLKGLEALDHEIGRLLADAKKNNITVFFTADHGNAEEMIDENNQKVTKHTTNVVPFSITDPNVKFTKKEGILANVAPTILKYLEIQIPEEMDQEPLI

SEQ ID NO: 20342 - protein, 252 aa, Mycoplasma gallisepticum R
MNSMKRYIFGNWKTYKTTQEVKEFFSVLNQTKLTKNPDVVFGVAPVFVHLGLANQLERNECLVLAQDANYVMNKANTGTVSYEQLKDIGVNYVIIGHSERRKLFHESDELINQKVKTLLENKMRPILCIGETLEEYEANKTKAVLKDQLEKDLKGIDSSLLKDLIIAYEPVWAIGTGKTASSQTAQDAIAYIRTVLGLLSSKTIANELPILYGGSVTPDNVSELLAQKDINGALVGGASLDPHKFIQLIEAK

SEQ ID NO: 20343 - protein, 216 aa, Mycoplasma gallisepticum R
MMSDLLFSILPMLNDYDQNKLASYKQLGLNKIHYDVMDEFVNNKAFDERYVDNLKNLGYQINVHLMVNKVANHILVYAKTRCDQISFHVEPLANNKQLINKYLAYIKTNNKKAGLAFKFNTDVNDYLDQIKLVDYVTLMSVEPGAGGQAFNPLVYRNIAKLIKFNPKLEIEIDGGINLEKAIELKGLVSGFVSGSYFYQLSDQSKLEMLEKIRAFS

SEQ ID NO: 20344 - protein, 427 aa, Mycoplasma gallisepticum R
MMIKLTFNLIKGLDYKKLDKNYQAKLDEIFSQLKNKKTPSANMLGWIDYVDQDHTKIYKSIDNKITEWDKLKVTDVVVIGIGGSFTGIKAILDVVAYLPSEQKRQIHFIRSLSENSFLKILEEVKDKNWGIVVISKSGTTLEPSVGFKLFREALYKQYGEQAQKRIVAITDPKKGVLHDIAVKNKYEMLPIYSDIGGRFSTITPSGLLVAGLVGADYKQLIEGAKKAKADLFASSELKKNSAYTYAALRHYLYTEMKKDVEIAITYEEQHEYLMLQHRQLFGESEGKSLNSLFPTYSVFTTDLHSMGQLYQDGKKIFFETVFSFEKANKNKLKLKNSEFNNDDQLDYLTKKSVNQLNYVACEATKQAHASAGVPIIEIDVKENSAYGFGYLYFWLCVATSVSALLLGHDPYNQPGVENYKQRMFKLL

SEQ ID NO: 20345 - protein, 476 aa, Mycoplasma gallisepticum R
MKVSVTTNKQGLFVYNKSNQHEIMKTLKEILQSQKAFFDSNVTKDYQFRLENLKKLREIIDIYENDFYEALKKDFNKSAYETYISEFVLIKKELNYAIRHLKKWMKPIKAPRNTFQFFAKVSYRYQPYGNTLIVAPWNYPLLLVFNPLVAAIAAGNTAIIKLSEFVPHTSKLMLEIFNKYFDEKYIYFIDNNKHSIEEMMSLKYDHIFFTGSSNVGKKVMQQAATHLTPVTLELGGKSPCIVDTNTDLEKAVKSFLFGKILNAGQTCIAPDYLIVHSYLYDAFIKELIKQIDDLNLNKSNMTHIINDQHFRRLEALLAKTPKEKIVYQKNNQGNYFHPVIIGDVAFNDEIMQEEIFGPVIPVMKYENLEHLLKELKNKERPLALYMFSNDRVITDKVFSTLEFGGGAINDTIIHIANSHTPFGGVGNSGMGNYHGYFGFKTFSYAKTILTKAGFDNNLRYRPYTEDKFRAIKKIFK

SEQ ID NO: 20346 - protein, 481 aa, Clavibacter michiganensis subsp. michiganensis
MSHPAFASSDLSIPEEFTLGAATAAYQIEGAASKDGRGPSIWDTFSHTPGATAEGATGDTAAGHYDNVTTDLDLMASLHLDAYRFSISWSRVMPEGEGAVNGAGLAFYSTLVDGLLARGIRPVVTLNHWDLPQMLEDKYGGWRGRETAYAFERYAEIVGAALGDRVAIWSTHNEPWNNSFAGYGHGVFAPGVKSHEAALKAAHHLNLAHGLAVRALRRTITKDDAKVSIVLNIFRVEPESPADAEAARLFDAIANRVFTGPVLDGAYPADLLEDTKAFTDWHFLQPGDEQICNQPIDLLGVNYYEIMHIRRRPDYDPTTELMGGTEFPGSERVELFRPEGFDSTAMGWTVEPWGLEDHLVALSARWPSLPIMVMENGAAFDDVLTEVDGQPAVLDRHRTQYLIDHLTATLRARDRGANVDGYLVWSLLDNFEWAAGYGPRFGIIRVDYESFHRTPKLSAHWFAEACSTRTVPALATVDLSA

SEQ ID NO: 20347 - protein, 178 aa, Brucella melitensis biovar Suis
MSKHKGPTGAMVDPESLPYRPCVGLMVLNKAGLVWAGRRIVIPGDEMDGATQLWQMPQGGIDKGEDPAQAALRELYEETGMTSVSLLEEASDWINYDLPPHLVGLALKGKYRGQTQKWFAYRFEGDESEIAINPPPGGHTAEFDCWEWKPMADLPNLIVPFKRKVYEQVVATFRHLAA

SEQ ID NO: 20348 - protein, 503 aa, Erwinia sp. Ejp 556
MLIFFIIHFKRITRKAMIGAMLSHGATDAGFPLILVFDKAVMMKNVSSAVAVSRNPATGEVFARYPFATIAEVDSALALTNGAFQYWRHSAMSDRVQLLRNVAGALRQQARELAEMMTSEMGKPVDQGLAEVEKSARLCEWYAEQGPAFLQREPTLVEGNKAFVDYLPLGPVLSVMPWNFPVWQVLRGAVPILLAGNSYLLKPAPNVMGCALLLQQILSRVGVPEGLFAVVNADNDGVAQAINDRRIAAVTVTGSVRAGAAIAALSGAAIKKCVLELGGSDAFIVLADADIDAAVKGAIAGRFMNNGQLCISAKRIIVEAPVFDAFRDKFVSAVKEMKIGDPRESGTWIGPMARYDLRDELDSQVQATLKEGATLLLGGHVLPGEGNYYAPTVLSDVKPGMTSFAQELFGPVASLIQADNAEHAVVMANDSEFGLGGSLWSRDLAVAQKLASRIETGGVFINSPSFSDPRVPIGGVKKSGFGRELSHFGLREFTNTQTVWMEE

SEQ ID NO: 20349 - protein, 287 aa, Samanea saman
MAKDVEVAERGSYSAKDYHDPPPAPLIDAEELGKWSFYRALIAEFIATLLFLYITVLTVIGYKSQSDTKAGGDVCGGVGILGIAWAFGGMIFILVYCTAGISGGHINPAVTFGLFLARKVSLIRAILYMVAQCLGAICGVGLVKAFQKAYYSRYGGGANTLSDGYSTGTGLGAEIIGTFVLVYTVFSATDPKRSARDSHVPVLAPLPIGFAVFMVHLATIPVTGTGINPARSLGAAVIFNQQKAWDDHWIFWVGPFIGAAIAAFYHQFILRAGAAKALGSFRSNPSV

SEQ ID NO: 20350 - protein, 341 aa, Williopsis saturnus
AGVAKFAKYPLTFGPSPISNLNRLSQHLGSKVNVYAKREDCNSGLAFGGNTLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVYEGKSMQGLIALIKEDYFKPGANVLYVHLGGAPALSAYSSFFPTKTA

SEQ ID NO: 20351 - protein, 341 aa, Williopsis saturnus
AGVAKFAKYPLTFGPSPISNLNRLSQHLGSKVNVYAKREDCNSGLAFGGNKLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVFEGKSMQGLIALIKEDYFKPGANVLYVHLGGAPALSAYSSFFPTKTA

SEQ ID NO: 20352 - protein, 330 aa, Bacillus subtilis
  misc_feature (4)..(4): Xaa can be any naturally occurring amino acid
  misc_feature (63)..(63): Xaa can be any naturally occurring amino acid
  misc_feature (75)..(75): Xaa can be any naturally occurring amino acid
  misc_feature (77)..(77): Xaa can be any naturally occurring amino acid
  misc_feature (89)..(89): Xaa can be any naturally occurring amino acid
  misc_feature (127)..(127): Xaa can be any naturally occurring amino acid
  misc_feature (155)..(155): Xaa can be any naturally occurring amino acid
  misc_feature (210)..(210): Xaa can be any naturally occurring amino acid
  misc_feature (250)..(250): Xaa can be any naturally occurring amino acid
  misc_feature (255)..(255): Xaa can be any naturally occurring amino acid
  misc_feature (279)..(279): Xaa can be any naturally occurring amino acid
  misc_feature (316)..(316): Xaa can be any naturally occurring amino acid
  misc_feature (321)..(321): Xaa can be any naturally occurring amino acid
SNAXKELIKEHQKDINPALQLHDWVEYYRPFAANGQSANYIPALGKVNDSQLGICVLEPDGTXIHAGDWNVSFTXQXISKVISFIAACXSRGIPYVLDRVDVEPTGDAFNSIIRLEINKPGKPFNPXINAGALTIASILPGESAYEKLEFLYSVXETLIGKRPRIHEEVFRSEWETAHRNRALAYYLKETNFLEAEVEETLEVYLKQCAXESTTEDIALIGLILAHDGYHPIRHEQVIPKDVAKLAKALXLTCGXYNASGKYAAFVGVPAKSGVSGGIXALVPPSARREQPFQSGCGIGIYGPAIDEYGNSLTGGXLLKHXAQEWELSIF

SEQ ID NO: 20353 - protein, 318 aa, Proteus mirabilis
MLLVKISNRGNGMKNCTLGNETDNSLISNAFGFLRFPLNFQPYSSDADWVITGVPFDMATSGRAGTRHGPGAIRQISTNLAWEGHRWPWHFDMRERLKVVDCGDLVFNFGDAQDMSDKLQAHTEKLLAAGKRCLTFGGDHFVTLPLLRAHAKHFGKMALVHFDAHTDTYANGSKFDHGTMFYHAPNEGLIDPQHSVQIGIRTEHDTNNGFTVLDAAQVNDRGVDDLVAQIKEIVGSLPVYLTFDIDCLDPAFAPGTGTPVVGGLTTDKALKMLRALQPLNIVGMDLVEVSPAYDQSDITALAGATIALDMLYLQAAKK

SEQ ID NO: 20354 - protein, 337 aa, Anabaena sp. 90
MTIIYPPKNFPSKTKNHKVLLIGKMYDEIGEKLLAEYTNVEIIKEPKQHQIHEAIQDVSGVFVRYPTKLDAQAIGLAKNLKVISTSGFGTDAIDIAAATKRGIVVVNNPGLSTTAVTEHTLSMILALAKKLTFLNQCVKAGNYLIRNQVQPIQLEGKTLGIVGLGRIGSAVAKICSTALQMRVLAYDPYVPSGKADTVRATLVQDLDYLLTESDFVSLHPELTDETCEMFDLEAFKKMKPSAFLINTSRGKVVRQPDLVTAIREKLIAGAAIDVFEPEPPAINNPLYEFDNVIFSPHLAGVTPEAGMAAALSAANQILQVLQGEKPPYIINPKVWNS

SEQ ID NO: 20355 - protein, 3482 aa, Anabaena sp. 90
MAQNTDYKKLIATTLTKMEAMQARITELETRQSEPIAVVGMGCRFPGGISSPEAYWNFCQAGLDAIVEVPQSRWDISKFYAPEPTPGKMNTRYGGFLQQDITEFDARFFSISSREATSMDPQHRLLLEVAWEALENANLPPTNLAGDRVGVFVGITSVDHAMTVYKSKYDEIDSFFGTGNSLSAAAGRLSYFLNLRGPCMSIDAACASSLVALHQAIRSLRNHECKIALVGGVNLILDPAITINLCQSGMMSPDGRCKTFDAAANGYVRGEGCGVLVLKRLSVAEKNGNRILALLRGSAVNHNGAAAGLTVPSGPAQQDLLRQALADARVKPQEVGYIEAHGTGTSLGDPIEMNAIAAVYGERSQPLYVGSVKTNIGHLEAAAGIAGTIKTILALQHGEIPSHLHFQEPNPLINWQGYPIKIPSQAIPWSNNGQVRIAGVSSFGFSGTNAHIIIEQAPAANIPEIKLQRPSHLLTISAHSETGLKELALRFHTRLESHPEMGDICHSAAIGRSSLPERLAIVADTLTELQQRLAAFAEEKNIDHGIFYRRFTGEKYPKIVFLFTGQGACYAGMGNQLYQTQPTFRQYIDQCADILGNYLEFPLQQILFGDRTDLLNQTAYAQPAIFALEYSLAMLWQSWGIKPSLLIGHSVGEYVAACIAGVFSLEAGLALIVKRGQLMQTAPLGKMASVFADEATVSALIQNYGNTVSIAAINHPQQIVISGESNSIDEIVANCKSQKIAVQLLSVNGAFHSPLMESILDDFEIAAREVSYHPPQILLVSGIDGQPLTTAPDASYWRQQSRQAVQYFQSLITALNKGYNLFLEVGPRPILAEQGRRYNDDAIWLSSLNRGLDNWQTMLSALAQLYINGVNFNAEKFNKDYGYRNIQLPNYPFQRKRFQFKSTVLSQSSLTKEVPLERELMETNMNLAKVANIKKNQQEIGNKLKSILALLLKEDENDIRDDETLLNLGADSIILTDFVRKIEEKFGVKVKIDQLFTDLQTIDEISIYLSDYIKQKPSNTSDETAINDILTKTSVQVSNSESELNNYLWVISQLQPIAVAYILKALEVLGKRLSIADTWTTEDLLQTLPIASKYHILVNRYLKTLEQTGIIQNQGNVWIVKSLPTPFSLPEAIENLQTICPAAKPELDMLQRCGENLAEVLKGNIDPLELIFPAGSVVHAESIYGNSPVSRLMNQRVSQAINSILNNFSSSDRPYQIIEVGGGTGATSEAIVNNLNLNHTTYFFTELSPVLLNKARQKFKNRHKFNFNQLDIEKSPVSQGLTAHSYHIVVAANVLHSTRNITETLNNIRELLIPGGYLVLLETVENNSWLDLTFGLTPGWWRFQDKELRLDTPLLSGESWCAALKRCGFVNADIYSQQNNISIYNGQELIIASTSPESAIDHQSKTVAVSIPTSGKEALMMAQLQSLKELKDIHEKTIIKQLEILQSAPVAPSNTPEVLLIQTETAPTPKISKTETTPPTQKISSPNLNPLALKLTESKSLTEQQQAFIQKLEIVYNQRTAKSKAYSQNSRKTMVDVKPTIDFRMALKEFQYPIVSESAQGAYFRDIDGNDYIDLAMGFGVNFFGHSPDFVLTEIQQQMQHGIGLGMQSNIAAETAALICEITGVERVAFSNTGTEAIMAAVRIARSRTKRQKIVIFAGSYHGTFDGILARAGEEAGTAEPLSLGTPSGMVEDVIVLTYGAEESLEIIAEQADNLAAVLVEPVQSRKPDLQPKEFIQKLRKLTQQKEIALIFDEIITGFRITPGGAQEWFEIEADIVVYGKAIGGGLPISMICGKADFLDTVDGGFWSYGDDSHPQTELTAYGGTFCRHPLALAACRAVLLHLREQGATLQETVNQLTNRLAIEVNQFFQETGIPIRIVHFGSLFRFESSGAYSIFLKPIELPLFYYLLNLKGVYTWEKRVCFLSTRHTNEDINKVVAAVKEAIIELRQAGFFANAKPPQTKKREASDRTEDEDARNNLNQQFPTSEAQRQLWLLAELDTTASASYNVTTSLELRGALDISSLQQAINEVVNRHEALRTKILEQGELQEVISSVTIDLPLINLMDEDNPEATALVLRTELSQKPFDLGVAPLFAAVLMRLAPEHYLLTLKTHHIVADGWSLGLILNELGKLYSAKIGVATESLSPPMQFRKYLALRQQEAQSPQMQAHRDFWLKTYEGEIPIFELPTDFPRPAVKTYTGGRESKIIAPQLWQNLQTVGRKNQATLFMTMFAAYTAFLRRISGHDDLVIGIPISGRQVEGSEKLVGFCSQFLPIRIQTDVTASFVTHLRHTKETLIAAFKHQTHALEELLAALQLQRDFSRSPLISVSFNLDPKLTLPEFEGLNVSLPPEPIGYTPFDLGFNFIEVNDALIIYCNYNTELFKPETIKQFLESFEILMQGVIKDANILLSELHLLTQVQQEELLAKLTGSTIELPQNSTIIDDFIAQVKSTPDAPALIVEEKTLTYRELNEKVNRLTNYLREKYNLGAGKAIALAIGRNQNLIIAILATFKTGAIYVPIDPQYPSSRIDFILKDSGCHLCLTESNFISQLPQEIEAICLDKIDNILTDFDINEPNFQPDTNQIAYILYTSGSTGNPKGVMGRHISILNVIRSLRLTFNLNKHPEWRYIFTAPVTHDPSFRNIFLPLTIGAALYMYEVQHIGHLVSFLQENKINVLHTTPSIYREILAVLAPEETIPTLKYISCGGEKLDRETAIALRKRFPAEIVSNVYGSTETCVGVSQYTIDDNLNTDVPLGQVFHNNRLFVLDEFNHPVPLHVIGEICVEGAALAVGYRNLPEITREKFQPNFLNSEKILFRTGDLGKQIAPGVIEFIGRKDNQVKVNGYRVDPGEIEYQISRYAEIEKAIVLPIEVNNQIQLSAYCQTDKDIKFSEIREFLAKYLPVYMIPSSFIFLKQFPLTKHGKFDLRSLIALKPTDQLTQVSYTAPRNTLESKLVHIWEKILTKHPIGIFDNFFEIGGHSLLLSRVVTHVHKELNVLVKLADFFKVPTILGLAALISKAQSNYQEPIPAITQQESYPMSHGQRRLWALEFLDHNHYAYGMPSAYQFNGDLNIAAFENAFKKLIERHEILRTTFTLINNEPRQIVNEQVDFAVNQIDLVDDENQAAKIAEAIRNNAKTTFDLESGLLLKINVLKLSQQSNIVLFNMHHIISDGWSAGVLIKDFLAHYHAYGKENVELPPPLRIHYKDYTSWQNQQLQTPKLQAQRDYWLPKLIPAPAPLDLPLDYTRPAVQSFSGSVVIWKPNQEFIKDFELLTKTQEASLFMGLLTLVKGFLFRYTEQNEITVGSPIAGRNHPDLEEQIGFYVNTLVLRDQITVDDSFATLLAKVKTTTIEAYDNQEYPFDKLVSDLNFKRDPSRNPLFDVVVVLQNNQNVDLAIDGIAVNTLEQELVTAKFDLEFIFVDEAELYLKLIYNTDIFANERISLMIKLLETLLEEVVKSPDTPLLHLCDHTDKACQEDNSLFATNFNF

SEQ ID NO: 20356 - protein, 335 aa, Rubus idaeus
TRAHVLLVPKKNYLVKPITFSGPCKSKLTMQIYGSIEASDDRSVYSKDLYHWIIFDNVRNLLVQGPGTINGNGQIWWQNSCKNKHTKPCGTLAPTAVTFYQCNNLVVKNLKFKDSQQMHVSFEDCTNVQASYLTVTAPETSPNTDGIHVANTQNITISNSIIGTGDDCISIVSGSQNVQASSITCGPGHGISIGSLGEGGSEDRVSKVTVNGAKISGTMNGVRIKTWQGGSGMASNIVFQNIEMNDVTNPIIIDQNYCDTSDKRKCKQQSKAVKVQNVLYKNIRGTSASKYAIAFDCSKSIPCQGIVLQNVQLHKRAKCSNVNLAYKENVSPRCA

SEQ ID NO: 20357 - protein, 1749 aa, Pseudoalteromonas haloplanktis
MLICDSNDDAKNNILVFSEQQAQEELVKLNDLAQQAGLVLIEEFDTDTETFFSSSYKSLSDEQGSGPLYFKSGGSAKIDDVAGQLILEGGRITIGNTLPGKESTATDSSGVGIYNLSEGFTISFDIISHNSAGGLSLYVDNNTASQSNSVHGGASKFYGKDINESNTPAGQRFSYTYIPGEDVNTGPDLTNIDARGILNPEIKNSYFQIRTDSAAMIVIDNLTIKTVATDVPDVEPPVEPPVQGEIPTVELPITTDFTALTADIFSVEHQKIIDTNGDEIPMFSKTGGSVTVIDTGLELNGGRFTLGNTTPGIETAATDTTTSGALDLSRPYQVVMDIVSISDPEGDNKFQIYVDNNSSSSSKSIHGNDSRFYNELINSLTAGQTLTVPGKLATKNSFLQLRTETGGTVVINNLRVEYVKDPSVFSCTDAPELYFCDDFANGDLNNWQVLAKPDNTEAPMGEFDVLDIMGNNMMRYTAGGAGGELILATEEAMANVPVTGNYFVEAKIRPRQNSTTANKHIFLMARYLNAGNWYAGGLNVQNSSSSTQVEVAVSSEGSIARPVQTKSPILLGEKGAIEDGVWYTTRFEMIDDQLTVYLDGEKMGSATDTSYTARGLIGVFTNNRSFEIDDVKVGDPSIKPIQLTLDYKEPNWDTSTSMDPLLINVTAIKNDGITAGTYTVTSSNEAVVSVAINGNAITLTPITVGDAMVTFVSDSDPSITRTIKVSVAEGFVMPTADYGDLTDKVMPAIASDSQFVDTQLSITFDNAPTFGSLGEIRIYKQNDNTLVDTLKVGKNVDVIGYTGQDRLRSVYYYPLTIEGNTLTIKPHNNVLEYGHTYRVVIGDDVVLGAQLNGTDFIGLGDNSQWTFTTKVTMPASNQLLVDDDGVADFRTVQGALNFAMASLAKDEQTTISVKDGVYNELLFLRNKDNVTIQGQSQDNTTIQYENYETLNGGSGGSAPIGSGTPGGGRGVFLVEGADMLVINNLTLKNTHLRNNVDSNQAETIYFNSNGRLVANNASFISEQDTLLLKGYTWFYNSLVAGNVDFIWGYPVTALFEDSEIRTIGDSKDGDPTKDSSGGYVLQARVPVQTDPGFIFLNNRFTHGPGPIGNNVLDNSTYIARSGGSDTYFDNVTLINNKFDTHIATSGWAVQGVNSQPAPNPEIATATSGWREYGSMDLAGNTLDLSARVGGYIMQDSDVVNLLERNAIFASFNDGQGWTPEPLAIPILPDEPIAITPVNNSLGFAGYNFSLTGGEGGTVVTVDNGTALKSALAQAKSLGVPETIYVDGVITDANSGGDNSSIEIKDMDNISIIGVADRGELSGIGIAIRRANNIIIQNLKIHEVLTGGKDGISIEGDENKPTANIWIDHNELYSSLNVDQDYYDGLIDSKSGAENITISYNYIHDSWKTSLHGHSDDDSSSNKNRHITFHHNRFENIISRVPLFRFGQGHIFNNYYNNITSSAINSRMGAELHIENNYFEHTKNPVVSFYSKVIGYWNTSGNYLGEGVTWGDVADGDVAAEVTATGMTPTSSYQAPYEYKLTPVMDVKAHVIAHAGIGKTDQSDLDIPDIAPPSEPPVQEPLGLPFTENFAAANTDEFFSNSYRDLSGLAGSGTPLFHRVTGAIDVSAGQLTMTGARISIANTTPAVSTTSADASTTGLLDLSNSYQVSFKVVTVAGNTAKASKIYVDNNTSGSANSIHGGSSKFYSVQLQDLVPGQTDTVDGLVATATSFITLRTESEATITLDEITIQ

SEQ ID NO: 20358 - protein, 465 aa, Streptomyces coelicolor A3(2)
MNMSAGDGKSERLVVIGGDAAGMSAASQARRLKGPDELEIVAFERGHFSSFSACGIPYWVGGDVTGRDALIARTPEEHRARDIDLRMRTEVTEIDVAGGRVRARDVDSGARSWMSYDKLVIGTGARPVRPELPGIDAPGVHGMQTLDDGQALLDTLTRTRGRRAVVVGAGYIGVEMAEALINRGYEVTVVNRGREPMSTLDPDMGRMVHGAMEGLGITMVNDAEVTGVLTGDDGRVRAVATEDAEFPADVVVLGIGVRPETGLAAAAGLPLGAHGGLLTDLAMRVRGHENIWAGGDCVEVLDLVSGQERHIPLGTHANKHGQVVGTNVGGGYATFPGVVGTAVSKVCDLEIARTGLREKDALRAGLRFVTATVESTSRAGYYPNASPMTVKMLAERRTGRLLGVQIVGREGAGKRVDIAAVALTAGMTVEQMTALDLGYAPPFSPVWDPVLVAARKAAREVERQR

SEQ ID NO: 20359 - protein, 339 aa, Schizosaccharomyces pombe
MSYSFQGLLNRVNESAIVNTLKEYTGLNTPKWTFNDIPDLTGKVALVTGSSGGIGYVTALELARKGAKVYLAGRNEEKYQKVMKQIHDEVRHSKIRFLRLDLLDFESVYQAAESFIAKEEKLHILVNNAGIMNPPFELTKDGYELQIQTNYLSHYLFTELLLPTLRRTAEECRPGDVRIVHVASIAYLQAPYSGIYFPDLNLPHVLLGTFARYGQSKYAQILYSIALAKRLEKYGIYSVSLHPGVIRTELTRYSPTFALKLLEKSVFQYLLLDPIRGAMTSLYAATSPEISKEHLNGAYFTAIAQRGILHRAHDDAFVEELYRYTHKIFEDLKYLAPSP

SEQ ID NO: 20360 - protein, 413 aa, Arabidopsis thaliana
MTVLVEVREYDPSKDLATVEDVERRCEVGPAGKLSLFTDLLGDPICRVRHSPSYLMLVAEIGPKEKKELVGMIRGCIKTVTCGITTKRLDLTHNKSQNDVVITKPLYTKLAYILGLRVSPTHRRQGIGFKLVKAMEDWFSQNGAEYSYFATENDNHASVNLFTGKCGYAEFRTPSILVNPVYAHRVNISRRVTVIKLEPSDAELLYRLRFSTTEFFPRDIDSVLNNKLSLGTFVAVPRGSCYGSGSRSWPGSAKFLEYPPDSWAVLSVWNCKDSFRLEVRGASRLRRVVSKATRMVDKTLPFLKIPSIPAVFRPFGLHFMYGIGGEGPRAEKMVKALCDHAHNLAKEGGCGVVAAEVAGEEPLRRGIPHWKVLSCAEDLWCIKRLGEDYSDGSVGDWTKSPPGDSIFVDPREF

SEQ ID NO: 20361 - protein, 353 aa, Cymbidium hybrid
METERKGPVVVTGASGYVGSWLVMKLLQKGYEVRAAVRDSTNFEKVKPLLDLPGSNELLSIWKADLNDIDETFDEVTRGSVGLFHVATPMNFQSEDPENEVIKPTISGLLGILRSCKRVGTVKRVIFTSSAGTVNVEEHQATVYDESSWSDLDFVTRVKMTGWMYFVSKTLAEKAAWEFVSDNDIHFITIIPTLVVGSFLISRMPPSLITALSLITGNEAHYSILRQAQFVHLDDLCDAHIFLFEHHKANGRYICSSHDSTIYSLAKMLKNRYATYDIPLKFKEIDPNIESVSFSSKKLLDLGFKYKYKYTMEEMFDDAIKTCRDKNLIPLHTEEMVSANEKFDEVKEQIAVK

SEQ ID NO: 20362 - protein, 443 aa, Rhodobacter capsulatus
MTTSQFRPGVHPGRLPPEGYCTAFADVAPPLTAHQAQVAAARCYFCAEAPCTTACPSDIDVPLFIRQILTGTPEAAARTILSQNIMGGMCARVCPTETLCEGACVREAAEGMPVEIGALQRFATDRLQAAGVHPFTRAPRTEKSVAVVGAGPAGLACAHRLAMLGHEVTVYDARLKPGGLNEYGIAAYKAPGGFAAREVAWLLQIGGIAVLENWKLGRNGSVADLLAEHDAVFLGMGLAGVNALTIPGAEHATPATEFIAHLRQAGDLATVPVGRRVVVIGGGMTAVDAAVQAKLLGAETASIVYRRSQAEMPASAHEQEHAQKNGVRIVPNAAPVAIRKDDQGYEVEFARTETQGGKLVQLDDTLRIKADQIFTAIGQTLGPVPEGLTITGGKIEIDAQGRTGMAHVWAGGDCATGGEDLTVTAVAQGRDAAEDIHAFLMGA

SEQ ID NO: 20363 - protein, 270 aa, Buchnera aphidicola
MNRYENIFDRLSQRKEGCFVPFVVLGDPSLDTSLKIINILIQNGADALELGIPFSDPLADGKTIQKANLRALSQKNNIFQYFKEIKNLRKKHTQIPIGLLIYANLVYNQGLDNFYLKCRKSGVDSVLIADVPIEESEIFYTTANKYKISSIFICPPNADDDLLYRISLYAKGYIYVLSRPGVTGIENQNFFVSGDFIKKIKKYNSVPLLQGFGISNSIQVKQAISSGLSGVICGSAIINIIEKYLYEEDIMMTKIQEFVKHLKKSTKLIA

SEQ ID NO: 20364 - protein, 499 aa, Arabidopsis thaliana
MARKMLVDGEIDKVAADEANATHYDFDLFVIGAGSGGVRAARFSANHGAKVGICELPFHPISSEEIGGVGGTCVIRGCVPKKILVYGATYGGELEDAKNYGWEINEKVDFTWKKLLQKKTDEILRLNNIYKRLLANAAVKLYEGEGRVVGPNEVEVRQIDGTKISYTAKHILIATGSRAQKPNIPGHELAITSDEALSLEEFPKRAIVLGGGYIAVEFASIWRGMGATVDLFFRKELPLRGFDDEMRALVARNLEGRGVNLHPQTSLTQLTKTDQGIKVISSHGEEFVADVVLFATGRSPNTKRLNLEAVGVELDQAGAVKVDEYSRTNIPSIWAVGDATNRINLTPVALMEATCFANTAFGGKPTKAEYSNVACAVFCIPPLAVVGLSEEEAVEQATGDILVFTSGFNPMKNTISGRQEKTLMKLIVDEKSDKVIGASMCGPDAAEIMQGIAIALKCGATKAQFDSTVGIHPSSAEEFVTMRSVTRRIAHKPKPKTNL

SEQ ID NO: 20365 - protein, 500 aa, Arabidopsis thaliana
MDSIWILSLLFFIIFLLLAAFKRKNHGKHRRIPSPPGFPIIGNLHQLGELQHQSLWKLSKKYGPVMLLKLGKVPTLILSSSETAKQALRDYDLHCCSRPSLAGGRELSYNNLDMSSSPYNEYWKELRKLCSQELFSANKIQSIQPIKDEEVKKVIDSIAESSSLKNPVNLSKTFLALTTSVVCKAAFGVSFEGSVLNSDRFNKLVRDTFEMLGSFSASDFIPYVGWIIDKFNGLQGWRKKSFRDLDAFYEQIFDLHKEEKEVGSEDLVDVLLRLEKEEIVVGNGKLTRNHIKAILMNILLGGIDTSAITMTWAMAELAKNPRVMKKVQAEIRNQIKNKERISFDDTDKLEYLKMVIKETWRLHPPTPLLLPRDVITEFEINGYTIPAKTRLHVNVWAIGRDPDTWKDPEMFLPERFNDSNIDAKGQNFELLSFGSGRRICPGLYMGTTMVEFGLANMLYHFDWKLPEGMVVEDIDMEEAPGLTVSKKSELVLVPVKYLDH

SEQ ID NO: 20366 - protein, 347 aa, Oryza sativa (japonica cultivar-group)
MDDNSIQQSLLADNPNVLQRKPSEGVNRFRRCRSTPSTDPLQGPPEKGSSVKAKELFKEMRPSFRLVGLLLFIYLLVGVLAFYAVMDEISGKRTNRVLDALYFCVVTMTTVGYGDLVPNNDTTKLLACAFVFMGMAVVALFVSKVADYLVEKQEVLFFKALHTNLKGGETKMLRAIETNRIKYKFYTNALLLVLSIISGTVFLWKVEKLSLVDSFYCVCATITTLGYGDKSFSSKLGRVFAVFWIITSTIIMAQFFMYLAEIYTERRQKMLANWVLTRKMTKMDLEAADLDDDRQVGAAEFVVYKLKELGKINQEEISSFLEEFEKLDVDHSGTLSPYDLTLAQSAQ

SEQ ID NO: 20367 - protein, 457 aa, Acinetobacter sp. ADP1
MPKEANMASQDYATQRSSLDAQALINDAPLSRYQWLIAIVCFLIVFVDGIDTAAMGFIAPALAQDWGVDRSQLGPVMSAALGGMIIGALVSGPTADRFGRKIVLSMSMLVFGGFTLACAYSTNLDSLVIFRFLTGIGLGAAMPNATTLFSEYCPARIRSLLVTCMFCGYNLGMAIGGFISSWLIPAFGWHSLFLLGGWAPLILMLLVIFFLPESYRFLIVKGKNTKKVRQILSRIAPQKVQGVTEFHVPEEKVEAGTKKGVFGMLFSAKYVKGTVLLWVTYFMGLVMIYLLTSWLPTLMRETGASLERAAFLGGLFQFGGVLSALFIGWAMDRFNPNRIIAGFYLAAGIFAVIVGQSLSNPTLLALFILCAGIAVNGAQSSMPVLSARFYPTQCRATGVAWMSGIGRFGAVFGAWIGAVLLGNNWSFTMILSMLIIPARAAAIAIFVKSLVAHTDAT

SEQ ID NO: 20368 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKRTFFGNFKPRTDLPNVVEMYMKKELEVEKFITHSVPFSEINKAFDLMAKG

SEQ ID NO: 20369 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKASDLMAKG

SEQ ID NO: 20370 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMEKG

SEQ ID NO: 20371 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERNLKGTFFGNFKPRTDLPNVVEMYMKKELEVEKFITHSVPFSEINKAFDLMAKG

SEQ ID NO: 20372 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFLEINKAFDLMAKG

SEQ ID NO: 20373 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPQGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKG

SEQ ID NO: 20374 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDAEFKTHPMNFLNERTLKGTFFGNFKPRTDLPNVVEMYMKKELEVEKFITHSVPFSEINKAFDLMAKG

SEQ ID NO: 20375 - protein, 262 aa, Hordeum vulgare subsp. spontaneum
SAESNMCDLLRINTDRGVMIGDGKSRFSIGGKPIYHFVGTSTFSEYTVMHVGCVAKINPEAPLDKVCVLSCGISTGLGASINVAKPPKGSTVAIFGLGAVGLAAAEGARIAGASRIIGVDLNASRFEEARKFGCTEFVNPKDHTKPVQQVLADMTNGGVDRSVECTGNVNAMIQAFECVHDGWGVAVLVGVPHKDSEFKTHPMNFLNERTLKGTFFGNFKPRTDLPNVVEMYMKKELEVEKFITHSVPFSEINKAFDLMAKG

SEQ ID NO: 20376 - protein, 506 aa, Oryza sativa (japonica cultivar-group)
MPRRLARPLLHETRRDATRARTGESVFLAAMAEKKGVGSLLPGLAVVLVGFVVGGAGSDDRFVYAGFTGAPLALDGTAAITASGLLELTNGTAQLKAHAVHPAALRFHGGGGGGGAVRSFSTSFVFGIIPPYSDLSGHGIVFFVGKNNFTAALPSQYLGLLNSTNNGNTTNHIFGVELDTIVSSEFQDPNDNHVGIDINSLKSVAVNTAGYYDDKTGAFHDLSLISGKAMQVWVDYDGATTQISVFMAPLKMSKPTRPLVSAVYNLSQVLVDPVYVGFSSATGTVRSRHYVLGWSFAMDGPAPAIDIAMLPKLPFYGTKARSKVLDIVLPIATAVFVLGVVVVVVLLVRRRLKYAELREDWEVEFGPHRFTYKDLFRATEGFKAKMLLGIGGFGRVYKGVLPKSNMEVAIKKVSHESRQGIKEFIAEVVSIGRLRHRNLVQLLGYCRRKGELILVYDYMPNGSLDKYLYDDKNKPTLDWTQRFRIIKGVASGLLYIHEDWEQVVIH

SEQ ID NO: 20377 - protein, 444 aa, Oryza sativa (japonica cultivar-group)
MDPCPFVRVLVGNLALRMPVAPPAAGAGAGVHPSTAPCYCKIRLGRMPWQVAAAPLVVADGGEQAPSGALAAAFHLSKADLEWFARKPSLLFSSSSSSRGPATLKVAVYAGRKGTTCGVSSGRLIGKATIPVDLKGAEAKAAVVHSGWICVGKKSGGKGGSAAAELSLTVRAEPDPRFVFEFDGEPECSPQVLQVRGSMKQPMFTCKFGCRSNSDLRRSVVQTERDAAAAAGKERKGWSVTVHDLSGSPVALASMVTPFVASPGTDRVSRSNPGAWLILRPAGDGSWEPWGRLECWRERGGAGASNSLGYRFDLLLPGVDHAVPLAESSIAASKGGKFAIDLTSMQPQSRGGTPGCSPRGSGDFSQWPLASYSYRGFVMSSSVQGEGRCSKPTVEVGVPHVGCAEDAAAFVALAAAVDLSMDACRLFSHKLRKELSHLRSDVLR

SEQ ID NO: 20378 - protein, 361 aa, Cucumis sativus
MDSWHSYDYLAGLNPIPAPKQDIIDPSLAKPASHGKSKNNSGVIAGVVCGAVVLALIIGFFVFAKRRRGRGKDSSTVEGPSGWLPLSLYGNSHSAGSAKTNTTGSYTSSLPSNLCRHFSFSEIKSATRDFDESLLLGVGGFGKVYNGEIDGGTTKVAIKRGNPLSEQGVHEFQTEIEMLSKLRHRHLVSLIGYCEENCEMILVYDYMAHGTLREHLYKTHKPPLSWRQRLEICIGAARGLHYLHTGAKHTIIHRDVKTTYILLDEKWVAKVSDFGLSKTGPTLDHTHVSTVVKGSFGYLDPEYFRRQQLTDKSDVYSFGVVLFEVLCARPALNPTLPKEQVSLAERAAHCYNKGILDQIIV

SEQ ID NO: 20379 - protein, 484 aa, Hypocrea jecorina
  misc_feature (171)..(171): Xaa can be any naturally occurring amino acid
MPESLALPNDFEWGFATAAYQIEGAVKEGGRGPSIWDTYCHLEPSRTNGANGDVACDHYHRYDEDFDLLTKYGAKAYRFSLSWSRIIPLGGRLDPVNEEGIEFYSKLIDALLRRGITPWVTLYHWDLPQALHDRYGGWLNVEEVQLDFERYARLCFERFGDRVQNWITINXPWIQAIYGYATGSNAPGRSSINKHSTEGNTATEPWLAGKAQIMSHARAVAVYSRDFRPSQKGQIGISLNGDYYEPWDSNEPRDKEAAERRMEFHIGWFANPIFLKKDYPESMKKQLGERLPALTPADFAILNAGETDFYGMNYYTSQFARHLDGPVPETDYLGAIHEHQENKDGSPVGEESGLAWLRSCPDMFRKHLARVYGLYGKPIYITENGCPCPGEENMTCEEAVNDPFRIRYFDSHLDSISKAITQDGVVVKGYFAWALLDNLEWSDGYGPRFGVTFTDYTTLKRTPKKSALVLKDMFAARQRVKVAA

SEQ ID NO: 20380 - protein, 272 aa, Leptospirillum ferrooxidans
GPQDRKNTPKMAKSNAHCGPKHSPLLFLGTFILWLGWFGFNPGSTLMATTPSVGYFAYIAMTTNLAAAAGALAAMFTAWKILGAPDMSMVANGAIAALVAITASCAFVDPWASVVIGAVAGVIAVVGVLAIDRIHIDDPVGAVSVHGMAGIWGTLSNGLFATPDRVKLLAVGTPGLFYGGGFHQLLVQAEGVSASLAYVFFVSLLVFYVIKVTIGLRVSEHDEVSGLDISEHKMWGYPEMFSGGFGGGTAPGELAGRSEMSMSAAKPVTQRT

SEQ ID NO: 20381 - protein, 188 aa, Leptospirillum ferrooxidans
MGEHTHRHSGDMASSLCWNCKGTLEEADLCGTCVKIQPFKEDRDYFDILGLPHRLVIDSGTLTEKFHEKSRLFHPDFHRMEASTEQEISLTNASRLNQAFKTLKDPFLRAAYYLALKKPGNPAIDPKKRLTGQDLMELMELKEELEGEVAVGHQEKAFARLLKEVRDLESSILESMKEIDFMGVWRGG

SEQ ID NO: 20382 - protein, 362 aa, Leptospirillum ferrooxidans
MSELFSPLQLASVTFPHRIFLSPMCQYQAREGYVTPWHFVHLGARAQGGASLVMMEASSVSPEGRLSHGDVGLWEDGQGKALAPLVDLVHSLGSRIGIQLAHGGRKASCHRPWEEGGRPLSESSGAWPVVGPSPMAFSEGYPIPKEMDSPEMERVAESFVRSAIRAKASGFDVLELHLAHGYLLHEFLSPLTNMRLDQWGGSIEGRMRYPLEVVRRVRQVWPQELPLFVRISATDWVPGGWSIEDSVVLARQLKLLGVDLIDVSSGGIVPHAAIPVAPLYQVALSERIRSEAKIPTGAVGLVTAPEEAESIVRSGKGDAVLIGRAMLRNPNWPLEAALKLGGFLSPPDSYLRAWPPVGCPAG

SEQ ID NO: 20383 - protein, 321 aa, Leptospirillum ferrooxidans
LEEGEKTRSFASGMGAISAILIHLAKKHPEIAFPKVLYGGTRAFIEQYLIPSGCLIHWFDPREEGWDEELSRRLSPDTGAIFAETPSNPVMTVIDLEKLSSAAKKVGAPLVVDNTFATPILQKPLVLGADIVVHSATKYLGGHGDLLGGTVTGKASLIDRLSFEEGSYLGATLSPFNAWLLLRGMKTLPLRMDAHCRGAMMVAEFLSGHPGVKSVHYPGLSKDPGHKIASSQMKGFGGMLSFSLGDDQRARRVASGLELFKIAVSLGDPESLIEHPASLSHRQMTAEERMTLGIDPGFLRVSVGLEDPEDLVMDLKRALER

SEQ ID NO: 20384 - protein, 297 aa, Leptospirillum ferrooxidans
QIQGYVQTPGIHSPEQIEGWKTVTQRVHQKGGLIYLQLWHVGRISHPDFLGGNLPVAPSAIAPRGMTTYTPTGPKEIPTPRALEISEIHQIVQQYKTAAQNARDAGFDGVEVHGANGYLLDQFLEDSTNLRNDLYGGSLENRARLLFEVMEAVGEVWGSQRVGVRLSPGGTFNDMHDSNPQKTFGYVLQKLSKMDLAYVHLIEPAIPEGEHPTPDLSARFFRPLYSGTLIVAGEYTREKGTQILKSGLADLVAFGRPFLANPDLVERFKKGAALNSFDPATFYGGGVAGYTDYPVLD

SEQ ID NO: 20385 - protein, 123 aa, Leptospirillum ferrooxidans
PNRQDGRIIEATSGNTVVALAQIAVLKGYAITIVMPEGVSGERVSHLKALGAEVLLTPSRDGMVGAIRKATEMEKSIKGLFMPRQFENPSNPESHYRTTGPEIFRQLGRVPDGFVAGVGTGGT

SEQ ID NO: 20386 - protein, 395 aa, Fritschea bemisiae
MDKLSLRDLKLNQKRVLMRVDFNVPLNADGSIRDATRIILTLPSIEYILRQKGRLVLISHLGRPKGSFDSKVSLRPCAQKLGELLGKEVGFCFDCIGAEVQKRVQNLNPGEVLLLENLRFHKGEESPEKDPGFAQSLAELGDVYINDAFGAAHRSHASIVPIAQFFPANCGVGFLMEKEIAAFSKIYLNPNRPFYAMVGGAKIGNKIDILQALSKRVDGLFIGGGMAFTFFKAKGLAIGESICDESRLKFARDFLKECERKGIRLHLPIDVVVTNGKKIQTVQIKGGVPDKWEGKDIGPQTVELWSKELNRGATLFWNGPMGVFEERAFASGTERLAHFLSEVPGDVTIGGGDLVAAVQSLNLEKKLSHVSSGGGASLEFLANGTLPGVEALSNK

SEQ ID NO: 20387 - protein, 303 aa, Mycobacterium bovis AF2122/97
MTKWTAADIPDQTGRTAVITGANTGLGFETAAALAAHGAHVVLAVRNLDKGKQAAARITEATPGAEVELQELDLTSLASVRAAAAQLKSDHQRIDLLINNAGVMYTPRQTTADGFEMQFGTNHLGHFALTGLLIDRLLPVAGSRVVTISSVGHRIRAAIHFDDLQWERRYRRVAAYGQAKLANLLFTYELQRRLAPGGTTIAVASHPGVSNTELVRNMPRPLVAVAAILAPLMQDAELGALPTLRAATDPAVRGGQYFGPDGFGEIRGYPKVVASSAQSHDEQLQRRLWAVSEELTGVVYPVG

SEQ ID NO: 20388 - protein, 280 aa, Mycobacterium bovis AF2122/97
MGDLSIQNLVVEYYSGGYALRPINGLNLDVAAGSLVMLLGPSGCGKTTLLSCLGGILRPKSGAIKFDEVDITTLQGAELANYRRNKVGIVFQAFNLVPSLTAVENVMVPLRSAGMSRRASRRRAEELLARVNLAERMNHRPGDLSGGQQQRVAVARAIALDPPLILADEPTAHLDFIQVEEVLRLIRELADGERVVVVATHDSRMLPMADRVVELTPDFAETNRPPETVHLQAGEVLFEQSTMGDLIYVVSEGEFEIVHDWPTAVRNWSRLPGRGITSAR

SEQ ID NO: 20389 - protein, 496 aa, Mycobacterium bovis AF2122/97
MSLLITSPATVAAAATHLAGIGSALSTANAAAAAPTTALSVAGADEVSVLIAALFEAYAQEYQALSAQALAFHDQFVQALNMGAVCYAAAETANATPLQALQTVQQNVLTVVNAPTQALLGRPIIGNGANGLPNTGQDGGPGGLLFGNGGNGGSGGVDQAGGNGGAAGLIGNGGSGGVGGPGIAGSAGGAGGAGGLLFGNGGPGGAGGIGTTGDGGPGGAGGNAIGLFGSGGTGGMGGVGGMGGVGNGGNAGNGGTAGLFGHGGAGGAGGIGSADGGLGGGGGNGRFMGNGGVGGAGGYGASGDGGNAGNGGLGGVFGDGGAGGTGGLGDVNGGLAGIGGNAGFVGNGGAGGNGQLGSGAVSSAGGMGGNGGLVFGNGGPGGLGGPGTSAGNGGMGGNAVGLFGQGGAGGAGGSGFGAGIPGGRGGDGGSGGLIGDGGTGGGAGAGDAAASAGGNGGNARLIGNGGDGGPGMFGGPGGAGGSGGTIFGFAGTPGPS

SEQ ID NO: 20390 - protein, 388 aa, Mycobacterium bovis AF2122/97
MRNELNDDEAMLVATVRAFIDRDVKPTVREVEHANSYPEAWIEQMKHIGIYGLAIDEQYGGSPVSMPCYVQVTQELARGWMSLAGAMGGHTVVAKLLTLFGTEEQRRTYLPPMASGELRATMALTEPGGGSDLQNMSTTALADGPEGSAGLLINGCKTWISNARRSGLFAVLCKTDPNATPRHQGMSIVLVEPGPGLTVSRDLPKLGYKGVESCELSFDNLRVPVSAILGGAMGQGFSQMMKGLETGRIQVAARALGVATAALEDSLAYAQQRESFGRPIWQHQAVGNYLADMATKLTAARQLTRYAAERYDSGQRCDMEAGMAKLFASEVAMEIALNAVRIHGGYGYSTEYDVERYFRDAPLMILGEGTNEIQRNVIAGQLVARGGI

SEQ ID NO: 20391 - protein, 302 aa, Mycobacterium bovis AF2122/97
MSGNEVHPDLRRIAVVTPRQLVGPRTLPVMRALIVVAGLRMSRTPPDIEVLTLESGVGVRLYRPAGSNEPAPALLWIHAGGYVMGTAQQDDRLCLRFSSRLGITVASVDYRLAPENPYPAALGDCYSALTWLASLPAVDPARVAIGGASAGGGLAAALALLARDRGGITPAFQLLVYPMLDDRTSIAPANPHYRLWNGRANRFGWRAYLGDADARVAVPGRRDDLGGLAPAWIGVGTHDLLHDEDLAYAERLTAAGVPCQVEVVEGAFHGFDRVAPNVGVSQRFFTSQCNSLRAALALSNRT

SEQ ID NO: 20392 - protein, 449 aa, Mycobacterium bovis AF2122/97
MASTLTTGLPPGPRLPRYLQSVLYLRFREWFLPAMHRKYGDVFSLRVPPYADNLVVYTRPEHIKEIFAADPRSLHAGEGNHILGFVMGEHSVLMTDEAEYARMRSLLMPAFTRAALRGYRDMIASVAREHITRWRPHATINSLDHMNALTLDIILRVVFGVTDPKVKAELTSRLQQIINIHPAILAGVPYPSLKRMNPWKRFFHNQTKIDEILYREIASRRIDSDLTARTDVLSRLLQTKDTPTKPLTDAELRDQLITLLLAGHETTAAALSWTLWELAHAPEIQSQVVWAAVGGDDGFLEAVLKEGMRRHTVIASTARKVTAPAEIGGWRLPAGTVVNTSILLAHASEVSHPKPTEFRPSRFLDGSVAPNTWLPFGGGVRRCLGFGFALTEGAVILQEIFRRFTITAAGPSKGETPLVRNITTVPKHGAHLRLIPQRRLGGLGDSDPP

SEQ ID NO: 20393 - protein, 1306 aa, Mycobacterium bovis AF2122/97
MSFVIATPEMLTTAATDLAKIGSTITAANTAAAAVAKVLPASADEVSVAVAALFGTHAQEYQTVSAQVATFHDRFVQTLSAAASSYVAAEAVNVEQSLLAAVNAPTQALFGRPLIGNGADGSPGTGQAGGPGGILYGNGGNGGSGAPGQRGGAGGAAGLIGNGGNGGAGGVGTTGGAGGHGGAGGWLYGNGGAGGFGGAGAVGGNGGAGGTAGLFGVGGAGGAGGNGIAGVTGTSASTPGGSGTAGGAGGIGGNGGAGGAGGVLMGNGGNGGAGGEGGPGGAGGAGASGAHATNLGADGQAGGNGGNGGAGGTGGVGGPGGGHGLLGLGGSHGAGGAGGSGGDGGAPGDGGNGATGTWGHNLGAGGTGGNGGNPGAGGAGGAGGASVGGSAHGANGAPGTTSTSGGNGGDGGKGADAISSGQTGANGGRGGDGGQVGNGGAGGAGGRGGAGGLGFGSEAPGRPGGAGGTGGAGGNGGTQAGDGGTGGAGGAGGDGGSGGAGSIGFNASAPGAAGSPGGNGGNGGPGGAGGEGGAGGLALAASGQNGSQGAGGDGGAGGNGGTPGNGGHGAAGALGVNGGVGGAGGHGGDPGVGGAGGQGGSGSTPGANGAPGNTPTSGGNGGNGGRGADATGFGQTGASGGRGGDGGLVGNGGAGGAGGNGSKGLPGLGRLGNPGLDGGTGGNGGAGGSGGAWAGNGGTGGAGGTGGVGGTGGSGSDGVNGSSAGADGHPGGTGGVGGTGGKGGDGGDGGAAPNGVAGSQGPGGAGGDGGTGGVGGNGGRGIDGADGATAGARGQDGGAGGAGGKGGRGGTGGPGGAGPAGTTGSQGAGGNGGSGGTGGDPGDGGNGANGSVFTNNGIGGNGGNGGNAGPSGAGGSGGAGSTFGATGSSSSIHVNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGTGGTGGTGGDGGRGAHGTLFSSLAGTGGTGGNGGTGGTGGTGGAGGAGGTGSTLGATGATGAAGRAGNGGVGGSGGLGSAFGPGGTGGMGGAGGTSTVSAGGDGGRGGFGGDGLDASSGGNGGDGGHGGDGFRTAGAGGRGGDGGKGADPGGLFPIPGAGGKGGTGGTGGTAHLGPLAIIGQSGQPGQFGSPGADGRGGAGGAGGGGGAGGSF

SEQ ID NO: 20394 - protein, 326 aa, Mycobacterium bovis AF2122/97
MTPRPRALVTAPLRGPGFAQLRRLADVVYDPWIDQRPLRIYSAEQLADRITAVAADVLVVESDSVGGPVFERGLRVVAATRGDPSNVDIPGATAAGIPVLHTPARNADAVAEMTVALLLAVARHLIPADADVRSGNIFRDGTIPYQRFRGAEIAGLTAGLVGLGAVGRAVRWRLSGLGLRVIAHDPYRDDAGHSLDELLAEADIVSMHAAVTDDTIGMIGAQQFAAMRDGAVFLNTARSQLHDTDALVDALRGGKLAAAGLDHFTGEWLPTDHPLVSMPNVVLTPHIGGATWNTEARQARMVADDLGALLSGNRPAHVVNPEVLGS

SEQ ID NO: 20395 - protein, 390 aa, Mycobacterium bovis AF2122/97
MFVLNDDERVIVETAAAFAGKRLAPHALEWDAAKHFPVDVLREAAELGMAAIYCRDDVGGSGLRRLDGARIFEQLAIADPVTAAFLSIHNMCAWMIDSFGTDEQRKDWIPRLATMGVIASYCLTEPGAGSDAGALSTRAVRHGSGKGGDYVLDGVKQFISGAAASDVYVVMARTGAEGPRGVSAFVVEKGTPGLSFGAPEAKMGWHAQPTAQVVLDGVRVPAEAMLGGADGEGAGFGIAMSGLNGGRLNIAACSLGGAQAAFDKAGAYVRDRQAFGGSLLDEPTVRFTLADMATGLQTSRMLLWRAASALDDDDADKVELCAMAKRYVTDTCFEVADQALQLHGGYGYLREYGLEKIVRDLRVHRILEGTNEIMRLVIGRAEAARFRATV

SEQ ID NO: 20396 - protein, 295 aa, Mycobacterium bovis AF2122/97
MTAHPETPRLGYIGLGNQGAPMAKRLLDWPGGLTVFDVRVEAMAPFVEGGATAAASVSDVAEADIISITVFDDAQVSSVITADNGLATHAKPGTIVAIHSTIADTTAVDLAEKLKPQGIHIVDAPGSGGAAAAAKGELAVMVGADDEAFQRIKEPFSRWASLLIHAGEPGAGTRMKLARNMLTFVSYAAAAEAQRLAEACGLDLVALGKVVRHSDSFTGGAGAIMFRNTTAPMEPADPLRPLLEHTRGLGEKDLSLALALGEVVSVDLPLAQLALQRLAAGLGVPHPDTEPAKET

SEQ ID NO: 20397 - protein, 299 aa, Mycobacterium bovis AF2122/97
MTAAQQDQAPMATPGCREGETYDVVVLGAGPVGQNVADRARAGGLRVAVVERELVGGECSYWACVPSKALLRPVIAISDARRVDGAREAVDGSINTAGVFGRRNRYVAHWDDTGQADWVSGIGATLIRGDGRLDGPRRVVVTKSSGESVALTARHAVVICTGSRPALPDLPGITEARPWTNRQATDNSTVPDRLAIVGAGGVGVEMATAWQGLGASVTLLARGSGLLPRMEPFVGELIGRGLADAGVDVRVGVSVRALGRPNPLAQWSSSWTTVPSCGSTRYSSPPAEHREPTTSAWRQ

SEQ ID NO: 20398 - protein, 372 aa, Mycobacterium bovis AF2122/97
MRSRQTRDRYRLLPEGYQVTPGRNRHPGTMVGNTPVLWIPELSGTSDPDRGFWAKLEGFNPGGMKDRPALYMVECARARGDIAPGAAIVESTSGTLGLGLALAGKVYRHPVTLVTDPGLEPIIARMLTAYGAGVDMGTQPHPVGGWQQARKDRVAQLMAEYPGAWNPNQYGNPDNVGAYRSLALELVAQLGRIDVLVCSVGTGGHSAGVARVLREFNPDMRLIGVDTIGSTIFGQPASNRLMRGLGSSIYPRNVDYRAFDEVHWVAPPEAVWACRSLAATHYASGGWSVGAVALVAGWAARNLPADTTIAAVFPDGPQRYFDTIYNDAYCNEHELLGGQPPTEPDEIASPLDAVVTRWTRSTTVIDPTQVVS

SEQ ID NO: 20399 - protein, 388 aa, Mycobacterium bovis AF2122/97
MTDTSFIESEERQALRKAVASWVANYGHEYYLDKARKHEHTSELWAEAGKLGFLGVNLPEEYGGGGAGMYELSLVMEEMAAAGSALLLMVVSPAINGTIIAKFGTDDQKKRWLPGIADGSLTMAFAITEPDAGSNSHKITTTARRDGSDWIIKGQKVFISGIDQAQAVLVVGRSEEAKTGKLRPALFVVPTDAPGFSYTPIEMELVSPERQFQVFLDDVRLPADALVGAEDAAIAHLFAGLNPERIMGAASAVGMGRFALGRAVDYVKTRKVWSTPIGAHQGLAHPLAQCHIEVELAKLMTQKAATLYDHGDDFGAAEAANMAKYAAAEASSRAVDQAVQSMGGNGLTKEYGVAAMMTSARLARIAPISREMVLNFVAQTSLGLPRSY

SEQ ID NO: 20400 - protein, 369 aa, Mycobacterium bovis AF2122/97
MNIWTTPERQQLRKTVRAFAEREILPHVDEWERIGELPRGLHRLAGAAGLLGAGFPEAVGGGGGDGADPVIICEEMHQAGAPGGVYASLFTCGIAVPHMVASGDERLIATYVRPTLAGEKIGALAITEPGGGSDVGHLRTSAVRDGDHYVINGAKTYITSGVRADYVVTAVRTGGPGAAGVSLLVVEKDTPGFEVTRKLDKMGWRSSDTAELCYTDVAVPATNLVGAENSGFTQIARAFVSERIGLAAQAYSSAQRCLDLTAQWCRDRETFGRPLISRQSVQNTLAEMARRIDVARVYAHHVVERQLAGETDLIAQVCFAKNTAVQAGEWVANQAVQLFGGMGYMAESEANANTGTCESSVSEAAPPKY

SEQ ID NO: 20401 - protein, 429 aa, Mycobacterium bovis AF2122/97
MPIIEQVGAREILDSRGNPTVEVEVALIDGTFARAAVPSGASTGEHEAVELRDGGDRYGGKGVQKAVQAVLDEIGPAVIGLNADDQRLVDQALVDLDGTPDKSRLGGNAILGVSLAVAKAAADSAELPLFRYVGGPNAHILPVPMMNILNGGAHADTAVDIQEFMVAPIGAPSFVEALRWGAEVYHALKSVLKKEGLSTGLGDEGGFAPDVAGTTAALDLISRAIESAGLRPGADVALALDAAATEFFTDGTGYVFEGTTRTADQMTEFYAGLLGAYPLVSIEDPLSEDDWDGWAALTASIGDRVQIVGDDIFVTNPERLEEGIERGVANALLVKVNQIGTLTETLDAVTLAHHGGYRTMISHRSGETEDTMIADLAVAIGSGQIKTGAPARSERVAKYNQLLRIEEALGDAARYAGDLAFPRFACETK

SEQ ID NO: 20402 - protein, 362 aa, Mycobacterium bovis AF2122/97
MSASLPVFPWDTLADAKALAGAHPDGIVDLSVGTPVDPVAPLIQEALAAASAAPGYPATAGTARLRESVVAALARRYGITRLTEAAVLPVIGTKELIAWLPTLLGLGGADLVVVPELAYPTYDVGARLAGTRVLRADALTQLGPQSPALLYLNSPSNPTGRVLGVDHLRKVVEWARGRGVLVVSDECYLGLGWDAEPVSVLHPSVCDGDHTGLLAVHSLSKSSSLAGYRAGFVVGDLEIVAELLAVRKHAGMMVPAPVQAAMVAALDDDAHERQQRERYAQRRAALLPALGSAGFAVDYSDAGLYLWATRGEPCRDSVAWLAQRGILVAPGDFYGPGGAQHVRVALTATDERVAAAVGRLTC

SEQ ID NO: 20403 - protein, 2085 aa, Mycobacterium bovis AF2122/97
MRTATATSVAVIGMACRLPGGIDSPQRLWEALLRGDDLVGEIPADRWDANVYYDPEPGVPGRSVSRWGAFLDDVGGFDCDFFGLTEREATAIDPQHRLLLEVSWEAIEHAGVDPATLAESQTGVFVGLTHGDYELLSADCGAAEGPYGFTGTSNSFASGRVAYTLGLHGPAVTVDTACSSGLTAVHQACRSLDDGESDLALAGGVVVTLEPRKSVSGSLQGMLSPTGRCHAFDEAADGFVSGEGCVVLLLKRLPDAVRDGDRVLAIVRGTAANQDGRTVNIAAPSAQAQIAVYQQALAAAGVEASTVGMVEAHGTGTPVGDPVEYASLAAVYGTEGPCALTSVKTNFGHLQSASGPLGLMKTILALRHGVVPQNLHFCRLPDQLAEIDTELFVPQANTSWPDNTGQPRRAAVSSYGMSGTNVHAILEQAPVSEPAASGPELTPEAGGLALFPVSATSAEQLHVTAARLADWVDQNGNAGSRVSMRDLGYTLSCRRAHRPVRTVVTASSFDELSAALRDVAGDQIPYQPAVGHDDRGPVWVFSGQGSQWPGMGTELLVAEPVFAATVAAMEPVIARESGFSVTEAMSAPQTVSGIDRVQPTIFAVQVALAAALKSYGVRPGAIIGHSLGEAAAAVVAGALSLHDGLRVICRRSRLMSRIAGSGAMASVELPGQQVLSELAIRGISDVVLSVVASPTSTVVGGATQSIRDLVAAWEQQDVLAREVAVDVASHTPQVDPILDELLEVLAEVDPTAPEIPYYSATLWDPRERPSFTGEYWVENLRYTVRFAAAVQAALKDGYRVFGELAPHPLLTYAVEQNAASLDMPIATLAAMRRGEQLPFGLRGFVADVHNAGAKVDFSVQYPDGRLVDAPLPSWTHRTLMLSREDSHRSHTGAVQAVHPLLGAHVHLLEEPERHVWQAGVGTGAHPWLGDHRIHNVAAFPGAAYCEMALAAARTTLGELSEVRDIKFEQTLLLDEQTVVSSAATIAAPGILQFAVESHQEGEPARRASAMLHALEEMPQPPGYDTNALTAAHESSMSGEELRKMFNSLGIQYGPAFSGLVAVHTARGAVTTVLAEVALPGAIRSQQSAYASHPALLDACFQSVLVHPEVQKATVGGLMLPVGVRRLRNYHSTRSAHYCLARVTSSSRAGECEADLDVFDQAGTVLLTVEGLRLAAGISEHERANRVFDERLLTIEWERGELPEVPQIDAGSWLLLSASEADPLTAQLADALNAVGAQSTSVASASDVAQLRSLLGGRLTGVVVVTGPPTGGLTQCGRDYVSQLVGIARELAELPGEPPRLFVVTRSAASVLPSDLANLEQAGLRGLMRVIDSEHPHLGATAIDVDNDETVAALVASQLQSGSQEDETAWRNGIWYTARLRPGPLRPAERRTAVVEYRRDGMRLQIRTPGDLESLEFVTFDRVAPGPGEIEVAVTASSVNFADVLVAFGRYPTFEGYRQQLGIDFAGVVTAVGPDVTEHRIGDHVGGMSANGCWSTFVRCDARLAVTLPPELPVAAAAAVPTASATAWYALHDLARICSDDKVLIHSGTGGVGQAAIAIARAAGCEIFATAGSAQRRQLLHDMGVEHVYDSRSTEFAEQIRGDTDGYGVDVVLNSLPGAAQRAGIELLAFGGRFVEIGKRDIYGDTRLGLFPFRRNLSLYAVDLALLTHSHPHTVRRLLKTVYQHTVEGTLPVPQTTHYPIHDAAVAIRLVGGAGHTGKVVLDVPRTGEGVAVVPPEQVRTSRPDGAYLVTGGLGGLGLFLAGELAAAGCGRIVLNSRSTPSPHATRVIERLRAAGADIQVECGDIADAATAHRVVAVATASGLPVRGVLHAAAVVEDATLANVTDELIDRCWAPKVHGAWNIHRATAAQPLEWFCLFSSAAALVGSPGQGAYAAANSWLDAFAHWRRAQGLPATSIAWGAWAEIGRATALAEGTGAAIAPAEGARAFQTLLRYGRAYSGYAPIMGTPWLTAFAQRSRFAEAFHATGQNQPATGKFLAELGSLPREEWPRTVRRLVSDQISLLLRRTIDPDRPLSDYGLDSLGNLELRTRIETETGIRVSPTKITTVRGLAEHVCDELAAAQSAPV

SEQ ID NO: 20404 - protein, 448 aa, Mycobacterium bovis AF2122/97
MGPPPAARRREGEPDNQDPAGLLTDKYELTMLAAALRDGSANRPTTFEVFARRLPTGRRYGVVAGTGRLLEALPQFRFDADACELLAQFLDPATVRYLREFRFRGDIDGYAEGELYFPGSPVLSVRGSFAECVLLETLVLSIFNHDTAIASAAARMVSAAGGRPLIEMGSRRTHERAAVAAARAAYIAGFAASSNLAAQRRYGVPAHGTAAHAFTMLHAQHGGPTELAERAAFRAQVEALGPGTTLLVDTYDVTTGVANAVAAAGAELGAIRIDSGELGVLARQAREQLDRLGATRTRIVVSGDLDEFSIAALRGEPVDSYGVGTSLVTGSGAPTANMVYKLVEVDGVPVQKRSSYKKSPGGRKEALRRSRATGTITEELVHPAGRPPVIVEPHRVLTLPLVRAGQPVADTSLAAARQLVASGLRSLPADGLKLAPGEPAIPTRTIPA

SEQ ID NO: 20405 - protein, 461 aa, Mycobacterium bovis AF2122/97
MATATTQRPLKGPAKRMSTWTMTREAITIGFDAGDGFLGRLRGSDITRFRCAGRRFVSISHPDYVDHVLHEARLKYVKSDEYGPIRATAGLNLLTDEGDSWARHRGALNSTFARRHLRGLVGLMIDPIADVTAALVPGAQFDMHQSMVETTLRVVANALFSQDFGPLVQSMHDLATRGLRRAEKLERLGLWGLMPRTVYDTLIWCIYSGVHLPPPLREMQEITLTLDRAINSVIDRRLAEPTNSADLLNVLLSADGGIWPRQRVRDEALTFMLAGHETTANAMSWFWYLMALNPQARDHMLTELDDVLGMRRPTADDLGKLAWTTACLQESQRYFSSVWIIAREAVDDDIIDGHRIRRGTTVVIPIHHIHHDPRWWPDPDRFDPGRFLRCPTDRPRCAYLPFGGGRRICIGQSFALMEMVLMAAIMSQHFTFDLAPGYHVELEATLTLRPKHGVHVIGRRR

SEQ ID NO: 20406 - protein, 452 aa, Mycobacterium bovis AF2122/97
MSFLFAQPEMLGAAATDLASIGSAISTANAAAAAATTRVLAAGADEVSAAVAALFSGHAQTYQALSTQAAAFHQQIVQTLTSTAGAYASAEAANVEQQLLGAINAPTMALLGRPLIGHGADGAPGTGQAGGAGGILYGNGGNGGSGATGQAGGAGGAAGLIGHGGAGGLGGTGASGGAGGAGGWLWGNGGAGGNGGVGVAGDPGGVGGAGGAGGAAGLWGSGGSGGTGGQGGVGGGKSGDGGTGGIGGAGGGGGWLHGDGGAGGHGGQGGTGVSSGGNGGAGGTGGDGRGLSGSGGAGGHGGQTGVGGKVGENNFGGAGGAGGTGGLIGNGGAGGTGGKGGDGFGVFGKGGAGGTGGRGGAAGLIGDAGTGGTGGKGGTAGEDGTGGNGGTGGNGGAAVLIGNGGGGGAGGNGGAGNDGTPGNGGGGGVGGTGGTLFGQPGQPGPPGQPGPA

SEQ ID NO: 20407 - protein, 491 aa, Mycobacterium bovis AF2122/97
MSNVMVVPGMLSAAAADVASIGAALSAANGAAAPTTAGVLAAGADEVSAAIASLFSGYARDYQALSAQMARFHQQFVQALTASVGSYAAAEAANASPLQALEQQVLAAINAPTQTLLGRPLIGNGADGLPGQNGGAGGLLWGNGGNGGAGDAAHPNGGNGGDAGMFGNGGAGGAGYSPAAGTGAAGGAGGAGGAGGWLSGNGGAGGNGGTGASGADGGGGLPPVPASPGGNGGGGGAGGAAGMFGTGGAGGTGGDGGAGGAGDSPNSGANGARGGDGGNGAAGGAGGRLFGNGGAGGNGGTAGQGGDGGTALGAGGIGGDGGTGGAGGTGGTAGIGGSSAGAGGAGGDGGAGGNGGGSSMIGGKGGTGGNGGVGGTGGASALTIGNGSSAGAGGAGGAGGTGGTGGYIESLDGKGQAGNGGNGGNGAAGGAGGGGTGAGGNGGAGGNGGDGGPSQGGGNPGFGGDGGTGGPGGVGVPDGIGGANGAQGKHG

SEQ ID NO: 20408 - protein, 1408 aa, Mycobacterium bovis AF2122/97
MSLVIVAPETVAAAALDVARIGSSIGVANSAAAGSTTSVLAAGADEVSAAIATLFGSHAREYQAISTQVAAFHDRFAQTLSAAVGSYVSAEATNAAPLATLEHNVLNALNAPTQALLGRPLIGDGAAGAPGTGQAGGAGGILWGNGGAGGSGAPGQVGGAGGAAGLFGTGGAGGAGGAGAAGGAGGSGGWLLGNGGVGGAGGQSLLGGATGGAGGNAGLFGVGGTGGPGGPGGPGGPGGPGGPGGVGGTGGAGGLGGTLYGAGGHGGAGGPGPIGGVGGHGGVGGAAGLLGVGGHGGAGGHGAAGIAGAAGKGGIFPDGSNGGAGGDAGDGGTGGRGGWLAGAGGAGGDGGIGGTGGAGGAGFSRALIVAGDNGGDGGNGGMGGAGGAGGPGGAGGLISLLGGQGAGGDGGDGGAGGVGGDRGAGANGNQAVNAGAGGAGGHGGDPGAGGAGGTGGAGSTIGAHGAAGASPTSGGNGGAGGNGAHFSSGGKAGGNGGAGGAGGLVGNGGAGGAGGNGAPGAPPSGGDPNGGGGGAGGAGGKGGDGGAQAGDGGAGGAGGKGGNGGNGATGATGLNGLGAGADGTDGGKGGNGGAGGGGGAGGQGGKALAATHQDGSMGAGGAGGNGGAGGMGGDGGNGAKGTFDNGGDGVGGNGGNGGSRGIGGAGGIGGAGSTAGADGARGATPTSGGNGGTGGNGANATVAGGAGGAGGKGGNGGLVGNGGAGGKGGDGMAGVAGSSPTTAGESGTSGQNGGAGGAGGAGGRGGDFGGDGGTGGAGGNGADGGAGGNGANGANATTPGAKGGDGGHGGPGAQGGNGGQGGPGGLAGNLFGQNGIQGVGGSGGKGGAGGLAGDGGNGANGNFAFGDGNGGHGGNGGNPGAGGQGGSGGAGSTPGAKGAHGFTPTSGGDGGDGGNGGHSQVVGGNGGDGGNGGNGGSAGTGGNGGRGGDGAFGGMSANATNPGENGPNGNPGGNGGAGGAGGAGLNGGNGGAGGNGGLGGFGGNGAAGANGVAVGAPGQPGGAGGHGGAGGNGGAGGNGGQGVVSDGAGGAGGAGGDGGAPGDGANGGNGQGAGAFAGGGGGRGGDGGNAGNAGAGGPGGTGSTAGKAGPAGSILHDGGNGGHGGHGAASGGNGGPGGHGGNGGNGGTGANGGNGGIGGTGGAGSTGAKGVLGTNEGDGGDGGRGGNGGRGGNGGQGLTGAGGNGGTGGTPGNGGNGGNGASGDLVTSPGDGGGGGRGGDAGRGGDAGLGGSSGPGGTPGDWGTGGTGGTGGTGGQGANGGLTGGRGGTGGNGGAGGTGGTGHNGSQPGMGGNGGAGGFGGNGFAGVGGRGGMGGSGGTGGTGDAGPFGTGTGGTGGHGGQGGGGGFSILLGLGGLGGLGSPGSIATGTAGGAGGGGGFGGLGGGEFV

SEQ ID NO: 20409 - protein, 2108 aa, Mycobacterium bovis AF2122/97
MGKERTKTVDRTRVTPVAVIGMGCRLPGGIDSPDRLWEALLRGDDLVTEIPADRWDIDEYYDPEPGVPGRTDCKWGAYLDNVGDFDPEFFGIGEKEAIAIDPQHRLLLETSWEAMEHGGLTPNQMASRTGVFVGLVHTDYILVHADNQTFEGPYGNTGTNACFASGRVAYAMGLQGPAITVDTACSSGLTAIHLACRSLHDGESDIALAGGVYVMLEPRRFASGSALGMLSATGRCHAFDVSADGFVSGEGCVMLALKRLPDALADGDRILAVIRGTAANQDGHTVNIATPSRSAQVAAYREALDVAGVDPATVGMVEAHGPGTPVGDPIEYASLAEVYGNDGPCALASVKTNFGHTQSAAGALGLMKAVLALQHGVVPQNLHFTALPDKLAAIETNLFVPQEITPWPGADQETPRRAAVSSYGMTGTNVHAIVEQAPVPAPESGAPGDTPATPGIDGALLFALSASSQDALRQTAARLADWVDAQGPELAPADLAYTLARRRGHRPVRTAVLAATTAELTEALREVATGETPYPPAVGQDDRGPVWVFSGQGSQWAGMGADLLATEPVFAATIAAIEPLIAAESGFSVTEAMTAPEVVTGIDRVQPTLFAMQVALAATMKSYGVAPGAVIGHSLGESAAAVVAGALCLEDGVRVICRRSALMTRIAGAGAMASVELPAQQVLSELMARGVNDAVVAVVASPQSTVIGGATQTVRDLVAAWEQRDVLAREVAVDVASHSPQVDPILDELAEALAEISPLQPEIPYYSATSFDPREEPYCDAYYWVDNLRHTVRFAAAVQAALEDGYRVFTELTPHPLLTHAVDQTARSLDMSAAALAGMRREQPLPHGLRALAGDLYAAGAAVDFAVLYPTGRLINAPLPTWNHRRLLLDDTTRRIAHANTVAVHPLLGSHVRLPEEPERHVWQGEVGTVTQPWLADHQIHGAAALPGAAYCEMALAAARAVLGEASEVRDIRFEQMLLLDDETPIGVTATVEAPGVVPLTVETSHDGRYTRQLAAVLHVVREADDAPDQPPQKNIAELLASHPHKVDGAEVRQWLDKRGHRLGPAFAGLVDAYIAEGAGDTVLAEVNLPGPLRSQVKAYGVHPVLLDACFQSVAAHPAVQGMADGGLLLPLGVRRLRSYGSARHARYCCTTVTACGVGVEADLDVLDEHGAVVLAVRGLQLGTGASQASERARVLGERLLSIEWHERELPENSHAEPGAWLLISTCDATDLVAAQLTDALKVHDAQCTTMSWPQRADHAAQAARLRDQLGTGGFTGVFVLTAPQTGDPDAESPVRGGELVKHVVRIAREIPEITAQEPRLYVLTHNAQAVLSGDRPNLEQGGMRGLLRVIGAEHPHLKASYVDVDEQTGAESVARQLLAASGEDETAWRNDQWYTARLCPAPLRPEERQTTVVDHAEAGMRLQIRTPGDLQTLEFAALDRVPPGPGEIEVAVTASSINFADVLVTFGRYQTLDGRQPQLGTDFAGVVSAVGPGVSELKVGDRVGGMSPNGCWATFVTCDARLATRLPEGLTDAQAAAVTTASATAWYGLQDLARIKAGDKVLIHSATGGVGQAAIAIARAAGAQIYATAGNEKRRDLLRDMGIEHVYDSRSVEFAEQIRRDTAGYGVDIVLNSVTGAAQLAGLKLLALGGRFIEIGKRDIYSNTRLELLPFRRNLAFYGLDLGLMSVSHPAAVRELLSTVYRLTVEGVLPMPQSTHYPLAEAATAIRVMGAAEHTGKLILDVPHAGRSSVVLPPEQARVFRSDGSYIITGGLGGLGLFLAEKMANAGAGRIVLSSRSQPSQKALETIELVRAIGSDVVVECGDIAQPDTADRLVTAATATGLPLRGVLHAAAVVEDATLANITDELIERDWAPKAYGAWQLHRATADQPLDWFCSFSSAAALVGSPGQGAYAAANSWLDTFTHWRRAQDLPATSIAWGAWGQIGRAIAFAEQTGDAIAPEEGAYAFETLLRHNRAYSGYAPVIGSPWLTAFAQHSPFAEKFQSLGQNRSGTSKFLAELVDLPREEWPDRLRRLLSKQVGLILRRTIDTDRLLSEYGLDSLSSQELRARVEAETGIRISATEINTTVRGLADLMCDKLAADRDAPAPA

SEQ ID NO: 20410 - protein, 472 aa, Mycobacterium bovis AF2122/97
MTRRGKIVCTLGPATQRDDLVRALVEAGMDVARMNFSHGDYDDHKVAYERVRVASDATGRAVGVLADLQGPKIRLGRFASGATHWAEGETVRITVGACEGSHDRVSTTYKRLAQDAVAGDRVLVDDGKVALVVDAVEGDDVVCTVVEGGPVSDNKGISLPGMNVTAPALSEKDIEDLTFALNLGVDMVALSFVRSPADVELVHEVMDRIGRRVPVIAKLDKPEAIDNLEAIVLAFDAVMVARGDLGVELPLEEVPLVQKRAIQMARENAKPVIVATQMLDSMIENSRPTRAEASDVANAVLDGADALMLSGETSVGKYPLAAVRTMSRIICAVEENSTAAPPLTHIPRTKRGVISYAARDIGERLDAKALVAFTQSGDTVRRLARLHTPLPLLAFTAWPEVRSQLAMTWGTETFIVPKMQSTDGMIRQVDKSLLELARYKRGDLVVIVAGAPPGTVGSTNLIHVHRIGEDDV

SEQ ID NO: 20411 - protein, 1018 aa, Mycobacterium bovis AF2122/97
MSFLLVEPDLVTAAAANLAGIRSALSEAAAAASTPTTALASAGADEVSAAVSRLFGAYGQQFQALNARAATFHAEFVSLLNGGAAAYTGAEAASVSSMQALLDAVNAPTQTLLGRPLIGNGADGVAGTGSNAGGNGGPGGILYGNGGNGGAGGPDGGAGGNGGAAGLIGNGGAGGAGGVGGAGGAGGAGGTGGLLYGNGGAGGNGGSAAAAGGAGGNALLFGNGGNGGSGASGGAAGHAGTIFGNGGNAGAGSGLAGADGGLFGNGGDGGSSTSKAGGAGGNALFGNGGDGGSSTVAAGGAGGNTLVGNGGAGGAGGTSGLTGSGVAGGAGGSVGLWGSGGAGGDGGAATSLLGVGMNAGAGGAGGNAGLLYGNGGAGGAGGNGGDTTVPLFDSGVGGAGGAGGNASLFGNGGTGGVGGKGGTSSDLASATSGAGGAGGAGGVGGLLYGNGGNGGAGGIGGAAINILANAGAGGAGGAAGSSFIGNGGNGGAGGAGGAAALFSSGVGGAGGSGGTALLLGSGGAGGNGGTGGANSGSLFASPGGTGGAGGHGGAGGLIWGNGGAGGNGGNGGTTADGALEGGTGGIGGTGGSAIAFGNGGQGGAGGTGGDHSGGNGIGGKGGASGNGGNAGQVFGDGGTGGTGGAGGAGSGTKAGGTGSDGGHGGNATLIGNGGDGGAGGAGGAGSPAGAPGNGGTGGTGGVLFGQSGSSGPPGAAALAFPSLSSSVPILGPYEDLIANTVANLASIGNTWLADPAPFLQQYLANQFGYGQLTLTALTDATRDFAIGLAGIPPSLQSALQALAAGDVSGAVTDVLGAVVKVFVSGVDASDLSNILLLGPVGDLFPILSIPGAMSQNFTNVVMTVTDTTIAFSIDTTNLTGVMTFGLPLAMTLNAVGSPITTAIAFAESTTAFVSAVQAGNLQAAAAALVGAPANVANGFLNGEARLPLALPTSATGGIPVTVEVPVGGILAPLQPFQATAVIPVIGPVTVTLEGTPAGGIVPALVNYAPTQLAQAIAP

SEQ ID NO: 20412 - protein, 501 aa, Mycobacterium bovis AF2122/97
MSFVVTIPEALAAVATDLAGIGSTIGTANAAAAVPTTTVLAAAADEVSAAMAALFSGHAQAYQALSAQAALFHEQFVRALTAGAGSYAAAEAASAAPLEGVLDVINAPALALLGRPLIGNGANGAPGTGANGGDGGILIGNGGAGGSGAAGMPGGNGGAAGLFGNGGAGGAGGNVASGTAGFGGAGGAGGLLYGAGGAGGAGGRAGGGVGGIGGAGGAGGNGGLLFGAGGAGSVGGLAADAGDGGAGGDGGLFFGVGGAGGAGGTGTNVTGGAGGAGGNGGLLFGAGGVGGVGGDGVAFLGTAPGGPGGAGGAGGLFGVGGAGGAGGIGLVGNGGAGGSGGSALLWGDGGAGGAGGVGSTTGGAGGAGGNAGLLVGAGGAGGAGALGGGATGVGGAGGNGGTAGLLFGAGGAGGAGGFGFGGAGGAGGLGGKAGLIGDGGDGGAGGNGTGAKGGDGGAGGGAILVGNGGNGGNAGSGTPNGSAGTGGAGGLLGKNGMNGLP

SEQ ID NO: 20413 - protein, 450 aa, Mycobacterium bovis AF2122/97
MTATPLAAAAIAQLEAEGVDTVIGTVVNPAGLTQAKTVPIRRTNTFANPGLGASPVWHTFCIDQCSIAFTADISVVGDQRLRIDLSALRIIGDGLAWAPAGFFEQDGTPVPACSRGTLSRIEAALADAGIDAVIGHEVEFLLVDADGQRLPSTLWAQYGVAGVLEHEAFVRDVNAAATAAGIAIEQFHPEYGANQFEISLAPQPPVAAADQLVLTRLIIGRTARRHGLRVSLSPAPFAGSIGSGAHQHFSLTMSEGMLFSGGTGAAGMTSAGEATVAGVLRGLPDAQGILCGSIVSGLRMRPGNWAGIYACWGTENREAAVRFVKGGAGSAYGGNVEVKVVDPSANPYLASAAILGLALDGMKTKAVLPSETTVDPTQLSDVDRDRAGILRLAADQADAIAVLDSSKLLRCILGDPVVDAVVAVRQLEHERYGDLDPAQLADKFRMAWSV

SEQ ID NO: 20414 - protein, 334 aa, Mycobacterium bovis AF2122/97
MRAVVITKHGDPSVLQVRQRPDPPPPGPGQLRVAVRAAGVNFADHLARVGLYPDAPKLPAVVGYEVAGTVEAVGDGVDPNRVGERVLAGTRFGGYCEIVNVAATDSVVLPDALSFEQGAAVPVNYATAWAALHGYGSLRAGERVLIHAAAGGVGIAAVQFAKAAKAEVHGTASPQKHQKLAEFGVDRAIDYRRDGWWQGLGPYDVVLDALGGTSLRRSYTLLRPGGRLVGYGISNMQHGEKRSMRRVAPHALSMLRGFNLMKQLEESKTVIGLNMLRLWDDRRTLEPWIAPLTKALNDGTILPIVHAIVPFAEAPEAHRILAARENVGKVVLVP

SEQ ID NO: 20415 - protein, 1327 aa, Mycobacterium bovis AF2122/97
MRCGIVVNVTGPPPTIDRRYHDAVIVGLDNVVDKATRVHAAAWTKFLDDYLTRRPQRTGEDHCPLTHDDYRRFLAGKPDSVADFLAARGIRLPPGSPTDLTDDTVYGLQNLERQTFLQLLNTGVPEGKSIASFARRLQVAGVRVAAHTSHRNYGHTLDATGLAEVFAVFVDGAVTAELGLPAEPNPAGLIETAKRLGANPGRCVVIDSCQTGLRAGRNGGFALVIAVDAHGDAENLLSSGADAVVADLAAVTVGSGDAAISTIPDALQVYSQLKRLLTGRRPAVFLDFDGTLSDIVERPEAATLVDGAAEALRALAAQCPVAVISGRDLADVRNRVKVDGLWLAGSHGFELVAPDGSHHQNAAATAAIDGLAEAAAQLADALREIAGAVVEHKRFAVAVHYRNVADDSVDNLIAAVRRLGHAAGLRVTTGRKVVELRPDIAWDKGKALDWIGERLGPAEVGPDLRLPIYIGDDLTDEDAFDAVRFTGVGIVVRHNEHGDRRSAATFRLECPYTVCQFLSQLACDLQEAVQHDDPWTLVFHGYDPGQERLREALCAVGNGYLGSRGCAPESAESEAHYPGTYVAGVYNQLTDHIEGCTVDNESLVNLPNWLSLTFRIDGGAWFNVDTVELLSYRQTFDLRRATLTRSLRFRDAGGRVTTMTQERFASMNRPNLVALQTRIESENWSGTVDFRSLVDGGVHNTLVDRYRQLSSQHLTTAEIEVLADSVLLRTQTSQSGIAIAVAARSTLWRDGQRVDAQYRVARDTNRGGHDIQVTLSAGQSVTLEKVATIFTSRDAATLTAAISAQRCLGEAGRYAELCQQHVRAWARLWERCAIDLTGNTEELRLVRLHLLHLLQTISPHTAELDAGVPARGLNGEAYRGHVFWDALFVAPVLSLRMPKVARSLLDYRYRRLPAARRAAHRAGHLGAMYPWQSGSDGSEVSQQLHLNPRSGRWTPDPSDRAHHVGLAVAYNAWHYYQVTGDRQYLVDCGAELLVEIARFWVGLAKLDDSRGRYLIRGVIGPDEFHSGYPGNEYDGIDNNAYTNVMAVWVILRAMEALDLLPLTDRRHLIEKLGLTTQERDQWDDVSRRMFVPFHDGVISQFEGYSELAELDWDHYRHRYGNIQRLDRILEAEGDSVNNYQASKQADALMLLYLLSSDELIGLLARLGYRFAPTQIPGTVDYYLARTSDGSTLSAVVHAWVLARANRSNAMEYFRQVLRSDIADVQGGTTQEGIHLAAMAGSIDLPQRCYSGLELRDDRLVLSPQWPEALGPLEFPFVYRRHQLSLRISGRSATLTAESGDAEPIEVECRGHVQRLRCGHTIEVGCSR

SEQ ID NO: 20416 - protein, 355 aa, Mycobacterium bovis AF2122/97
MAGIGSAISAANALVAGPTTALAADRRRRGVDGYRGAVRRECAGIPTDQRAGGRVSRAVCRGPNLGWRVVRGRRDRQRHVGTRSAQCRQCAHPGIVGRPLIGDGANGGPGQPGGPGGLLYGNGGHGGAGAAGQDRGAGNSAGLIGNGGAGGAGGNGGIGGAGAPGGLGGDGGKGGFADEFTGGFAQGGRGGFGGNGNTGASGGMGGAGGAGGAGGAGGLLIGDGGAGGAGGIGGAGGVGGGGGAGGTGGGGVASAFGGGNAFGGRGGDGGDGGDGGTGGAGGARGAGGAGGAGGWLSGHSGAHGAMGSGGEGGAGGGGGARGEAGAGGGTSTGTNPGKAGAPGTQGDSGDPGPPG

SEQ ID NO: 20417 - protein, 489 aa, Mycobacterium bovis AF2122/97
MSAASQRVDAFGEEAGYHKGLKPRQLQMIGIGGAIGTGLFLGASGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 20418 - protein, 490 aa, Mycobacterium bovis AF2122/97
MSFVIAAPEVMAAAATDLANIGSSISAASAAAAGPTMGILAAGADEVSVAISALFGSHAQGYQTLSAQLAAYHNQFVRALNAGAGSYASAEAANVQQTLLNAINAPTQTLLGRPLIGNGADGGPGQNGGPGGLLYGNGGNGGAGDTANPNGGNGGSAGLIGNGGAGGAGAATGAGGAGGNGGWLYGNGGPGGAAGLGTAGGVSPAGGAGGAAGLWGHGGAGGAGGSASGAPGAGGAGGDGGRGGLLYGDGGAGGAGGNGSNGVTGVHGGNGGAGGAAGLIGNGGAGGDGGNGGLSNTGASGGAGGAGGAALIGNGGDGGHGGNGGHGNSGGAGGAGGAGGHVGLIGNGGNGGAGGNGGNDNSSTLADAGSGGAGAAGGNGGLFYGNGGVGGRGGNGGQAPTPGNAGDGGAGGNARLIGDGGRGGNGGEGGDGPPGVKGDGGNGGNGGNAVVIGNGGNGGAGGFGIPVGSGGAGGSRGVLFGTPGANGADG

SEQ ID NO: 20419 - protein, 1150 aa, Mycobacterium bovis AF2122/97
MTAIFLGSSGTPGEDGGNGGAGGAGGAGGAHAGDGGAGGAGGNGGAGGAGGNGAHGFNAVLVSDGGNGGDGGAGGRGGDGGAGGAGGDAPAGRAGSQGVGGDGGAGGAGGAPGNGGSGGRGDMAFKDGDGGAGGDGGDPGAGGKGGAGGAGATEGVTGATGATVHSGGNGGKGGNGADATVAGANGGKGGAGGNGGLVGDGGAGGDGGSGAAGANGANVGEDGADGTLSGQPGEGSEANGGQGGVGGGGAGGAGGDGGAGSSALGSGGNGGRGDAGQAGGAGGAGGAGGAGGSVSGDGGPGGKGGAGGAGGAGASGGGGGKGASGADSAEAVGGAGGKGGDGGVGGVGGDGGPGGDGGAGGAAPAGQVGSHGVGGVGGDGGLGGAGGNGGDGGHGSDGGDGGDGGDPGAGGLGGLGGDSGNGTRAASGVDASDHGPGSGGNGGNGGNGAQASVAGGAGGNGGDGGNAGRVGDGGAGGNGGDGAAGANGANSGAPGSDALALGQPGGNGGQGDAGQAGGAGGAGGAGGSVSGDGGAGGNGGAGGNGGVGASGGAGARGANGIDSIGGTGGAGGGGGDGGAGGVGGHGGDGGVGGAAPSGTVGSHGTGGVGGDGGLGGAGGVGGAGGNGGIGITVGGAGGAGGNGGDPGAGGRGGLGGDSGNGTSAANGVDASKHGPLTGGDGGVGGNGAKAAAAGGDGGQGGDGGNAGLFGDGGAGGDGADGTAAEALGGDGGAGGAGGKGGDAGDIGDGGDGGKGGDGAHGALGGLTVAGGNGGAGGAGGAGGAGGAFLGDGGNGGAGGQGGAGRGGSPGGGGGVGGHGGAGGDAGMNGGGGTGGQGGNGAAGGAGWSPDSDLKGFDGFDGGSGGAGGDGGAGGAGGTQTGDGGDGGAGGLGGAGGVGGNGVDGFDINETTGRDGDGGDGGYGGWGGAGGNGGAGGSAPAGEVGNRGVGGDGGDGGSGGDAGNGGLGGDGFTYLADFDGEPGGDGGDGGDGGWGRPGGQGGFGSTSGAHGKAGFGAPGGDGGDGGNGGHGGDGNGSFADAGDGGPGGNGGNGGLGGAGRDGGAPGGDGGDGGTGGSGGFGAPPPRSIGGGDGGDGGRGGDGGRGAGGLTSGGVGSSGESGGSGNGRGDPGSGGSGGEGGEGGPSISVNVT

SEQ ID NO: 20420 - protein, 386 aa, Mycobacterium bovis AF2122/97
MGSATKYQRTLFEPEHELFRESYRAFLDRHVAAYHDEWEKTKIVDRGVWLEAGKQGFLGMAVPEEYGGGGNADFRYNTVITEETCAGRYSGIGFGLHNDIVAPYLLALATEEQKRRWFPNFCTGELTTAIAMTEPGTGSDLQGITTRAVKHGDHYVLNGSKTFITNGINSDLVIVVAQTDPEKGAQGFSLLVVERGMAGFERGRQLDKIGLDAQDTAELSFTDVAVPAENLLGQEGMGFIYLMQNLPQERISIAIMAAAGMESVLEQTLQYAKERKAFGRSIGSFQNSRFLLAELATEATVVRIMVDEFIKLHLAGKLTAEQAAMAKWYATEKQVYLNDRCLQLHGGYGYMREYPVARAYLDSRVQTIYGGTTEIMKEIIGRGLGV

SEQ ID NO: 20421 - protein, 504 aa, Mycobacterium bovis AF2122/97
MACLEVSDVICDRGTGVLTAAAMDLASIGSTVSAASAAASAPTVAILAAGADEVSIAVAALFGMHGQAYQALSVQASAFHQQFVQALTAGAYSYASAEAAAVTPLQQLVDVINAPFRSALGRPLIGNGANGKPGTGQDGGAGGLLYGSGGNGGSGLAGSGQKGGNGGAAGLFGNGGAGGAGASNQAGNGGAGGNGGAGGLIWGTAGTGGNGGFTTFLDAAGGAGGAGGAGGLFGAGGAGGVGGAALGGGAQAAGGNGGAGGVGGLFGAGGAGGAGGFGDTGGTGGDGGSGGLFGVGGAGGHGGFGSAAGGDGGAGGAGGTVFGSGGAGGAGGVATVAGHGGHGGNAGLLYGTGGAGGAGGFGGFGGDGGDDGIGGLVGSGGAGGSGGTGTLSGGRGGAGGNAGTFYGSGGAGGAGGESDNGDGGNGGVGGKAGLVGEGGNGGDGGATIAGKGGSGGNGGNAWLTGQGGNGGNAAFGKAGTGSVGVGGAGGLLEGQNGENGLLPS

SEQ ID NO: 20422 - protein, 245 aa, Mycobacterium bovis AF2122/97
MRVGVLGAKGKVGATMVRAVAAADDLTLSAELDAGDPLSLLTDGNTEVVIDFTHPDVVMGNLEFLIDNGIHAVVGTTGFTAERFQQVESWLVAKPNTSVLIAPNFAIGAVLSMHFAKQAARFFDSAEVIELHHPHKAEAPSGTAARTAKLIAEARKGLPPNPDATSTSLPGARGADVDGIPVHAVRLAGLVAHQEVLFGTEGEILTIRHDSLDRTSFVPGVLLAVRRIAERPGLTVGLEPLLDLH

SEQ ID NO: 20423 - protein, 492 aa, Mycobacterium bovis AF2122/97
MATIHPPAYLLDQAKRRFTPSFNNFPGMSLVEHMLLNTKFPEKKLAEPPPGSGLKPVVGDAGLPILGHMIEMLRGGPDYLMFLYKTKGPVVFGDSAVLPGVAALGPDAAQVIYSNRNKDYSQQGWVPVIGPFFHRGLMLLDFEEHMFHRRIMQEAFVRSRLAGYLEQMDRVVSRVVADDWVVNDARFLVYPAMKALTLDIASMVFMGHEPGTDHELVTKVNKAFTITTRAGNAVIRTSVPPFTWWRGLRARELLENYFTARVKERREASGNDLLTVLCQTEDDDGNRFSDADIVNHMIFLMMAAHDTSTSTATTMAYQLAAHPEWQQRCRDESDRHGDGPLDIESLEQLESLDLVMNESIRLVTPVQWAMRQTVRDTELLGYYLPKGTNVIAYPGMNHRLPEIWTDPLTFDPERFTEPRNEHKRHRYAFTPFGGGVHKCIGMVFGQLEIKTILHRLLRRYRLELSRPDYQPRWDYSAMPIPMDGMPIVLRPR

SEQ ID NO: 20424 - protein, 471 aa, Mycobacterium bovis AF2122/97
MVTRIVILGGGPAGYEAALVAATSHPETAQVTVIDCDGIGGAAVLDDCVPSKTFIASTGLRTELRRAPHLGFHIDFDDAKISLPQIHARVKTLAAAQSADITAQLLSMGVQVIAGRGELIDSTPGLARHRIKATAADGSTSEHEADVVLVATGASPRILPSAQPDGERILTWRQLYDLDALPDHLIVVGSGVTGAEFVDAYTELGVPVTVVASQDHVLPYEDADAALVLEESFAERGVRLFKNARAASVTRTGAGVLVTMTDGRTVEGSHALMTIGSVPNTSGLGLERVGIQLGRGNYLTVDRVSRTSATGIYAAGDCTGLLPLASVAAMQGRIAMYHALGEGVSPIRLRTVAATVFTRPEIAAVGVPQSVIDAGSVAARTIMLPLRTNARAKMSEMRHGFVKIFCRRSTGVVIGGVVVAPIASELILPIAVAVQNRITVNELAQTLAVYPSLSGSITEAARRLMAHDDLD

SEQ ID NO: 20425 - protein, 438 aa, Mycobacterium bovis AF2122/97
MHFARHGAGIQHPVIVRGDGVTIFDDRGKSYLDALSGLFVVQVGYGRAELAEAAARQAGTLGYFPLWGYATPPAIELAERLARYAPGDLNRVFFTSGGTEAVETAWKVAKQYFKLTGKPGKHKVISRSIAYHGTTQGALAITGLPLFKAPFEPLTPGGFRVPNTNFYRAPLHTDLKEFGRWAADRIAEAIEFEGPDTVAAVFLEPVQNAGGCIPAPPGYFERVREICDRYDVLLVSDEVICAFGRIGSMFACEDLGYVPDMITCAKGLTSGYSPLGAMIASDRLFEPFNDGETMFAHGYTFGGHPVSAAVGLANLDIFEREGLSDHVKRNSPALRATLEKLYDLPIVGDIRGEGYFFGIELVKDQATKQTFTDDERARLLGQVSAALFEAGLYCRTDDRGDPVVQVAPPLISGQPEFDTIETILRSVLTDTGRKYLHL

SEQ ID NO: 20426 - protein, 502 aa, Mycobacterium bovis AF2122/97
MTTLWQPHRNDYSPIPGRGVHARRGARRPRPRGGRAERPGTGQLTRSGRRALLVGLTAASVGVLYGYDLSAIAGALLSLSEEFELTTREQELLTTTAVLGQIAGALGGGILANAIGRKKSVVLIVAGYAVFALLGATSVSVPMLVVARLLLGVTIGLSVVVVPVYVAESAPAAVRGSLVTAYQLATLSGIVVGYLVGYLLAGSHGWRAMFGLAAAPATLLLPLLWRMPDTARWYLLKGRIADARSALRRIQPEADIDAELADMAAAVDERGGGIGEMVRRPYLRATLFVIALGFLVQITGINAIIYYSPRLFAAMGFAGYFAMLALPAMVQVAGLAAVCASLFLVDRLGRRPILLSGIATMITADAVLITVFANDSDGGTGLVLGFAGVLLFIIGFNFGFGSLVWVYAAESFPSRLRSMGSSLMLTSTLTANAIVAAFSLTMLRVLGGAGVFAVFGTFAVVAFVVVYRFAPETKGRKLEEIRHFWENGGRWPAERSPAADEP

SEQ ID NO: 20427 - protein, 473 aa, Mycobacterium bovis AF2122/97
MRHYYSVDTIRAAEAPLLASLPDGALMRRAAFGLATEIGRELTARTGGVVGRRVCAVVGSGDNGGDALWAATFLRRRGAAADAVLLNPDRTHRKALAAFTKSGGRLVESVSAATDLVIDGVVGISGSGPLRPAAAQVFAAVQAAAIPVVAVDIPSGIDVATGAITGPAVHAALTVTFGGLKPVHALADCGRVVLVDIGLDLAHTDVLGFEATDVAARWPVPGPRDDKYTQGVTGVLAGSSTYPGAAVLCTGAAVAATSGMVRYAGTAHAEVLAHWPEVIASPTPAAAGRVQAWVVGPGLGTDEAGAAALWFALDTDLPVLVDADGLTMLADHPDLVAGRNAPTVLTPHAGEFARLAGAPPGDDRVGACRQLADALGATVLLKGNVTVIADPGGPVYLNPAGQSWAATAGSGDVLSGMIGALLASGLPSGEAAAAAAFVHARAAAAAAADPGPGDAPTSASRISGHIRAALAAL

SEQ ID NO: 20428 - protein, 1360 aa, Mycobacterium bovis AF2122/97
MSFVLVSPETVAAVATDLKRIGASLAHENASAAASTTAVVSAAADEVSTAVAALFSQHAQGYQAAAAQVAAFHSRFVQALTAGAGAYAFAEAANASPLQSAMGAVSASAQTLLSRPLIGNGANATTPGGNGGDGGWLFGSGGNGAPGAAGQSGGNGGSAGLWGNGGAGGAGGSGGAAGGNGGNGGWLFGAGGTGGIGGTGAPGAMGGTGGNGGNGALLIGGGGLGGAGGMGGTGGGTGGTGGNGGNGALLIGAGGVGGAGGIGGQGTGAGGAAGAGGTGGNGGAGGLFMNGGDGGAGGQGGDGAAGDAAASAGGTGGKGGQGGDGGTGGAGGAGPVLFGHGGAGGMGGQGGTGGMGGAGGDGTTVIAAGTGGEGGTGGTGGTGGNGADAAAVVGFGANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGGAGGSGGDGGKGGQGGSGGTGGSGAPIGGGAGGTGGSGGHAGKGGAGGIGAQGTTITVPGNGGNAGDGGNGGGGGAGGTGGDGATGTPAGNGGNGGNAGDGGNGGSGDFGGNTTSGASGSGGNGGNAGTAGSGGAGGTGGTGLSGGNGGNGGDGGNGAHGTVGAQFVPATSLPTPNGGAGGNGGTGSNGGAPGPAGAPGPTTGGNAGSQGIGGDGGNGGDGGKGGDGADAVNVVFMPTEPQAATGTAGSAGDPTGGNGGPGTPGSPMVAPPPPTPITQVQQGGDGGAGGTGSTNANDGTATGGKGGEGGVGSILGGPGGNGGTGGNASATGTNGVANAGNGGKGGDGGQFGAGGNGGAGGSVTDGSAGSTAGNGGNGGNATNGTIAGQPAGGNGSAGGKGGDGGNIAAGATGTAGNGGNGGNGNDGAVNAGTGGSGGNGGNAGGGGANGGDGGAGGAGGAGGRGGKGIDGGFGGDGGNGGSNNGTGAGGNGGNGGTGGVGSVGAAGGDGGNGGTGGFAGFGGTAGNGGSGGTGGAGGDGGTGGGGGNGGTGVIAGGGGTGGNGGASGAGGAGGTGGFAGNGNAGGNGGTGGASEDGDNGNAGSGATGGTGGNGGTGGDGGAAGLGGVA

SEQ ID NO: 20429 - protein, 1460 aa, Mycobacterium bovis AF2122/97
MSFVLIAPEFVTAAAGDLTNLGSSISAANASAASATTQVLAAGADEVSARIAALFGGFGLEYQAISAQVAAYHQRFVQALSTGAGAYASAEAAAAEQIVLGVINAPTQALLGRPLIGDGANATTPGGAGGAGGLLFGNGGAGAAGAPGQAGGPGGPAGLWGNGGPGGAGGSGGGTGGAGGAGGWLFGVGGAGGVGGAGGGTGGAGGPGGLIWGGGGAGGVGGAGGGTGGAGGRAELLFGAGGAGGAGGAGTDGGPGATGGTGGHGGVGGDGGWLAPGGAGGAGGQGGAGGAGSDGGALGGTGGTGGTGGAGGAGGRGALLLGAGGQGGLGGAGGQGGTGGAGGDGVLGGVGGTGGKGGVGGVAGLGGAGGAAGQLFSAGGAAGAVGVGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGVGADNPTGIGGAGGTGGAGGTGGTGGAAGAGGAGGAVGTGGTGGVVGDVGNAGIGGTGGKGGAGGTGFAGGAGGAGGQGGSSGAGGTNGSGGAGGTGGQGGAGGAGGAGADNPTGIGGAGGTGGTGGAAGAGGAGGAIGTGGTGGAVGSVGNAGIGGTGGTGGVGGAGGAGAAAAAGSSATGGAGFAGGAGGEGGAGGNSGVGGTNGSGGAGGAGGKGGTGGAGGSGADNPTGAGFAGGAGGTGGAAGAGGAGGATGTGGTGGVVGATGSAGIGGAGGRGGDGGDGASGLGLGLSGFDGGQGGQGGDGGSAGAGGINGAGGAGGDGGDGGDGATGAAGLGDNGGVGGDGGAGGAAGNGGNAGVGLTAKAGDGGAAGNGGNGGAGGAGGAGDNNFNGGQGGAGGQGGQGGLGGASTTSINANGGAGGNGGTGGKGGAGGAGTLGVGGSGGTGGDGGDAGAGGGGGFGGAAGKAGGGGNGGVGGDGGEGATGLGLDLSGFAGGQGGQGGAGGNAGAGGINGAGGTGGTGGAGGDGAPATLIGGPDGGDGGQGGIGGDGGNAGFGAGVPGDGGIGGTGGAGGAGGAGGAGDAGADGDPSIDGGQGGAGGHGGQGGKGGLNSTGLASAASGDGGNGGAGGAGGNGGDGDGFIGGSGGTGGTGGDAGAGGLANTGGTAGNAGIGGAGGRGGDGGAGDSGALSQDGNGFAGGQGGQGGAGGNAGAGGINGAGGTGGTGGAGGDGAPATLIGGPDGGDGGQGGGAGFGSGVAGAAGAGGNGGKGGDGGTGGTGGTNFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDGS

SEQ ID NO: 20430 - protein, 1938 aa, Mycobacterium bovis AF2122/97
MSFVLISPEVVSAAAGDLANVGSTISAANKAAAAATTQVLAAGADEVSARIAALFGMYGLEYQAISAQVAAYHQQFVQTLRTGAASYMLAEATNVEQNLLNLINAPTQTLLGRPLIGDGANATTPGGAGGDGGLLFGSGGNGAPGAPGQAGGAGGSAGLLGNGGSGGAGGTGAPGGNGGNAGWLYGRGGVGGAGGIGGGTGGAGGHAWLFGHGGTGGIGGGPGGNGGWLLGNGGHGGAGGIGGGSGGAGGNGGWLLGNGGIGGAGGTGGGAGGTGGNAAWLLGGGGTGGAGGIGGGNGGHGGNGGWLLGNGGNGGLGGDGDGGTGGGHGGNGGNPGWLLGTAGGGGNGGAGSTGTAGGGSGGTGGDGGTGGRGGLLMGAGAGGHGGTGGAGGAGVDGGGAGGAGGAGGNGGAGGQAALLFGRGGTGGAGGYGGDGGGGGDGFDGTMAGLGGTGGSGGTGGDGGAPGNGGAGGAGQLLSHSGVAGASGKGGAGGTGGNGGAGSAGADAPAGSGAMGSTGFAGGAGGDGGNGGGSGASQGNGGNGGNGGTGGKGGTGGAGMNSLDPLLAAQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGAGMNSLDPLLAAQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGAGMNSLDPLLAAQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGDGALAGSSGGAGGKGGNGGDAGKAGTGSAPGTAGTGGDGGKGGNGGIGAAGTTGPVGTGASGGTGGSGGAGGTGGDGGAANGGTAGAGGAGGNGGKGGDGGAGVTSSTAGNSGGAGGSGGKGGDAGAGGAGATPGANGIAGNGGDGGDGAAGAVGISGATGAGDGGHGGTGGAGGNGGTGGAGGSGIDGVGGGTGGTGGNGGNGAIGGAGGDAGGSGNSGGNGGTGGKGGNAGAGGAAGSNGGTVGANGTGGDGGNGGAAGAATAGSNGGAGTGSAGGNGGTGGRGGSGGAGGDGIGGVGGGKGGNGADGEVGGAGGAGGSGPNTSPGGNGGQGGQGGSGGAGGAAGAGGAGGGANGTAGNGGQGGAGGTGGAGAASSATNGGSGGAGGTGGAGGTGGAGGDGVGGAGGGNGGHGGDAGDGGNGANGNNRSSGSFLAAGGTGGAAGDGGQGGQGGAGGGAGGQGGAGGAGGTGGNGGNITGGTAGTAGAAGNGGAAGKGGAGGQGGTGGGTGGQGGAGGDGGAGGTGGDRTVGGGTVPAGSGGQGGNAGGGGAGGQGGADGGSGGDGGDAGTGGNGGNGGNRNSGNGTGGAGGNGGGGANGGAGGAGGSGGGTGGNGGAGGDAGDAGNGGNGNGTGNGGNGGNGGIAGMGGNGGAGTGSGNGGNGGSGGNGGNAGMGGNSGTGSGDGGAGGNGGAAGTGGTGGDGGLTGTGGTGGSGGTGGDGGNGGNGGNGADNTANMTAQAGGDGGNGGDGGFGGGAGAGGGGLTAGANGTGGQGGAGGDGGNGAIGGHGPLTDDPGGNGGTGGNGGTGGTGGAGIGSLGGGTGGDGGNGGTGGNGGTGGEGGEVGGAGGTGGAAGNGGDGGTGGTGGGDGGAGGTGGTGGTGGLGDPRVGGSGGDGGTGGSGGAAGNGGNGGNAGAGGNGNGGTGGAGGIGGTGGNGGDAEPGVPPGAGGAGGAGTTGGKGGTGGNGSGTGSGGTGGDGGTGGGGGNGGTGWNGGKGDTGSGGGAGDGGKAPAGGTGGAGGDGGAGGKGGSGGV

SEQ ID NO: 20431 - protein, 476 aa, Mycobacterium bovis AF2122/97
MVLRSLASPAALTDPKRCASVVGVAAFAVRREHAPDALGGPPGLPAPRGFRAAFAAAYAVAYLAGGERRMLRLIRRYGPIMTMPILSLGDVAIVSDSALAKEVFTAPTDVLLGGEGVGPAAAIYGSGSMFVQEEPQHLRRRKLLTPPLHGAALDRYVPIIENSTRAAMHTWPVDRPFAMLTVARSLMLDVIVKVIFGVDDPEEVRRLGRPFERLLNLGVSEQLTVRYALRRLGALRVWPARARANTEIDDVVMALIAQRRADPRLGERHDVLSLLVSARGESGEQLSDSEIRDDLITLVLAGHETTATTLAWAFDLLLHHPDALRRVRAEAVGGGEAFTTAVINETLRVRPPAPLTARVAAQPLTIGGYRVEAGTRIVVHIIAINRSAEVYEHPHEFRPERFLGTRPQTYAWVPFGGGVKRCLGANFSMRELITVLHVLLREGEFTAVDDEPERIVRRSIMLVPRRGTRVRFRPAR

SEQ ID NO: 20432 - protein, 328 aa, Mycobacterium bovis AF2122/97
MTIMRAVVAESSDRLVWQEVPDVSAGPGEVLIKVAASGVNRADVLQAAGKYPPPPGVSDIIGLEVSGIVAAVGPGVTEWSAGQEVCALLAGGGYAEYVAVPADQVLPIPPSVNLVDSAALPEVACTVWSNLVMTAHLRPGQLVLIHGGASGIGSHAIQVARALAARVAITAGSPEKLELCRDLGAQITINYRDEDFVARLKQETDGSGADIILDIMGASYLDRNIDALATDGQLIVIGMQGGVKAELNLGKLLTKRARVIGTTLRARPVSGPHGKAAIAQAVAASVWPMIAANRVRPVIGTRLPIQQAAQAHELMLSGKTFGKILLTV

SEQ ID NO: 20433 - protein, 488 aa, Mycobacterium bovis AF2122/97
MADPGGFLKYTHRKLPKRRPVPLRLRDWREVYEEFDNESLRQQATRCMDCGIPFCHNGCPLGNLIPEWNDLVRRGRWRDAIERLHATNNFPDFTGRLCPAPCEPACVLGINQDPVTIKQIELEIIDKAFDEGWVQPRPPRKLTGQTVAVVGSGPAGLAAAQQLTRAGHTVTVFEREDRIGGLLRYGIPEFKMEKRHLDRRLDQMRSEGTEFRPGVNVGVDISAEKLRADFDAVVLAGGATAWRELPIPGRELEGVHQAMEFLPWANRVQEGDDVLDEDGQPPITAKGKKVVIIGGGDTGADCLGTVHRQGAIAVHQFEIMPRPPDARAESTPWPTYPLMYRVSAAHEEGGERVFSVNTEAFVGTDGRVSALRAHEVTMLDGKFVKVEGSDFELEADLVLLAMGFVGPERAGLLTDLGVKFTEHGNVARGDDFDTSVPGVFVAGDMGRGQSLIVWAIAEGRAAAAAVDRYLMGSSALPAPVKPTAAPLQ

SEQ ID NO: 20434 - protein, 470 aa, Synechococcus sp. PCC 7002
MQTKSAGFNAGVQDYRLTYYTPDYTPKDTDLLACFRMTPQPGVPPEECAAAVAAESSTGTWTTVWTDGLTDLDRYKGRCYNVEPVPGEDNQYFCFVAYPLDLFEEGSVTNVLTSLVGNVFGFKALRALRLEDIRFPVALIKTYQGPPHGITVERDLLNKYGRPLLGCTIKPKLGLSAKNYGRAVYECLRGGLDFTKDDENINSQPFMRWRDRFLFVQEAIEKSQAETNEVKGHYLNVTAGTCEEMLKRAEFAKEIGTPIIMHDFLTGGFTANTTLAKWCRDNGVLLHIHRAMHAVIDRQKNHGIHFRVLAKCLRLSGGDHLHSGTVVGKLEGDRAATLGFVDLMREDYVEEDRSRGVFFTQDYASLPGTMPVASGGIHVWHMPALVEIFGDDSCLQFGGGTLGHPWGNAPGATANRVALEACVQARNEGRSLAREGNDVLREAGKWSPELAAALDLWKEIKFEFDTVDTL

SEQ ID NO: 20435 - protein, 499 aa, Escherichia coli
MSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFFSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETAS

SEQ ID NO: 20436 - protein, 115 aa, Cicer arietinum
GYTKGDGLGAEIVGTFILVYTVFSATDAKRSARDSHVPILAPLPIGFAVFLVHLATIPITGTGINPARSLGAAIIFNKDLGWDDHWIFWVGPFIGAALAALYHQVVIRAIPFKSK

SEQ ID NO: 20437 - protein, 410 aa, Ralstonia sp. JS705
MATHVAIIGNGVAGVTTAQALRAEGFEGRISLIGSEPHLPYDRPSLSKAVLDGSLERPPVLAEADWYGEANIDMLTGPQVTAINAETRTISLDDGTTLSADAIVIATGSRARTLALPGSQLGGVVTLRTYDDVQSLRDSWTPATRLLIAGGGLIGCEVATTARKLGLPVTILEAGDELLVRVLGRRIGAWLRGRLTELGVQVELGAGVAGFSGEGRLEQVLASDGRFFAADSALICIGAEPADQLARQAGLACDRGVIVDHCGATLAEGVFAVGDAASWPLRAGGRRSLETYMNAQRQAAAVAAAILGKAVSAPQLPVSWTEIAGHRMQMAGDIEGPGEFLLRGTLGSGAALLFRLQEGKLQAVVAVDAPRDFALATRLVEAHAAVEPARLADISNSMRDLVRAHSGDTA

SEQ ID NO: 20438 - protein, 321 aa, Schizosaccharomyces pombe
MGSLEVPCIDLSENDTSIVVKELLDACKNWGFVSLKNHGIPLDEIDRTFKLADKFFDIPVEEKQKYLFKGGRLHSGYTGHFGEKLDMEHQSRGDLKESYDLAGFPDPKLENLCPFIAEHMDEFLQFQRHCYKLTLRLLDFFAIGFGIPPDFFSKSHSSEEDVLRLLKYSIPEGVERREDDEDAGAHSDYGSITLLFQRDAAGLEIRPPNFVKDMDWIKVNVQPDVVLVNIADMLQFWTSGKLRSTVHRVRIDPGVKTRQTIAYFVTPDPETPLSPLFEEKTGKDIETVTAGEWIDGRINFTYGYSAPPKGYLGSQNDGIVA

SEQ ID NO: 20439 - protein, 512 aa, Schizosaccharomyces pombe
MSFTTLYSAIQGDASARALVAPSLNAELSFSELRIAIMDLQRQIASLGIKVGDPVNIAIPNGLEFVVAFYAVSWQRAICGPLNSNYKQSEFEFYIDDLKSKLVIVPEGSVAANTPAVRAAKKLSVAVAELAWCPKSRLVRIVHFEGAKINAPQPLGLPQPDDVMLVLHTSGTTGRPKVVPLTHKNLCRSIHNITTSYRLDPRDTSYVVMPLFHVHGLLCGLLSTLASGGCAVVPPKFSAHSFWKEFIQYGATWYTAVPTIHQILLRTPPPKPLPRIRFIRSCSSPLAPPVLSKLEATFRAPVLEAYAMTEASHQMTTNPLPPLVHKPHSVGKPFGVELKILDQKGNEMPQGKEGEICVRGINVTKGYLNNPAANKSSFTKDRFFRTGDEGKLDKDGYVFITGRIKELVNRGGEKISPAEIDAVLMQHPDVSEAVCFAVPDEKYGQDIQAAINPVAGKTVTPKQLHDYLEQKVAAFKIPKKFYFTDRIPKTATGKVQRRLVCDAFFNHSKAKL

SEQ ID NO: 20440 - protein, 414 aa, Schizosaccharomyces pombe
MSLSTKLAITDVDLKGKNVLIRVDFNVPLDGDRITNNARIVGALPTIKYALEQQPKAVILMSHLGRPNGARVAKYSLKPVAAELSKLLGKPVKFLDDCVGPEVEKACKEAKGGEVILLENLRFHIEEEGSAKVDGKKVKADASAVEAFRKSLTSLGDIFVNDAFGTAHRAHSSMVGVDLPRVSGFLMKKELDYFSKALENPARPFLAILGGAKVADKIQLIDNLLDKVNRLIICGGMAFTFLKVLNGMKIGDSLFDEAGSKNVESMMAKAKKNNVEVFLPVDFVTADKFDKDAKVGSATAEEGIPDGWMGLDCGPKSSAKFAEVITTSKTIVWNGPAGVFEFDNFAKGTKSMLDACVKTCEAGNVVIVGGGDTATVAKKYGKEDALSHVSTGGGASLELLEGKALPGVVALSSK

SEQ ID NO: 20441 - protein, 227 aa, Lentinula edodes
MPTIIDKLSDALHLHSHQSTFDSKVTVIFVLGGPGAGKGTQCARLVEDFSFSHLSAGDLLRAEQHREGSEYGQLIQTCIKEGSIVPMEVTVKLLENAMTATLAERRSGEGWTDGQGRFLIDGFPRKMDQAEKFEHDVGKATAVLFFSTTQEVMLDRLLERGKTSGREDDNVESIKKRFNTYKEQTMPVIEHYEKLGKVIEIDSSVSIEEVHQKTRSAVAKLLSGSTA

SEQ ID NO: 20442 - protein, 356 aa, Atriplex nummularia
MAAPVCCLPNDDLASRLVQKIAQTVEDEIPEQFLHKDGFPEAKDVPELWTRSLLIDFSLLSSGDQDEIVKFRSALSNWGCFLVKNHGIEGSFLEEVIEVSRKFFSLPFEEKMKYYTDDIFQGYDTDAVCQGLDQQKMNWNDRLFLTMYPKSKGNLKAWPQNPSNFSEIVDEYSKELINLTKGLYKAAAKSLNVREDSFCLEKEGVILSRFTLYPKCPRPKNVLGSKPHLDGSVFTIVLADQEGLEVQKDGQWFKVPVIPGALFVNFGDFGEVLTNGIYKSTMHRVATHSAKDRLSVTAFCTMDATQELTPLTELVTANRPPLYKKFKVYEYKEGVCCKCGPGENAIDAIKLDFPIL

SEQ ID NO: 20443 - protein, 42 aa, Leavenworthia stylosa
CSAVGVLPLSLQYGFSVVEKFLKGPSSIDQHFKSTSLEENIP

SEQ ID NO: 20444 - protein, 43 aa, Leavenworthia stylosa
CSAVGVLPLSLQYGFSVVEKFLKGASSIDQHFKSTSLEENIPV

SEQ ID NO: 20445 - protein, 42 aa, Leavenworthia stylosa
CSAVGVLPLSLQYGFSVVEKFLKGASSIDQHFKSTSLEENIP

SEQ ID NO: 20446 - protein, 42 aa, Leavenworthia uniflora
CSPVGVLPLSLQYGFSVVEKFLKGASSIDQHFKSTSLEENIP

SEQ ID NO: 20447 - protein, 337 aa, Petroselinum crispum
MEVERVQAISKMSRCMDTIPSEYIRSESEQPAVTTMQGVVLQVPVIDLGSSNNTEENLVELIAEASREWGIFQVVNHGIPDDAIAKLQKVGKEFFELPQQEKEVIAKPEGYQGVEGYGTKLQKELGGKKGWVDHLFHIIWPKSAVNYNFWPNNPPLYREANEEYAVALRGVVDKLFEALSLGIGLEKHELKKASGGDDLIYMLKINYYPPCPRPDLALGVVAHTDMSAITILVPNEVQGLQVHKDDHWYDVKYIPNALIIHIGDQIEIMSNGKYKSVYHRTTVNKDKTRMSWPVFLEPPPELLTGPISKLITDENPAKFKTKKYKDYVYCKLNKLPQ

SEQ ID NO: 20448 - protein, 367 aa, Arabidopsis thaliana
MRGAAPTGVVSVMVLMILVLLKQIESASANGSSLGLPPRKFCNIYQGSWVYDKSYPLYDSKNCPFIERQFNCKSNGRPDSEYLKYRWQPSGCNLPRFNGLDFLGRIMKGKKLMFVGDSLSLNQWQSLTCLLHNAAPKANSTSTRSPSGLSVFSFPAYNSSIMFSRNAFLVDIVGAPPKRVMKLDSISSGSLWKTADVLVFNSWHWWLHTDRKQPWDAIMSGNVTVKDMDRLVAYEKAMMTWAKWIDQNIDPSKTKVFFQGISPDHGRAREWSKQGGKGSCIGETKPIMGSSYLAGPHAAEMVVAKVIKTMKNQARLMDVTLMSQLRKDGHPSVYGFGGHRMADCSHWCLSGVPDSWNQLLYSELFHS

SEQ ID NO: 20449 - protein, 198 aa, Oryza sativa
MENQFQDGKEEVIEAWYMDDSEEDQRLPHHREPKEFIPLSKLSELGILSWRLNADDWENDENLKKIREARGYSYMDICDVCPEKLPNYEAKLKNFFEEHLHTDEEIRYCLEGSGYFDVRDQNDQWIRVAVKKGGMIVLPAGMYHRFTLDSDNYIKAMRLFVGEPVWTPYNRPHDHLPARKEYVEKIINRGGTQAVEAR

SEQ ID NO: 20450 - protein, 116 aa, Prunus persica
MGLAENQNGHRIKKYRGMGSLEAMTKGSDQRYLGDTAKLKIAQGVVGAVADKGSVLKFIPYTIQAVKQGFQDLGASSLQSGHDLLRTSVLRLEVRTGAAQAEGGVHGLVSYEKKSF

SEQ ID NO: 20451 - protein, 228 aa, Haemophilus somnus 2336
MLKIKKRSAIALIASAVVSQSVFADKQFNDDVSYALGYFMGKYLTVMGEEHKDVASYNYEKIVAGIKDVVENKSTLTDEKAQETLQELENKARHAKMAKIKAENEKFTAEFAKKSNVKKTESGLLYRIEKMGEGKSIKPTDRVKVHYTGKLANGKVFDSSRERGQPAEFKLNQVILGWTEGLQFIKKGGKIELVIPADLAYGERGAGLIPPSSTLYFDIEILDVTSEK

SEQ ID NO: 20452 - protein, 192 aa, Haemophilus somnus 2336
MIDFDGYRPNVGIVICNAERQVLWAKRYGQNSWQFPQGGINDNETAEQAMYRELYEEAGLTPKDVEILYVSKHWLRYKLPKRLLRHDNRPICIGQKQRWFLLQLVSDEKRINMQHTKSPEFDGWRWVSFWYPVRQVVTFKKDVYRKVMKEFALFLFDTNLKSRLSVPEEKKMFSSVKKKLIHKKNHKYSSNQ

SEQ ID NO: 20453 - protein, 255 aa, Haemophilus somnus 2336
MARRPLVMGNWKLNGSKAFTKELITGLKDELNAVSGCDVAIAPPVMYLAEAEAALVSSDIALGTQNVDLNKQGAFTGDISTEMLKDFGVKYVIIGHSERRQYHHESDEFIAKKFGVLKDAGLVPVLCIGESEAENEAGKTEEVCARQIDAVMNTLGVEAFNGAVIAYEPIWAIGTGKSATPAQAQAVHAFIRGHIAKQSQAVAERVIIQYGGSINDANAAELFTQPDIDGALVGGASLKASAFAVIVKAAAKAKN

SEQ ID NO: 20454 - protein, 404 aa, Haemophilus somnus 2336
MRVFPKSDKLEHVCYDIRGPVHQEALRLEEEGKKILKLNIGNPAPFGFEAPDEILVDILRNLPAAQGYCDSKGLYSARKAIVQYYQSKNILSATVNDVYIGNGVSELITMSLQALLNDGDEVLIPMPDYPLWTAAATLAGGKAVHYLCDEQADWFPDVADIKSKVTSRTKAIVIINPNNPTGAVYSKELLLDIVEVARQNGLMIFADEIYDKILYDNAVHHHIAALAPDLLTVTFNGLSKSYRVAGFRQGWMILNGPKQQAKGYIEGLDMLASMRLCANHPMQHAIQTALGGYQSINEFILPGGRLLEQRNKAYELINQIPGLSCTKPMGALYMFPKIDTKKFNIYDDEKMVLDLLRQEKVLLVHGRGFNWQQPDHFRIVTLPYVNQIEDALGRLAKFLTHYRQ

SEQ ID NO: 20455 - protein, 316 aa, Haemophilus somnus 2336
MTIYADNSYSIGNTPLVRLKNFGNNGNIIAKIEGRNPSFSVKCRIGANMVWQAEKDGILTKDKEIIDATSGNTGIALAYVAAARGYKITLTMPETMSSERKRLLRGLGVNLVLTEGVNGMKGAIAKAEEIVASNPNHYVMLKQFENPANPAIHQQTTGPEIWSGTEGKIDVLVAGVGTGGTISGISRYIKQDQGKKIITVAVEPEESPVITQTLAGEETKPGPHKIQGIGAGFIPKNLDLSLVDQIEKVSSETAIITARRLMAEEGILGGISSGAALAVADRIAQRPEFSDKLIVVILPSASERYLSTALFDGFEG

SEQ ID NO: 20456 - protein, 479 aa, Haemophilus somnus 2336
MSRRLRRTKIVCTLGPSTDRGNNLEKIIVAGANVVRMNFSHGTPEDHLARAEKVREIAKKLGKTVAILGDLQGPKIRVSTFKEGKIFLNIGDNFTLDADLPKGEGNQEAVGLDYKTLPQDVVPGDILLLDDGRVQLKVLSTDNTKVFTEVIVGGPLSNNKGINKLGGGLSANALTEKDKEDIILAARIGVDYLAVSFPRSSADLNYARELAQQAGLKAKIVAKVERAETVIDDEAMDDIILASDVIMVARGDLGVEIGDPELVGIQKKLIRRSRQLNRVVITATQMMESMISNPMPTRAEVMDVANAVLDGTDAVMLSAETAAGQYPSETVSAMAKVCLGAEKMPSVNISRHRLDKEFDTIEETIAMSTMFAANHMKGVAAIIAMTSSGHTAKLMSRISSGLPIFALSRNESTLNLCALYRGVIPIHFDQDSRTLEGLKAAIQSLKDKGYLVSGDLVLLTQGDHLTSNGTTTCRALVVE

SEQ ID NO: 20457 - protein, 400 aa, Haemophilus somnus 2336
MDISMSNTTSFTTSTIHAGRNKRVCKNAVNPVIQRASSLVFDTLADKKQATINRAKGGLFYGRRGTLTHFALQELMCELEGGEGCYLYPCGAAAVSNAILAFVKTGDHVLMSGAAYEPTQEFCHIILKKMSITTTFYDPLIGEKIADLVQPNTTVLFLEAPSSLTMEMPDIVSIVQAARQINPKIVVMIDNTWSAGVFFKALDFGIDISIQAGTKYLIGHSDAMIGTAVANARCWEQLRENSYLMGQMVDADTAYMTARGIRTLLVRLKQHQENGIKVAKWLLEQPEVKTVYHPALPSCPGHQYFKRYFTGSSGLFSFELNKKLSQQALENFMDHFKIFTMAYSWGGFESLILCNQPEEIARIRPNIERKLTGTLIRLHIGLEDVDDLIADLKAGFERLK

SEQ ID NO: 20458 - protein, 433 aa, Haemophilus somnus 2336
MAKIVKVIGREIIDSRGNPTVEAEVHLEGGFVGLAAAPSGASTGSREALELRDGDKARFLGKGVLKAVSAVNNEIATALVGKEASNQAEIDQIMIELDGTENKSKFGANAILAVSLANAKAAAASKGMPLYAWIAELNGTPGVYSMPLPMMNIINGGEHADNNVDIQEFMIQPVGAKTLKEALRIGAEVFHNLAKVLKGKGLSTAVGDEGGFAPNLESNAAALACIKEAVEKAGYVLGKDVTLAMDCASSEFYNKENGMYEMKGEGKSFTSQEFTHYLEGLCKEYPIVSIEDGQDESDWDGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGEKAPFLGLKAVKGQA

SEQ ID NO: 20459 - protein, 264 aa, Haemophilus somnus 2336
MTRPLIEVRNLTFKRGNRIIYDNLNLQVQQGKITAIMGPSGIGKTTLLKLIGGQLQPEKGEILFDEQDICKMSNSELYRVRQRIGMLFQSGALFTDLSTFDNVAFPIREHTHLPEKLIRQIVLMKLEAVGLRGAANLMPSELSGGMARRAALARTIALDPELIMYDEPFAGQDPISMGVIISLIKRLNEALRLTSIVVSHDVQEVLSIADYAYIIADKRVIAEGSAEQLLQSRDPQVVQFIQGKEDGPVHFHFPAQDYVQELFS

SEQ ID NO: 20460 - protein, 369 aa, Haemophilus somnus 2336
MTQQYALDTLLAQAGNRTDERTGAVSTPIFLSTAYAHHGIGESTGFDYTRTKNPTRTVLEETIAKLEGGDRGFACSSGMAAIQLLMNLFASPDEWIVSSDVYGGTYRLLDFAHKNIHGVKPVYVNTASSEEIEKAITENTKAIFVETPSNPLMEECDVAEIAKIAKKYNLLLIVDNTFLTPVLFRPMEHGADIVIHSGTKYIAGHNDTLVGLIVAKGQEICDRLYYIQNGAGPVLSPFDSWLTIRGMKTLALRMERHQKNAQELANFLREQPQVKDVLYPNKGGMLSFRLQNENWVNPFLKAMKLITFAESLGGTESFITYPATQTHMDIPEVERVARGVCNRLLRFSVGLENVEDIKADLLQAFSQLK

SEQ ID NO: 20461 - protein, 210 aa, Haemophilus somnus 2336
MTKQFFAQVALDDVSAQGSYGIGLQIGQQLVDSKLAVKAEAVAKGIYDALNQNPPALELNEVAKALQELQQQASEIAQAQFKQIEEEGKKYLEENAKKDSVKVTDSGLQYEVLVEGSGAIPTRQDQVRVHYTGTLIDGTVFDSSVKRGQPAEFPVSGVIAGWIEALSMMPLGSKWKLTIPHHLAYGERGAGASIPPFSTLVFEVELLDIL

SEQ ID NO: 20462 - protein, 314 aa, Haemophilus somnus 2336
MMQIVFLDSTAIPKHITIPRPSFEHQWIEYEYTDADQLIDRAKEADIVITSKVIFSREVMLQLPKLKLIAITATGTNNVDLIAAKELGITVKNVTGYSSVTVPEHVLGLIFALKHSLMNWYKDQLSAKWADCKQFCYFDYPITDVKGSTLGVIGKGCLGSEIGRLATALGMNVIYAERCGATEIRSGYLPFEQVLKQADIVTLHCPLTEQTQNLINAETLKLMKPTAYLINTGRGPLVDEQALVEALENKVIAAAAIDVLVKEPPEKENPLIQAATRLPNLIVTPHIAWASDSAVTTLVNKVAQNIEEFVKTGK

SEQ ID NO: 20463 - protein, 318 aa, Haemophilus somnus 2336
MMSKTLTVLGSINADHVISVPHFAKPGETLSGKQYHIAYGGKGANQAVAAARLADFSQGATVNFVGCIGSDDIGRAMKKAFAQDGINVATITEIPNEMTGIAMIQVADSGENSIVISAGANAYLTPEIVDKFATEIERADYLLMQLETPLNAILEAAKLAKKHGATVVLNPAPANQLPDELLSLLDMITPNETETEILTGVKVTDEQSAAKAASVLHQKGVATVLITLGSKGVYVSRKSSTQELGQNKVIAGFRVNAVDTTAAGDTFNGAFLTALLENKSLDEAIRFAHAAAAISVTRQGAQPSIPTRRETLDFLAQH

SEQ ID NO: 20464 - protein, 432 aa, Haemophilus somnus 2336
MTTSATLFYRAQQVIPGGVNSPVRAFKGVGGTPVFIEKANGAYIFDIEGKQYIDYVGSWGPMILGHNHPSILSAVLKIAENGLSFGTPTPLEIELAELICQLVPSIEMVRMVNSGTEATMSAIRLARGYTKRDKILKFEGCYHGHSDSLLVKAGSGSLTLGQPSSPGVPEDFAKHTITCEYNNLQSVKNAFEQYPDQIACVIVEPVAGNMNCILPKQDFLQGLRQLCNEYGSLFIIDEVMTGFRVALGGAQSYYEVTPDLTTLGKVIGGGMPVGAFGGKKEIMQYIAPTGPVYQAGTLSGNPIAMSAGIACLNELKKEGNEQRLAMLTKKLALGLKNLANQHNIPLVVNYVGGMFGIFFTTQNEVTSYQQAIQCDIERFNLFFHKMLEQGVYLAPSAFEAGFMSLAHTDADIDRTLQAADIAFASLRSSSFS

SEQ ID NO: 20465 - protein, 107 aa, Haemophilus somnus 2336
MLLIDGGGAVRRALIDANLAQLAADNGWEGIIVYGAIRQLQQLENINIGIQALAPIPVGSDEQSIGETDVPVNFGGVTFFPDDYIYADLTGIILSQEPLDLEEFDSL

SEQ ID NO: 20466 - protein, 426 aa, Actinobacillus pleuropneumoniae serovar 1 str. 4074
MSKSEQLFEKAQKVIPGGVNSPVRAFKGVGGTPVFIQKAEGAYITDSDGKKYIDYVGSWGPMVLGHNHPAIIDAVLKAVPNGLSFGAPTESEITLAELVTKLVPSIELVRMVSSGTEATMSAIRLARGYTGRDKIIKFEGCYHGHSDSLLVKAGSGALTLGQPSGPGVPADFAKHTLTCTYNDLDSVKTAFEQYPNEIACLIVEPVAGNMNCIPPKNDFLKGLRALCDQYGAVFIIDEVMTGFRVALGGAQAYYDVKPDLTTLGKIIGGGMPVGAFGGKKEIMEYIAPTGPVYQAGTLSGNPIAMAAGLACLTELSKAGNEEKLAAQTKTLAEGFKALADKHNVLFTAQYVGGMFGLFFTEQAEITNFQEVMKCDAAKFNRFFHLMLEQGVYLAPSAFEAGFMSLAHSDEDIQATLAAADKAFAQL

SEQ ID NO: 20467 - protein, 243 aa, Actinobacillus pleuropneumoniae serovar 1 str. 4074
MLKNKLSVLAIVAGTFVSAQTAFAAEQKADQKFIDDSSYAVGVLMGKNIEGVVESQKEIFSYNQDKILAGVQDTIKKTGKLTDEDLQKQLKSLDTYLASQESKIAAEKSKATVEAGNKFRADYEKQSGVKKTASGLLYKIEKAGTGESPKAEDTVKVHYKGTLTDGTVFDSSYDRGEPIEFQLNQLIPGWIEAIPMLKKGGKMEIVVPPELGYGERQAGKIPASSTLKFEIELLDFKAAEAKK

SEQ ID NO: 20468 - protein, 459 aa, Actinobacillus pleuropneumoniae serovar 1 str. 4074
MAKAPKTAYVCNDCGAEYSRWMGQCKECKSWNTVSEIRLISSKEATKSDRFSGYAGETSGKVQTLSEISLQEVPRFSSGFNELDRVLGGGVVPGSAILIGGHPGAGKSTLLLQVMCGLSKDLPTLYVTGEESLQQVAMRANRLGLPTDNLKMLSETSVEHICNIADQEKPKIMVIDSIQVMHLADIQSSPGSVSQVRECASFLTRYAKTRQVAIIMVGHVTKDGTLAGPKVLEHCIDASILLEGESDSRFRTLRSQKNRFGAVNELGVFAMTEQGLREVKNPSAIFLSRSDEQTPGSSVMVLWEGTRPLLVEIQALVDHSMLANPRRVAVGLDHNRLSLLLAVLHRHGGLQMSDQDVFVNVVGGVKVTETSADLALILALISSFRNRALPQDLVVFGEVGLAGEIRPVPSGQERISEAAKHGFKRAIIPHGNAPKKPIKGMEVFTVKKLSDALDILGNL

SEQ ID NO: 20469 - protein, 169 aa, Actinobacillus pleuropneumoniae serovar 1 str. 4074
MITLHTNFGDIKIELNFEKAPVTAKNFEDYCKEGFYNGTIFHRVIDGFMIQGGGMTSGLIEKATKAPIQNEANNRLSNKRGTLAMARTSDPHSASSQFFINVADNTFLDYRSKEMFGREVVQEWGYAVFGEVVEGMDVVDKIKGVKTGNKGFHQDVPVEDVVIESVTVA

SEQ ID NO: 20470 - protein, 396 aa, Actinobacillus pleuropneumoniae serovar 1 str. 4074
MSNLSQLETKLVHAGRKSRYTQGSVNPVVQRASSLVFESVSQKKHATRNRYKGELFYGRRGTLTHFALQDAMCELESGAGCYLYPCGAAAVTNSILAFVSQGDHVLMTGAAYEPTQDFCNVILKNIGVSTTYYDPLIGEGIRALIRPNTKVLFLESPSSLTMEVPDIPTLVRIAREVNPNMVIMIDNTWAGGVLFPALEFGIDISIQAGTKYLVGHSDVMIGTAVSNARCWDQLREHSYLMGQMVDADSAYTTARGLRTLGIRLKEHQERSIQVAQWLAQRPEVKAVFHPALPSCPGHEFFKRDFKGASGLFSFELNQKLNDEQLANFLDHFELFTMAYSWGGFESLILANQPEEIARIRPAIERKLSGTLIRIHVGLEAVEDLIADLEKSFSRLK

SEQ ID NO: 20471 - protein, 316 aa, Actinobacillus pleuropneumoniae serovar 1 str. 4074
MTVLNIVFLDKTGVPTHEIPRPSFPHIWTEYDSTDASQTFERAKDADIIVTSKVLLGRELLAQLPKLKLIAITATGTNNVDLVAAKELGIAVKNVTGYSTTTVPEHVLGMIFALKHSLIGYHRDQITSDRWATCGQFCYVDHPVTDIRGSTLAIFGKGNTGSEVARLAQSVGMKVIFAEHKGATEIREGYTAFEEVFKQADIISLHCPLTDSTQNLINAETLALMKPTAYLINTGRGPLVDEAALLAALEQGKIAGAALDVLVKEPPEKDNPLMQAAKRLPNLLITPHVAWASDSAVTTLVNKVTQNMEEFVLNGK

SEQ ID NO: 20472 - protein, 307 aa, Actinobacillus pleuropneumoniae serovar 1 str. 4074
MGKIWVTGDAVVDLIPDGENHYLKCAGGAPANVAVGVSRLGVEAGFIGRVGLDPLGKFMQQTLNAEKVSTEHMILDPKQRTSTVIVGLDDGERSFTFMVNPSADQFLEAGDLPTFQKGDFLHCCSIALINDPSRSTTIEAIRRIKAAGGFFSFDPNLRESLWASLEEMKQVVNSVVAMADVLKFSEEELTLLTDTATLEQATKAITAQYPEKLIIITLGKDGAIYHLNGHSQTVAGKALKPVDTTGAGDAFVSGLLAGLSQVENWKDESVLVDVIRKANASGALATTAKGAMSALPNKAELEAFLAQ

SEQ ID NO: 20473 - protein, 385 aa, Actinobacillus pleuropneumoniae serovar 1 str. 4074
MSLDLSDIRQQITQLDRHLLKLLAERHRLAFDVVRSKEITQKPLRDIEREKALLQALVSHAEAENYQLDPQYVTQIFQRIIEDSVLTQQNYLQNKLNAQKEQNVSIAFLGMRGSYSNMASRQFAKKYQGSLIELSCDSFQQVFDKVSGGEAEFGVLPLENTTSGSINDVYDLLQHTDLAVVGELAYPIKHCVLANGNIELTEIDTLYSHPQVIQQCSQFIQSLNKVHIKYCESSSHAMQMVARLNKPNIVALGNEDGGKLYGLTNIKTDIANQQNNITRFIVVAKQAINVSPQLQTKTLLLMTTSQQAGALADALMVFKQHQIRMTKLESRPIYGKPWEEMFYIELQANIHSENTQQALKALENVTSYIKVLGCYPSEIIEPVKL

SEQ ID NO: 20474 - protein, 304 aa, Actinobacillus pleuropneumoniae serovar 1 str. 4074
MIELNGEPFGQMRQTYGGDTLNTATYLARVSTPEQIQVCYVSALGTDKLSQGMLAYWQADGIDTQWVLKDEQRSPGLYLIQLDKKGERTFLYWRNQSAARYLLQHSNFPQVLSELDSVDMIYLSGISLAILPENDRKLLITSLAKLKQAGVEIAFDSNFRPKLWESLEQAQACYRELLPLVDVALVTFDDEAMLWQDEDEQQTIARLSAYGIAKIIVKQGSRGAVVCEHLQQTFVPTIPVEHVVDTTSAGDSFNAGFLAGYLQGKPLAVCCRQGNQLAGIVIQHKGAIIDKSATAHLFAQFNAM

SEQ ID NO: 20475 - protein, 432 aa, Actinobacillus pleuropneumoniae serovar 1 str. 4074
MRTTELIELDQKHIWHPYSSITHPIPTYPVERADGVIITLKDGKKLIDGMSSWWAALHGYNHPRLNQAATEQLSKMSHIMFGGLTHEPAAKLSQKLLEILPPELNKIFFADSGSVAVEVAMKMALQYAQASGQKNAKKRTKFATIRSGYHGDTWHAMSVCDPVTGMHGLFNSSLPVQYFLPQPSVKFGEAWRDEAILPLQDLFEQHGDEIAALILEPVVQGAGGMYFYSPVYLQKARELCDRFGILLIFDEIATGFGRTGKLFALQHAEVVPDIICLGKALTGGYLTLSATVTTEKVATVICEGEAKCFMHGPTFMANPLACAIAYESINLLLESDWQANIQRIERQLLEELAPAKHFKSVAEVRVLGAIGVLEMQQPVDLVPLQKLFVEHGIWVRPFGKLVYIMPPFIISQAELTQLTSALLQVLKIAYNE

SEQ ID NO: 20476 - protein, 173 aa, Actinobacillus pleuropneumoniae serovar 1 str. 4074
MNNPFALFDLPVQFELDNALLSERYLALQRQLHPDNFANGSSTEQLAAVQKSADINSALQTLKDPILRAEAIIEIHTGEAKNLEEKSMRDIEFLMQQMEWHEKLETIEHRHDEAELTAFLKQIKTEQKAVLEQLQQTLEAQQWQQANGLTDRLRYFKKLIIQIEKVEEKFFDM

SEQ ID NO: 20477 - protein, 165 aa, Actinobacillus pleuropneumoniae serovar 1 str. 4074
MRIDTSALCDIYSDQVDVVEPIFSSFGGASSFYGKITTVKCFESNGLIASVLEEEGQGRVLLIDGGGAVRRALIDAELAQLALDNGWEGIIVYGAVRQLDVLETLDIGIHALAPIPVGADDNEIGEVDTPVNFGGVTFFPEDYVYADLTGIILSPELLDLAELEE

SEQ ID NO: 20478 - protein, 466 aa, Actinobacillus pleuropneumoniae serovar 1 str. 4074
MGPATDRGNNLEKVIAAGANMVRMNFSHGVPEDHIERANKVREIAARLGKTVAILGDLQGPKIRVSTFKDGKIFLNIGDKFTLDADLPRGEGHQDAVGLDYKNLPNDVVPGDILLLDDGNVQLKVLSVEGVKVHTEVTVGGPLSNNKGINKLGGGLSAPALTEKDKEDIKLAAKIGVDYLAVSFPQSSADLDYARQLAREAGLEAKIVAKVERAETVATEEAMDDIILGSDVVMVARGDLGVEIGDAALVGVQKRLIRRARKLNRVVITATQMMESMIKKPMPTRAEVMDVANAVLDGTDAVMLSGETANGDYPVETVKSMAEVCLGAETMPSINISRHRMEGTFATIDEAVAMSAMYTANHLEGVSALIALTHSGETAKLMSRISSGLPIYALSRNQQALNRTALYRGVTPVFYDEESRTFEGAKKAIALLKEKGYLMSGDLVLLTQGDELKEGGTNTSRLLKVE

SEQ ID NO: 20479 - protein, 256 aa, Actinobacillus pleuropneumoniae serovar 1 str. 4074
MARRPLVMGNWKLNGSKAFTKELIAGLKAELADVKGCDVAIAPPVMYLAEAEAALAGQSVIALGAQNVDVNVQGAFTGDISTEMLKDFGAKYIIIGHSERRTYHKECDTFIAKKFAALKAAGLVPVLCIGETEAENEAGQTEAVCAKQIDAVIDALGVEAFNGAVIAYEPIWAIGTGKSATPAQAQAVHAFIRGHIAAKSQAVADQVIIQYGGSVNDANAAELFTQPDIDGALVGGASLKAPAFAVIVKAAEKAKA

SEQ ID NO: 20480 - protein, 380 aa, Actinobacillus pleuropneumoniae serovar 1 str. 4074
MAKKDYYEVLGLQKGASENDIKRAYKRLASKHHPDKNQGSKDAEEKFKEINEAYEVLGDAEKRAAYDQYGHAAFEQGGGAGGFGGGFGGGGFGGFEDIFSEMFGGGFGGGGRRNHVVRGDDLRYDIEISLEEAVKGCKKDIRISTLAECDTCHGSGAEKGSKVETCSHCHGSGRIRRQQGFFVTEAVCPSCHGSGKKIEKPCKSCHGDGRVQKAKNLSVTIPAGVDTGNQLRLSGEGAAGENGAPAGDLYVVIHVREHDIFERDGSNLYCEVPISFTMAALGGEIEVPTLDGKLKLKIPAETQTGKLFRVRGKGVASPRGGYAGDLICKVVVETPVALNDEQKDLLRKLEESLAGKSKHRPQQESFLDSVKNFFSNLGKH

SEQ ID NO: 20481 - protein, 348 aa, Actinobacillus pleuropneumoniae serovar 1 str. 4074
MNNDFLVLKNITKSFGKATVIDNLDLVIKRGTMVTLLGPSGCGKTTVLRLVAGLENPTSGQIFIDGEDVTKSSIQNRDICIVFQSYALFPHMSIGDNVGYGLRMQGVSNEERKQRVKEALELVDLAGFADRFVDQISGGQQQRVALARALVLKPKVLLFDEPLSNLDANLRRSMREKIRELQQRLGITSLYVTHDQTEAFAVSDEVIVMNKGKIMQKAPAKDLYLRPNSLFLANFMGESTIFDGNLNQGTVSIGDYRFPLHNAADFSVADGACLVGVRPEAIRLTATGETSQRCQIKSAVYMGNHWEIVANWNGKDVLINANPDQFDPDATKAFIHFTEQGIFLLNKE

SEQ ID NO: 20482 - protein, 267 aa, Actinobacillus pleuropneumoniae serovar 1 str. 4074
MLAHEYLVEVKNLTFKRGERVIYNNLNLKVQKGKITAIMGPSGIGKTTLLRLIGGQIVPESGEILFDGEDVCKASNSQLYAIRQRMGMLFQSGALFTDLSTFDNVAFPIREHTKLPEQLIRKLVLMKLESVGLRGAADLMPAELSGGMARRAALARAIALDPELIMYDEPFTGQDPISMGVIVELIKKLNQVLNLTSIVVSHDVTEVLSIADYAYIVADKRVIAEGTPEALTASQDPQVIQFLAGKADGPVRFHYPAKDYTEELFSD

SEQ ID NO: 20483 - protein, 393 aa, Actinobacillus pleuropneumoniae serovar 1 str. 4074
MNSNDIKQLDADYIAQTYGRFNLALSHGKGCDVWDFEGNQYLDFTSGIGTNSLGWADDGWLAAVTTQAGKLQHTSNIFFTEPSAVLAKSLVEASGLKRVFFCNSGAEANEGAIKTARKYSHDKYGKGRATLLSLVNSFHGRTISTLAATGQDVFHQHFFPFTQGFEHTPANDLDALHARIEQDDVCAIILEIVQGEGGVCALDTEYLQGVQAICQAKDIILIIDEVQTGIGRTGKLFAYQHFGLQPDIITLAKGLGGGLPIGAFVLGGKCQNTLGKSDHGSTFGANPVCCAAANAVLAKIDEKFLADVAAKGEKLRAALLTLPKVKSVSGLGLMLGIEFEDGVKAADVVAKAIEKGVLTLTAKTKLRLLPPLVISEQQIDHGVAVLREVLESL

SEQ ID NO: 20484 - protein, 209 aa, Actinobacillus pleuropneumoniae serovar 1 str. 4074
MALDFNAVALETTEAKGGYGIGLQIGQQLLSSGMEVDAEAVARGINDVLNQNPPAIDLNDVTKALQELGARAEAAQAEAFKAIEADNKAFLEENKKAKGVVVTESGLQYEVLTEGTGAKPTAASSVRVHYTGSLIDGTVFDSSVKRGTPAEFPVGGVIKGWTEALQLMTIGSKWRLTIPQELAYGERGAGASIPPFATLIFEVELLDIL

SEQ ID NO: 20485 - protein, 436 aa, Actinobacillus pleuropneumoniae serovar 1 str. 4074
MAKIVKVIGREIIDSRGNPTVEAEVHLEGGFVGLAAAPSGASTGSREALELRDGDKSRFLGKGVLKAVSAVNNEIAQAILGKDGSAQAEIDQIMIDLDGTDNKSKFGANAILAVSLATAKAAAASKGLPLYAYIAELNGTPGVYSMPLPMMNIINGGEHADNNVDIQEFMIQPVGASTLKEALRIGAEVFHNLAKVLKSKGLNTAVGDEGGFAPNLASNADALACIKEAVEKAGYVLGKDVTLAMDCASSEFYNKENGLYEMKGEGKSFTSQEFTHYLEGLCNEYPIKSIEDGQDESDWEGFAYQTKVLGGKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALAAAGTPAPFNGLKEVKGQA

SEQ ID NO: 20486 - protein, 448 aa, Pseudomonas aeruginosa UCBPP-PA14
MPTPDKNNKIDVQAFIDAQAVSAFQLRVLSLCFLIVAMDGFDTAAIGFIAPALAHDWQLSPAQLSPILGAALAGLALGAFAAGPLADRFGRKSVLLLSVLFFGGWSLASAYAGSVETLALLRFFTGLGLGGAMPNAITLTSEYCPRRHRALMVTAMFCGFTLGSALGGLLAARMVPALGWESVLLLGGGLPLASLPLLWACLPESVRFLARRAPDAARLRRILERLGRLPDGWAGRLELPADESDGTSPLRQILGAELRGGTLLLWATFFMGLLIIYLLTNWLPTLIGGTGFSLGEAATISAMFQLGGTLGALLLGSAMDRFDAHRVLSLAYVGGALFILGIASLYHSFALLALCVAGVGFCISGSQVGANALAADFYPTRSRATGVSWALGLGRIGSIVGSLSGGALLGLGLGFSGILALLVIPALLAAVAVHRLGRRRARPSSVTL

SEQ ID NO: 20487 - protein, 331 aa, Pseudomonas aeruginosa UCBPP-PA14
MKTRQLGHNGPSVSAIGLGCMGMTDFYTTGGDRQEAIATLHRAVELGLNFFDTADMYGPHSNEELLGEALRGKREQVFLASKFGIIRDPANPQARGVDGSPAYIRRAIEGSLKRLGTDRLDLYYQHRMDPQVPIEDSVGALADLVKAGKIRHIGLSEASAETLERAHRVHPISALQSEYSLWTRDPEDTGVLAACRRLGIAFVPYSPLGRGFLTGTLKRPEDFAADDYRRFSPRFQGENFAKNLKLVDKVGELAAAKGVKPSQLALAWVLAQGDDLIPIPGTKQRRYLEENVAATELRLSAAELAELDAIFPAEAVAGSRYSEEGMRLVNL

SEQ ID NO: 20488 - protein, 369 aa, Pseudomonas aeruginosa UCBPP-PA14
MSNLLLSPLAVGNLALRNRIVMAPMTRSRAQQPGDVPTALNALYYAQRAGAGLIVSEGTQISRLGQGYAYTPGIYSEAQLAGWRQVTEAVHAAGGLIAAQLWHVGRMSHRSLQAGGEAPIAPSPIQAKAQVFIADGQGGGSMAPADAPREMTLEDIRRVRDEFVRAARNALDAGFDLVELHGANGYLIDQFLASASNRRSDAYGGSLENRARFLLEIVDALVAAVGAERVGLRLSPWGTINDMHDDEPEAMTLYLAEALQRRGIAYLHLAEWEWSGGPAYPQGFRERLRERFRAPLIVCGNYDAERAEAILQAGLADAVAIGRPFIANPDLVERIRLGAPLAEANQARFYGGDAAGYTDYPTLGQSATA

SEQ ID NO: 20489 - protein, 264 aa, Pseudomonas aeruginosa UCBPP-PA14
MSQDNPQAIIQVRDLCNRFGAQAVHEHLDLDVRRGEILGVVGGSGTGKSVLLRSIVGLRRPTSGSVRVFGEDLLQLPEERRSLVERRFGVLFQQGALFSSLTVVENVALPLIENAGLPRADAEHLAQVKLALAGLPANAGDKYPASLSGGMIKRAALARALVLDPDILFLDEPTAGLDPIGAAAFDNLIRTLRDALGLTVFLVTHDLDTLYTICDRVAVLSQKKVLVVDTLERVAATDDPWVREYFHGPRGRAAHQAAAVPENH

SEQ ID NO: 20490 - protein, 187 aa, Pseudomonas aeruginosa UCBPP-PA14
MLKRLLIATCTLLFAGSLLAATPAAKPHVLIATSLGEIEVELDPTKAPISVKNFLEYVDSGYYDGTLFHRVIPGFMVQTGGFSAGMQEKKTRAPIKNEADNGLLNERGTLAMARTGVVDSATSQFFINLTDNDFLNHGARDFGYAVFGKVVRGMGVVDQIAKVPTTRRNGFADVPSDDVVILSAKRL

SEQ ID NO: 20491 - protein, 311 aa, Pseudomonas aeruginosa UCBPP-PA14
MRALTALSRFVSASFPFWVLLFAILAFFRPAWFLPLTVAIAPLLGLVMFGMGLTLKGEDFREVARHPIRVLIGVLAQFVIMPGLAWLLCRLLQLPAEIAVGVILVGCCPGGTASNVMTWLSRGDVALSVAITSVTTLLAPLVTPALVWLLASAWLPVSFAAMFLSILQVVLMPIALGLLAQRLLGERTRQVAEVLPLVSVFSIVVIIAAVVAASQARIAESGLLIMAVVMLHNGFGLSLGYLTGKLTGMPLAQRKALAIEVGMQNSGLGAALANAHFSPLAAVPSALFSVWHNLSGSLLAALFRRMEDTPR

SEQ ID NO: 20492 - protein, 455 aa, Pseudomonas aeruginosa UCBPP-PA14
MPDAPASAAERLERLPLSPYHRLIFVIIALAFFFDSMDLAMMTFLLGSIKAEFGLDSAQAGLLASSSFFGMVIGAALSGMLADRFGRKPVFQASIVLWGLASYLCSTAGDLGSLTFYRVLLGIGMGMEFPIAQSLLSEMIPASRRGKYIALMDGFWPLGFVAAGCLSYFLLPLTGWRSIFLVLALPAVFVLAIRFLIPESPRWLEQAGRREQADRVLRDIEARVMRSLGLTELPPPLRQPQRERSRPGFFSAFAELWSPAYRRRTLTVWGLWFFALLGFYGLTSWLSALLQQSGFAVTQSVYYTVLISLAGIPGFLCAAWLVESWGRKPSCVLMLLGGGAMAYAYGQTAVFGGSLALLIGFGLAMQFFLFGMWAVLYTYTPELYPTSARATGSGFASAVGRIGSLLGPLVTGLVLPLTGQGGVFTLGALCFGVAALVVWAFGIETRGRTLEELAG

SEQ ID NO: 20493 - protein, 330 aa, Pseudomonas aeruginosa UCBPP-PA14
MKALILKAFGGPESFELREVPKPVPQAGQVLVRVHATSINPLDYQVRRGDYPDLVALPAITGHDVSGVVEAVGPGVTAVAPGDEVWYTPQIFEGQGSYAEYHLAAESIIGRKPAALSHLEAASLSLVGGTAWEALVTRAALRVGESILVHGGAGGVGHVAIQLAKAMGARVFTTVREVNFEFTRQMGADVLIDYQKQDYVEAILRETGGHGVDVVFDSIGGDTLSRSPEVLAQLGRVVSIVDLAQPQNLLQAWGRNASYHFVFTRQNRGKLDELSALVERGRLRPHVGAVYSLADIPLAHARLESRDNGIRGKIAIAVEPSVDPAQAFAR

SEQ ID NO: 20494 - protein, 427 aa, Pseudomonas aeruginosa UCBPP-PA14
MSRSETLFNNAQKHIPGGVNSPVRAFKSVGGTPLFFKHAEGAYVLDEDDKRYVDYVGSWGPMILGHSHPDVLDAVRRQLDHGLSYGAPTALEVEMADLVCSMVPSMEMVRMVSSGTEATMSAIRLARGYTGRDSIIKFEGCYHGHSDSLLVKAGSGALTFGVPNSPGVPAAFAKHTLTLPFNDIEAVRKTLGEVGKEVACIIVEPVAGNMNCVPPAPGFLEGLREACDEHGVVLIFDEVMTGFRVALGGAQAYYGVTPDLSTFGKIIGGGMPVGAFGGKREIMQQISPLGPVYQAGTLSGNPLAMAAGLTTLRLISRPGFHNELTAYTTRMLDGLQQRADAAGIPFVTTQAGGMFGLYFSGADAIVTFEDVMASDVERFKRFFHLMLDGGVYLAPSAFEAGFTSIAHGDKELEITLNAAEKAFAALK

SEQ ID NO: 20495 - protein, 506 aa, Pseudomonas aeruginosa UCBPP-PA14
MRYAHPGSEGAIVSFKARYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAEVLTGGSVEKLEGNLASGYYIQPTLLKGHNKMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 20496 - protein, 482 aa, Pseudomonas aeruginosa UCBPP-PA14
MSLEQTGHAPATSGVDFESVDADYFQHRQLKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIACFIGAYCESLFGVGGWLIYLVFYIVFIGIHILGAGEALKLMFVITAVAAIALGVFIVAMVPHFDSANLFNIPQTAATGASSFLPFGYVGVWAAIPYAIWFFLAVEGVPLAAEETKNPKRDLPRGLIGAMLVLLAFAALILVVGPGAAGAKELMGSGNPLVEALESAYKGSTWMSQFVNLVGLAGLIASFFSIIYAYSRQIFALSRAGYLPRSLSLTNRKKAPVLALVVPGVIGFGLSLTGQGDLLILVAVFGATISYVLMMAAHITLRIRRPDMQRPYRTPGGILTSGVALALACVAVVAGFLVDPRVVVGAVAIYAVLIGYFALYSRHHLVSGTPEEEFAAIQAAEQDLR

SEQ ID NO: 20497 - protein, 486 aa, Pseudomonas aeruginosa UCBPP-PA14
MIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPTGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 20498 - protein, 442 aa, Pseudomonas aeruginosa UCBPP-PA14
MTNPTTSIEDVPLNAFHRLLTLRSGGGSFVDGYVLSIIGVAMLQMTAALQLSSFWQGMIAASALVGIFFGGFLGGWLTDRLGRRRLFFVGPSLFVLASLAQYGVDSAAALFVLRFLIGVAVGIEYPVATALLVEFLPKKYRGPRLATLTILWFAGAAFAYLVGDLILRSGGEDAWRLVLASTAAIGAVLFLLRIGTPESPRWLLSKGRDADAERVIRQVYGEAFSLANLPEQALERKVTIWHLLYAGYGKRMLFVTLFWTCSVIPVFAVYAFAPKVLLALNLKGDWASYGSVAITLLFVIGCIIATRLINRIGRRCMLLHSFLWSGLALLGLGVFHAGSEATILGLFGAYALFIGGAQVLQLVYPNELFPTEIRAFAVGVGTSLSRVGAAVGTYLVPLSLETLGTAQTMYAAALVTLLGLLVTWALAPETRSLNLQQAASLT

SEQ ID NO: 20499 - protein, 471 aa, Pseudomonas aeruginosa UCBPP-PA14
MSSVGEQKVQDGSLKRELGERHIRLMALGACIGVGLFLGSAKAIQMAGPAIMISYILGGLAILVIMRALGEMAVHNPVAGSFSQYAKDYLGPLAGFITGWNYWFLWLVTCVAEITAVAVYMGIWFPDVPRWIWALAALASMGTINLIAVRAFGEFEFWFALIKIVTILAMVVVGIGMIAFGFGNDGIATGISNLWAHGGFMPNGIQGVLMSLQMVMFAYLGVEMIGLTAGEARNPTKTIPSAINSVFWRILLFYVGSLFVIMSLYPWNEIGTQGSPFVMTFERMGIKTAAGIINFVVITAALSSCNGGIFSTGRMLYSLAQHRQAPAFFGKASRSGVPRRALILSILALLLGVLLNYLVPEKVFVWVTSIATFGAIWTWAMILLAQLRFRKTLSPAECDKLQYRMWLYPLSSYLALAFLVMVVVLMAFFEDTRIALYIGPPFILLLTVLYYAFNLAPKEPAGTGSVSRAAS

SEQ ID NO: 20500 - protein, 166 aa, Pseudomonas aeruginosa UCBPP-PA14
MRKEYVMSAFHDLTLLGLDGQDLPLSPFKGKVLLVVNVASKCGLTPQYAGLENLYQTYRERGFAVLGVPCNQFAGQEPGSEADIQSFCSLNYGVSFPMSAKVEVNGSARHPLYRLLAGEGAEFPGDITWNFEKFLLGPDGRVLARFSPRTAPDDPALVQAIEKALG

SEQ ID NO: 20501 - protein, 472 aa, Pseudomonas aeruginosa UCBPP-PA14
MDGQHPHSGELKRGLKNRHIQLIALGGAIGTGLFLGSAGVLKSAGPSMILGYAIAGFIAFMIMRQLGEMIVEEPVAGSFSHFAHKYWGGFAGFLSGWNCWVLYILVGMSELTAVGKYIHYWWPEVPTWATAALFFVVVNAINLANVKAFGEAEFWFAIIKVVAIIGMILLGCYLLFSGSGGPQASVSNLWAHGGFFPNGVSGLVMAMAIIMFSFGGLEMLGFTAAEADKPRTVIPKAINQVIYRILIFYIGALVVLLSLTPWDSLLQTLNASGDAYSGSPFVQIFSMIGSGTAAHLLNFVVLTAALSVYNSGTYCNGRMLLGLAEQGDAPRALARVDKRGVPVRALVVSALVTFLAVVVNYVIPHQALELLMSLVVAALVINWAMISMAHLKFRAQMDRQGTRTHFRAFWYPYGNYLCMAFVVFILGVMLLIPGIQVSVYAIPVWLLVMWACYRLKGAPRPMPGLRVKPVTE

SEQ ID NO: 20502 - protein, 365 aa, Pseudomonas aeruginosa UCBPP-PA14
MTVDQRQWAREAIRIIEADFQRSADTHLIPLETPGLPGVELYFKDESSHPTGSLKHRLARSLFLYALCNGWLGPAAPVIEASSGSTAISEAYFARLLGLPFIAVMPASTSKEKIAQIAFYGGQSHLVEDPTQIYAESERLARESGGHFMDQFTYAERATDWRANNNIAESIFQQMRHEPYPTPTWLISSPGTGGTLATLGRYVRYRQHCTRVLCADAERSVFFDAYVSGDRGLTLDCGSRIEGIGRPRVEASFLPEVIDAMVKVPDAWSLAAMHYLARRLGRRVGGSSGTNLIGALVAARQMVAAGEKGSLVAILCDGGERYATTYYDPVWLARQGYALEPLVEALAACVERGVALPDGLLVVGL

SEQ ID NO: 20503 - protein, 302 aa, Pseudomonas aeruginosa UCBPP-PA14
MQQLLNEILDEVRPLIGRGKVADYIPALAGVEPNQLGIAVYSRDGELFHAGDALRPFSIQSISKVFSLVQAIQHSGEDIWQRLGHEPSGQPFNSLVQLEFERGKPRNPFINAGALVICDINQSRFAAPAQSMRDFVRRLCGNPEVVSDSVVARSEYQHRSRNAAAAYLMKSFGNFHNDVEAVLLSYFHHCALRMSCVDLARAFCFLADKGFCKHSGEQVLNERQTKQVNAIMATSGLYDEAGNFAYRVGLPGKSGVGGGIIAVVPGRFTVCVWSPELNAAGNSLAGIAALEKLSERIGWSIF

SEQ ID NO: 20504 - protein, 297 aa, Pseudomonas aeruginosa UCBPP-PA14
MTADPILTLFLPIALGIIMLGLGLSLTPADFLRVVRYPKPVLVGLVCQIVLLPLACFLIVQGFALEAALAVGMMLLAASPGGTTANLYSHLAHGDVALNITLTAVNSVIAILTMPLIVNLSLQYFMGDGQAIPLQFGKVMQVFVIVLGPVAIGMLVRNRLPAVADRLQKPVKILSALLLLVIILLALAKDWQTFVTYAPVVGLAALAFNLLSLAVGYWVPRLLRLPKAQAVAIGMEIGIHNGTLAIALALSPSLLNNSTMAIPPAIYGVLMFFTAAAFGWWVSRGHQAAPAPVTAPD

SEQ ID NO: 20505 - protein, 286 aa, Pseudomonas aeruginosa UCBPP-PA14
MSDYQETLYQGYGQRFSIDNMLHEVRTEHQHLVIFENARMGRVMALDGVIQTTEADEFIYHEMLTHVPILAHGAARRVLIIGGGDGGMLREVAKHKSVERITMVEIDGTVVDMCKEFLPNHSQGAFDDPRLNLVIDDGMRFVATTEERFDVIISDSTDPIGPGEVLFSENFYQACRRCLNEGGILVTQNGTPFMQLEEVRTTAARTDGLFADWHFYQAAVPTYIGGAMTFAWGSTREGLRRLPLETLRQRFRDSGIATRYYNADIHLGAFALPQYVLQAIGKQDND

SEQ ID NO: 20506 - protein, 303 aa, Pseudomonas aeruginosa UCBPP-PA14
MTYGDPAWRPWVLDEERARPFIREALEAGIDFFDSADIYSTGESERILGRALRDFAQREDLVIATKAFFPMSDRPNACGLSRKHLLASVDASLRRLGTDYLDLFVIHRFDPDTPIAETCETLDSLVRVGKVRYLGASSMPAWRFMKMLAFQRHHGLAQFISMQSQYNLIVREDEEDLMPLCREEGIALTPWSPLARGLLAGARSAGTLRTRTDEQAPRWYGGREEVESTLGALEKLAAARGLPPAQLALAWLLGRNGVAAPIVGLSRPHHLEDALAALTLDLAEEECATLEAPLTVRARTPRW

SEQ ID NO: 20507 - protein, 506 aa, Pseudomonas aeruginosa UCBPP-PA14
MIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAEVLTGGSVEKLEGNLASGYYIQPTLLKGHNKMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDIDPLGFF

SEQ ID NO: 20508 - protein, 451 aa, Pseudomonas aeruginosa UCBPP-PA14
MSFDFDLFVIGAGSGGVRAARFAAGFGARVAVAESRYLGGTCVNVGCVPKKLLVYGAHFSEDFEQARAYGWSAGEAQFDWATLIGNKNREIQRLNGIYRNLLVNSGVTLLEGHARLLDAHSVEVDGQRFSAKHILIATGGWPQVPDIPGKEHAITSNEAFFLERLPRRVLVVGGGYIAVEFASIFNGLGAETTLLYRRDLFLRGFDRSVREHLRDELGKKGLDLQFNSDIARIDKQADGSLAATLKDGRVLEADCVFYATGRRPMLDDLGLENTGVKLTDKGFIAVDEHYQTSEPSILALGDVIGRVQLTPVALAEGMAVARRLFKPEEYRPVDYKLIPTAVFSLPNIGTVGLTEEEALSAGHKVKIFESRFRPMKLTLTDDQEKTLMKLVVDAHDDRVLGCHMVGAEAGEILQGIAVAMKAGATKQAFDETIGIHPTAAEEFVTLRTPTR

SEQ ID NO: 20509 - protein, 491 aa, Pseudomonas aeruginosa UCBPP-PA14
MHNESRPEAPLRVLVVGAGFAGLGLAIRLRQAGIDDYLVLEKAADVGGCWRENRYPGAACDVPSHLYSFSFEPKADWSRKFAPQAEILDYLRHCADKYRLRGKIRFHCEVEEARFDAGSGEWQVRCADGQTLRARALVCATGQLSRPLLPRLPGLERFQGPAFHSANWDAEVELAGKRVAVIGTGASAIQFVPRIAPQVQRLSLFQRSAPYVIAKPDRAYADWERRLKARWPWLQRLDRGLKYLHHESRMLAFATFPALMKVMRLSFHRHLHRQIADPQLRARLVPDYPLGCKRILISNDYYPALARSNVELVDTGIREVTEDAVVGRDGRRHEVDAIIFGTGFAATEFLAPMRILGLDGRDLRQAWADGAEAYKGISVSGFPNLFILYGPNTNLGHNSIVYMLESQFPYVLGCLRQLQAQGLRYLDVKPEVQRRFNLEVQQGLRHTVWERGCDSWYKTAAGKNTNNWPGYTFVYRWRTRRPELADYDLAR

SEQ ID NO: 20510 - protein, 1100 aa, Pseudomonas aeruginosa UCBPP-PA14
MARREKPVFLNDPQWYKDAVIYQVHVKSFYDANNDGIGDFAGLIEKLDYIADLGVNTLWLLPFYPSPRRDDGYDIAQYRGVHSDYGSLADARRFIAEAHRRGLRVITELVINHTSDQHPWFIRARHAKKGSRARDYYVWSDSDEKYQGTRIIFIDTEQSNWTWDPVAQQYYWHRFYSHQPDLNFDNPQVLREVLGVMRYWLDMGVDGLRLDAIPYLIERDGTSSENLPETHQVLKRIRAELDAHYPDRMLLAEANQWPEDTRPYFGGEDGGEGDECHMAFHFPLMPRMYMAIAQEDRYPITDILRQTPDIPANCQWAIFLRNHDELTLEMVTDDERDYLWNHYAADRRARLNLGIRRRLAPLVERDRRRIELLHSLLLSMPGTPTLYYGDEIGMGDNIYLGDRDGVRTPMQWSVDRNGGFSRADPAKLVLPPILDPLYGYQTINVEAQARDPHSLLNWMRRLLAVRSQQKAFGRGSLKMLAPSNRRILAYLREYAEGERQDSILCVANLSRAAQAVELDLASHAGKVPVEMIGGMSFPPIGELTYLLTLPPYGFYWFYLADATQMPSWHVAADERLPELPTLVVKQRLGELLQGASRNILEGETLPAYLPKRRWFAGEKGQPRLCYIVPLDEAEPRCALCEVEIDGLRYQLPLGFLDADQRGDSLPQLLALARLRRGRKVGLLTDAASLPLFARKVLAQLRAEAVIAHGDGEIQFIPAAGLAELDDIADEDVLPFSVEQSNSSIRFGERMVLKVLRKILPGLHPEIEVGGYLTRHGYPGIAPLLGEVRRVGADGEPHTLMILQGYLNNQGDAWNWTLDNLERAVRDEISAASEALEGQYDSLAELRGFAANLGARLGEMHSVLAGESDDPAFGSRESDEASVQAWALRIAEQLREAGKRLSEPPRPLQGEAAEQARRLLERLPALLERLPLLARQAAGGLLIRVHGDLHLGQVLMVQGDARFIDFEGEPARSLEERRQRHSPMKDVGGMLRSFDYAAAMVLRNAQSTDSSEQADSARRKVAMRYRSEARDAFLVGYRAAAAGLAHAWHGREGEGAALVLACLEKAAYELLYEADYRPDWLEVPLAGLAELTEHLLKGKNR

SEQ ID NO: 20511 - protein, 464 aa, Pseudomonas aeruginosa UCBPP-PA14
MSQILKTSLLIVGGGPGGYVAAIRAGQLGIPTVLVEGAALGGTCLNVGCIPSKALIHAAEEYLKARHYAGRSALGIQVQAPSIDIARTVEWKDAIVDRLTSGVAALLKKHGVDVVQGWARILDGKSVAVELAGGGSQRIECEHLLLAAGSQSVELPILPLGGKVISSTEALAPGSLPKRLVVVGGGYIGLELGTAYRKLGVEVAVVEAQPRILPGYDEELTKPVAQALRKLGVELYLGHSLLGPSENGVRVRDGAGEEREIAADQVLVAVGRKPRSEGWNLESLGLDMNGRAVKVDDQCRTSMRNVWAIGDLAGEPMLAHRAMAQGEMVAELIAGKRRQFAPVAIPAVCFTDPEVVVAGLSPEQAKDAGLDCLVASFPFAANGRAMTLEANEGFVRVVARRDNHLVVGWQAVGKAVSELSTAFAQSLEMGARLEDIAGTIHAHPTLGEAVQEAALRALGHALHI

SEQ ID NO: 20512 - protein, 316 aa, Pseudomonas aeruginosa UCBPP-PA14
MADFEILCFGETMAMFVAEQPGELDRVEQFGKRIAGADSNVAIGLARLGFAVAWLSRVGDDSLGRFVLDSLTREGLDCRFVEVDAQAPTGFQMKSREVDGADPRVEYFRRGSAASRLGLAHIREEMLGARHLHATGIPPALSASACELSHELMRRMRGKGASLSFDPNLRPSLWPSERRMIAEINALAAHAHWVLPGLEEGRLLSGWQEPADIAAFYLDMGVDAVAIKLGPSGAYYRDAHGEGLVPGVPVATVVDTVGAGDGFAVGVVSALLEGLPLPDAVARGNWIGSRAVQVRGDMEGLPKRSQLLDREHRKSA

SEQ ID NO: 20513 - protein, 310 aa, Pseudomonas aeruginosa UCBPP-PA14
MYLVCGEALFDVFSLESAARSNELGFTAIAGGSPFNVAVGLRRLGVEAALFGGLSSDYLGARLRRVLEEEGVDCGFLVPSDAPTTLAMVGLDASGSAQYQFRGEGCADRQVRLEHLPTLDGRIRGLHVGSYTLVVTPVADTLLALVRRESGRRLVSLDPNVRLDPQPDIDLWRRRVEAFASHAHLIKASEEDLALLYPDRDPGEVARGWLNPRCRLVFVTHGGAGASVHCTHGSWSRPADTALALRDTVGAGDTFQAATLAYLRRLDADSPAGLAALSREAIDAMLAFAIRAAAVTCSRVGPDLPFAHEL

SEQ ID NO: 20514 - protein, 344 aa, Pseudomonas aeruginosa UCBPP-PA14
MTMTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEALQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 20515 - protein, 496 aa, Pseudomonas aeruginosa UCBPP-PA14
MFELSDWQRRAATQRFIDQALIGGRQRPAASGATFDAIDPASNRLLARVAACDAADVDAAVAAARRAFDEGPWARLAPVERKRVLLRLAELMLAHREELALLDSLNMGKPVMDAWNIDVPGAAHVFAWYAESLDKLYDQVAPTAQQALATITRVPLGVIGAVVPWNFPLDMAAWKLAPALAAGNSVVLKPAEQSPFSALRLAELALEAGVPEGVLNVVPGLGEQAGKALGLHPEVDALVFTGSTEVGKYFMQYSAQSNLKQVWLECGGKSPNLVFADCRDLDLAAEKAAFGIFFNQGEVCSANSRLLVERSIHDEFVERLLAKARDWQPGDPLDPASRAGAIVDRRQTAGILAAIERAQGEGATLLGGGRQLTINGSDNFIEPTLFGDVRPDMQLAREEIFGPVLAISAFDSEDEAIRLANDSRYGLAASLWSDDLHRAHRVARRLNAGTVSVNTVDALDVAVPFGGGKQSGFGRDLSLHSFDKYTQLKTTWFQLR

SEQ ID NO: 20516 - protein, 460 aa, Pseudomonas aeruginosa UCBPP-PA14
MTAQLNPQRDTRDYQQLDAAHHIHAFLDQKALNREGPRVMVRGDGLQLWDNDGKRYLDGMSGLWCTNLGYGRQDLAAAASRQLEQLPYYNMFFHTTHPAVVELSEMLFSLLPDHYSHAIYTNSGSEANEVLIRTVRRYWQILGKPQKKIMIGRWNGYHGSTLGSTALGGMKFMHEMGGMLPDFAHIDEPYWYANGGELSPAEFGRRAALQLEEKILELGAENVAAFVAEPFQGAGGMIFPPQSYWPEIQRICRQYDVLLCADEVIGGFGRTGEWFAHEHFGFQPDTLSIAKGLTSGYIPMGGLVLGKRIAEVLVEQGGVFAHGLTYSGHPVAAAVAIANLKALRDEGVVTRVREETGPYLQRCLREVFGDHPLVGEVQGAGFVAALQFAEDKATRKRFANENDLAWRCRTIGFEEGVIIRSTLGRMIMAPALVAGRAEIDELIDKTRIAVDRTAREIGVL

SEQ ID NO: 20517 - protein, 483 aa, Pseudomonas aeruginosa UCBPP-PA14
MQLKDAKLFRQQAYVDGAWVDADNGQTIKVNNPATGEIIGSVPKMGAAETRRAIEAADKALPAWRALTAKERANKLRRWFDLMIENQDDLARLMTIEQGKPLAEAKGEIAYAASFLEWFGEEAKRIYGDTIPGHQPDKRIIVIKQPIGVTAAITPWNFPSAMITRKAGPALAAGCTMVLKPASQTPYSALALAELAERAGIPKGVFSVVTGSAGEVGGELTSNPIVRKLTFTGSTEIGRQLMAECAQDIKKVSLELGGNAPFIVFDDADLDAAVEGALISKYRNNGQTCVCANRLYVQDGVYDAFVDKLKAAVAKLNIGNGLEAGVTTGPLIDAKAVTKVEEHIADAVSKGAKVVSGGKPHALGGTFFEPTILVDVPKNALVSKDETFGPLAPVFRFKDEAEVIAMSNDTEFGLASYFYARDLARVFRVAEQLEYGMVGINTGLISNEVAPFGGIKASGLGREGSKYGIEDYLEIKYLCLGGI

SEQ ID NO: 20518 - protein, 426 aa, Pseudomonas aeruginosa UCBPP-PA14
MSKTNESLLKRRQAAVPRGVGQIHPVVAERAENSTVWDVEGREYIDFAGGIAVLNTGHLHPKVIAAVQEQLGKLSHTCFQVLAYEPYIELAEEIAKRVPGDFPKKTLLVTSGSEAVENAVKIARAATGRAGVIAFTGAYHGRTMMTLGLTGKVVPYSAGMGLMPGGIFRALAPCELHGVSEDDSIASIERIFKNDAQPQDIAAIIIEPVQGEGGFYVNSKSFMQRLRALCDQHGILLIADEVQTGAGRTGTFFATEQLGIVPDLTTFAKSVGGGFPISGVAGKAEIMDAIAPGGLGGTYAGSPIACAAALAVLKVFEEEKLLERSQALGERLKAGLREIQAKHKVIGDVRGLGSMVAIELFEGGDTHKPAAELVSKIVVRAREKGLILLSCGTYYNVIRFLMPVTIPDAQLEKGLAILAECFDELA

SEQ ID NO: 20519 - protein, 318 aa, Pseudomonas aeruginosa UCBPP-PA14
MSNDHPQPLDAAEIPRFAGIPTFMRLPAFTDPAALQVGLIGVPWDGGTTNRAGARHGPREVRNLSSLMRKVHHVSRIAPYDLVRVGDLGDAPVNPIDLLDSLRRIEGFYRQVHAAGTLPLSVGGDHLVTLPIFRALGRERPLGMVHFDAHSDTNDRYFGDNPYTHGTPFRRAIEEGLLDPLRTVQIGIRGSVYSPDDDAFARECGIRVIHMEEFVELGVEATLAEARRVVGDGPTYVSFDVDVLDPAFAPGTGTPEIGGMTSLQAQQLVRGLRGLDLVGADVVEVSPPFDVGGATALVGATMMFELLCLLAESAARSA

SEQ ID NO: 20520 - protein, 457 aa, Pseudomonas aeruginosa UCBPP-PA14
MTSDSRPAVLDLIGNTPLVRVTRFDTGPCTLFLKLESQNPGGSIKDRIGVAMIEAAERDGRLRPGGTIVEATAGNTGLGLALVGRAKGYRVVLVVPDKMSTEKVLHLRAMGAEVHITRSDVGKGHPEYYQDVAARLAQDIPGAFFADQFNNPANPLAHECGTGPELWAQTGHDLDAIVVGVGSSGTLTGLTRFFQKVQPELEMVLADPEGSIMAEYSRSGTLGTPGSWAVEGIGEDFVPAIADLSSVRHAYSISDEESFAMARELLRVEGIPGGSSTGTLLAAALRFCREQKEPKRVVSFVCDTGTRYLSKIYNDQWMTDQGLLQRKHYGDLRDIIARRFEEGRVISVGPDDTLLTAFQRMRLADVSQLPVLDDGKLVGVIDESDILLGVHADAPRFRDAVSSAMNAAPETLAPGASLAQLQAVLDRGLVAIVADASGFHGLITRFDLLNHLRRKLT

SEQ ID NO: 20521 - protein, 134 aa, Pseudomonas aeruginosa UCBPP-PA14
MKDWLDEIHWNADGLVPAIAQDHETGRVLMMAWMNREALALTASENRAIYWSRSRGKLWRKGEESGHVQKLHELRLDCDADVVILMVEQVGGIACHTGRESCFYRVFENGAWKTIDPVLKDPDAIYEHAGHHHE

SEQ ID NO: 20522 - protein, 488 aa, Pseudomonas aeruginosa UCBPP-PA14
MSSPSLVELKAILRLAGPLIAAQLAYVAMVFTDTVMMGKLGPDALAAGGLGAVSYAFVSTFCVGVVAAVGNLVAIRHGCDDAAGAAAAARSGLWVGAALALAAGLLLWNLRPLLLLFGQAPQTVDGAMQFLHSLTFALPGYMAFMVLRGFTSAIDRAGPVMAISVLGALANLALNYSFIEGLFGLPRLGLAGIGLVTALVMNCMPLLLALYIRRQPAYAAYSLLRGLGRPQRAMVEEILRLGLPIGGTYAVESGMFTVATLCMGIIGDHALAAHQIAIQAVYVAFMVPVGLSYATTYRIGQHFGAGRLLEARRAGRVGIGFGALCMLLFAGLFWWMPEAIIGLFLDRDAPANREVAAMAVSLLAIAAWFELFDGTQNVAMGAIRGLKDARTTFLVGLACYWLVGVPLACLLAFAAGWGAAGVWWGLAGGLACAAIGLTLAFEWKTARLLPKATASETSALNCRAAGRGAPSARRCPGNAPVPPAAAAD

SEQ ID NO: 20523 - protein, 442 aa, Pseudomonas aeruginosa UCBPP-PA14
MNNEPQSSSLDNFWMPFTANRQFKARPRLLESAEGIHYIAQGGRRILDGTAGLWCCNAGHGRREISEAVARQIATLDYAPPFQMGHPLPFELAARLAEIAPPGLNKVFFTNSGSESADTALKIALAYQRAIGQGTRTRLIGRELGYHGVGFGGLSVGGMVNNRKAFSANLLPGVDHLPHTLDVARNAFTVGLPEHGAEKAEELERLVTLHGAENIAAVIVEPMSGSAGVVLPPKGYLQRLREITRKHGILLIFDEVITGFGRVGEAFAAQRWGVVPDLLTCAKGLTNGSIPMGAVFVDEKIHAAFMQGPQGAIEFFHGYTYSGHPVACAAALATLDIYRRDDLFQRAVELEGYWQDALFSLRDLPNVVDIRAVGLVGGVQLAPHADGPGKRGYDVFERCFWEHDLMVRVTGDIIAMSPPLIIDKPHIDQIVERLAQAIRASV

SEQ ID NO: 20524 - protein, 255 aa, Klebsiella pneumoniae
MRHPLVMGNWKLNGSRHMVNELVANLRTELAGVSGCAVAIAPPEMYLDLAKRAAEGSHIHLGAQNVDVNLSGAFTGETSAEMLKDIGAQYIIIGHSERRTYHKESDELIAKKFAVLKEQGLTPVLCIGETEAENEAGKTEEVCARQIDAVLKTQGAAVFEGVVIAYEPVWAIGTGKSATPAQAQAVHKFIRDHIAKADAKIAEQVIIQYGGSVNAGNAAELFTQPDIDGALVGGASLKADAFAVIVKAAEAAKKA

SEQ ID NO: 20525 - protein, 265 aa, Klebsiella pneumoniae
  misc_feature (219)..(219): Xaa can be any naturally occurring amino acid
MMTPIWLGTSWKMNKPLSQAMAWCETLAARMPEGCHPAIQPFVIPSFTAIQPVSHFLQTHQLPLLTGAQNMHEADQGAWTGEISAAMLAETGATLVELGHSERRAAFNESDAAINRKVHSALGHGLRPLICIGDSAEEKRWQVSRESVVRQMKIALYGLSHQQALRTLIAYEPVWAIGEHGTPASPQEAGVIHQALRQALCERFGHETGTRIPLLYGGXVTLQNAVELLRQQEINGLFIGRAAWDAQGYCDIVQRVTQEFILQAQ

SEQ ID NO: 20526 - protein, 431 aa, Vibrio vulnificus
MTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDIERFKRFFHLMIDHGVYLAPSAFEASFTSLAHGSKEIEATLEAADRCFAILAAESK

SEQ ID NO: 20527 - protein, 469 aa, Xylella fastidiosa Temecula1
MFLPRPDFRIALSICFMAVSFVISRFGSEVRPTLLLALPLVLGHVSTGLIGFVLNVIAGHHSTVTLAASTIGTALLWLPMLVPMGTLISLTVLVSQLHGAERERDIGPLFRQALWLAMLLGLVMFTFLSVVPALLPLFGIVPDIVPGAAKFLHVVRWGSLAFPLYFCMRYFCEGMHCTFPTMLLGFGGLLVLVPLSYALTYGRFGFAEYGVEGLGIATVTVMWLQAVVFALYLWRSRRFAHLQLFAHLELPCWARIRDLLNIGLPIGISILMEGGLFIVTTLLIGRFGTDEIAAHQIALSVAQLCFMIPMGVAEATTVRIGHAVGRCDLLVMRRVAWAGYAIVIGTQTLSASVLLLGYDVIVAAYTDDLVVASLASKLLLFAAIFQFPDGLQMLSSGVLRGMKDTRVPMLLAMISYWGLGMPLGLGLGFALEWNSRGMWIGLIIGLTAAALLLGWRFRVVSERMFAGIP

SEQ ID NO: 20528 - protein, 391 aa, Xylella fastidiosa
MSIVRMTDLALSGKRVLIRQDLNVPIDQGRITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLEHPVKPLLAIVGGSKVSTKLELLSNLVNNVEQLITGGGIANTFLAAAGYSIGKSLYEGDLIETAREIITAAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 20529 - protein, 306 aa, Vibrio cholerae
MKPTADILASIIEEVRPLTSKGIVADYIPALAKVPSDKLGIAVFTNQGEVITAGDAQEGFSIQSISKVLSLTLAMGLYQPDELWSRVGKEPSGQAFNSLIQLEMEQGIPRNPFINAGAIVVCDMLQSRLSAPRQRLLEFVRQLSGEPQIAYDKVVAASEMMHSDRNAAIAYLMRSFGNFHNEVIPVLHNYFHACALKMSCVELAKTFSYLANKGVSVVTGETVITPTQSKQTNALLATCGLYDGAGEFAYRVGMPGKSGVGGGIIAVVPGEMTIAVWSPALDQSGNSLAGTRALELLAQRIGRSIF

SEQ ID NO: 20530 - protein, 298 aa, Streptomyces sp. WA46
MIDVAVAEPGPGQVRIEVRAVGVNPFDHKMYSGAFGTDPANLPMRLGAEAAGVVTAVGADATGPAGPIQIGDEVIAYRAPGAYAAELIVPASSVVPKPAALSWEQAGGLMVTGVTAVHVLEAIGLREKDSVLIHGAAGGVGLMAVQLAVERGATVLGTASPAKHDVLRDLGAIPIAYGPGLADRVRAAAPQGVHAAADLVGTDEAVDVSVELVADRSRIASVAGFERGARAGIKLLGGGPGADPGTEIRTAARLQLTEAAEAGRLRVLIAASHPLREAAAAHRQIMTGHTTGKIVLVP

SEQ ID NO: 20531 - protein, 437 aa, Synechococcus elongatus
MRELTLTTTVFQTTKSQEIFAAAQKLMPGGVSSPVRAFKSVGGQPIVFDHVKGAHIWDVDGNQYIDYVGSWGPAIVGHAHPEVIDALHAALEKGTSFGAPCLLENILAEMVIAAVPSVEMVRFVNSGTEACMAVLRLMRAYTQREKVIKFEGCYHGHADMFLVKAGSGVATLGLPDSPGVPKATTAATLTAPYNDLEAVSRLFEQYPNDIAGVILEPVVGNAGFIPPDAGFLEGLRELTKQYGALLVFDEVMTGFRIAYGGAQEKFGVTPDLTTLGKVIGGGLPVGAYGGRAEIMKMVAPAGPVYQAGTLSGNPLAMTAGIKTLEILSRPGSYEHLDRITGKLVQGLLDAAREFGHEVCGGHISGMFGLFFTAGPVTNYEQAKQSDLKKFAAFHRGMLEQGIYLAPSQFEAGFTSLAHTEADIERTIAAARTVLSQL

SEQ ID NO: 20532 - protein, 432 aa, Nostoc sp. PCC 7120
MVNTTIKTTKSQEIFAAAQNLMPGGVSSPVRAFKSVGGQPIVFDHVKGAYIWDVDGNQYIDYVGTWGPAICGHAHPDVIGALHDALEKGTSFGAPSFLENVLAEMVIAAVPSIEMVRFVNSGTEACMAVLRLMRAFTNREKVIKFEGCYHGHADMFLVKAGSGVATLGLPDSPGVPKSATSSTLTAPYNDLEAVKALFEENRDQIAGVILEPVVGNAGFITPDAGFLEGLRELTHEHGALLVFDEVMTGFRIAYGGAQEKFGVTPDLTTLGKVIGGGLPVGAYGGRRDIMSMIAPAGPVYQAGTLSGNPLAMTAGIKTLELLQKPGAYEYLERITKKLADGLLQVALETGHAACGGHISAMFGLFFTSGPVHNYEDAKNSDTAKFGRFHRGMLERGVYLAPSQFEAGFTSLAHTDEDIDQTIAIAREVLSSI

SEQ ID NO: 20533 - protein, 501 aa, Clostridium perfringens
MKKRALISVFDKDGVLELAKFLRDRDVEIISSGGTYKYLKENNIEVKEISEITDFPEMLDGRVKTLHPLVHAGILAIRDNKEHMKTLEEREINTIDYVVVNLYPFFEKVREDLSFEEKVEFIDIGGPTMLRAAAKNFKDVVVLSDKKDYEKVMNEIKENNCVSFKLRKTLAGKVFNLMSAYDAAISNFLLEGEEEYPEYLSVSYKKIQDLRYGENPHQGAAYYSSTEFDGAMNSFEILNGKALSYNNIKDLDIAWKVACEFEETACCALKHNTPCGVAVGENSKEVYLKAYDADPVSIFGGIVAINRKIDKATAEEMVKIFLEVVAAPDFDEDALEVLRTKKNLRVIKCKNTPQAKNYMVTVDGGILVQGEDNKLANEYKVVTEKEPTEMELRDMIFGMKVVKYVKSNAIVVVKDGVATGIGGGQVNRIWATKEALERGKGGAVLASDAFFPFRDCVDEAAKNGIKAIIQPGGSIRDEESIEACNEHGISMVFTGVRHFKH

SEQ ID NO: 20534 - protein, 506 aa, Nostoc sp. PCC 7120
MARLALLSVSNKTGLIDLARRLVEEFEFDLISSGGTAQALKDAGLPVTKVADYTGSPEILGGRVKTLHPRIHGGILARRDVASDLTDLENNQIRPIDLVVVNLYPFESTIAKPGVTLAEAVEQIDIGGPAMLRASSKNFAHLTVLCDPAQYDEYLQELRQNNGVASLEFRQKAALKGFLHTASYDSAIASYLSGTQQHTLSGTELQSLRYGENPHQPAAWYQTGTTPTGWTAAEKLQGKELSYNNLVDLEAARRIIAEFTDTPAATIIKHTNPCGTALADTIVEAYQKAFNADATSAFGGIVALNRPIDAATASELTKTFLECVIAPDCDAEAQKILSKKSNVRVLTLADLSTGPKTLVKQIAGGFLVQAADDIAADTSQWQVVTERQPTPDELAELLFAWKVCKHVKSNAIVVTSDRTTLGVGAGQMNRIGSTKIALEQAGDKAKGAILASDGFFPFDDTVRTAAAAGISAIVQPGGSLRDQDSVKAANELGLLMVLTGVRHFLH

SEQ ID NO: 20535 - protein, 510 aa, Deinococcus radiodurans
MTKRALISVSDKTGVVEFAAQLQQRGWELLSTGGTFATLSGAGIPVRQVSDVTGFPEMLDGRVKTLHPAIHGGILARREAGHLGQLAAQDIGTIDLVCVNLYPFRETVARGAPDPEVIENIDIGGPAMIRSAAKNHDAVLVLVDPADYALALQDEVSPAERRRLAAKAYRHTSEYDAAITAYLSGESDELPTQLPEHLSLDLTRTAQVRYGENPHQPGAIYRWGNARGPVIDAQVVAGKPMSFNNYADADAAWSLCQELAAQEQGAVCVAVKHANPCGVAVAADVKTAWERARDADTLSVFGGVVAVSQPVDFGAAQSMKGTFLEVLIAPDVTPDAVEWFAAKKPDLRVLIAGQPQGVSVLDVRPLTGGFAVQERDARPWDDLCPEVVTERQPSEQEWADLRFAWAVVKGARSNAVALCKGGVTVGLGAGAVSRIWAAERAIANAGEAAQGAVLASEAFFPFDDVVRLAASAGVTAVLQPGGAKRDPEVIAACNELGISMVFTGSRHFRH

SEQ ID NO: 20536 - protein, 1372 aa, Cercospora zeae-maydis
MPTSNGGRTSPASLRSHHVRYASDSNIALRSTIMEQPEGPPELETYDSSGTNSSGNDGDEYAGTQESHSDSDGISSRHFVPGSGQAYAQDEVTPLTNVSTYGWSQPGSSNVSRTTTRGSVGSALPGTPAYEGTGTAMTNGTRRPANTRKESSNIYAPNRGPGSSMRYALNTGTRPRNGFTHMRRRNPNDEYRAQEKAYVQRIRQDGPDNDFQTEPRTPSLDYSFGSEDDEESPTNANYADHDPAEVDTLLYYGQEDLEPSVEELNIPANRERLEWHAMLANVLTGDVVKQEKKRLIGGPEQQGENTLKTEVWIGVRAKTCGRSIAAQKRLVEDGRSKVKQTIESIVAFEIKGEAEVGQSPMQQVQDVVKKIEKIEGLYPPRQAFRAAHPPAASSAYEHTCDAVIAWNNTTELIGTELGILQSWVGNMELDFTTARVRPEGEQHNELFDDSSFIDRILKEDGLKSLQGDKNLLNGVNTVIHKAKATLIANAEAFSDRHLPPYIEELLTLINFPSRLIQEIIRMRLSYAKKMKDAAQQGVMTAEQMILQFQILLQLAVKIKEQYLLIGQPEPGWDLPPCIDDNFDSVVLDALKFYFKMLNWKLMANKNTFKEAEILEQEWDFSNELGRHLDGGDVEVAEQFSSLTSKSMGRLAAPFEKELQRPADEVAGTAEMDKRYKSILDSVRVRQRKIFRFSRILSQRFENATEYNINIDNELYEDFLLALRLSGHFLVETNAESSVPTPGENEKAGGKVYILASPVLKERPKDIQSMLGTCYHAEDSPEDPSNPYVLILRPELPLVWEGDRMDASHSGKETLKVPQTLDLKTGRLRLVADGSLQRLQNANMAFTTATGNFDLTILVEQRANLCRESTKNWQRFAKLHTSSPTHSWTRSPLFALRSKPREGKAKAKNSTHPELLCFCYGIWSAFCHSHGRTTAGGQSHKLTKLALDWVSFICDDCVASDRKTFRWAVVALEFAMVMTRGQNILSISDEEYALLRSKVAGCRSLLISHFDIMGARGTVAAQAEKQRMDAMVGKLRLDIGKLKDDDESSRIVRAQWLDELEKLDQARKDREAERQALGRVLEDSNDADRALTHLSASAGNVHLRWQQGQFVGGGTFGSVYAAINLDSGHLMAVKEIRLQDPKMIPTVVSQIRDEMGVLQVLDHPNVVQYYGIEPHRDKVYIFMEYCSGGSLAGLLEHGRIEDETVVQVYALQLLEGLGYLHEASVVHRDIKPDNILLDHNGVIKFVDFGAAKVIAKQGKTMVADGPTGNGRQRSVQGTPMYMSPEVIKGGKHTGRLGAADIWSLGCVISEMATGSRPWANMDNDFAIMYNIANGNSPQMPTRDQMSDVGLDFLQAMLRTRPCEACVRCGASAT

SEQ ID NO: 20537 - protein, 511 aa, Synechocystis sp. PCC 6803
MARLALLSVSDKSGIVELAQRLVNEFQFDLISSGGTAKTLKEAGVPVTKVSDYTGAPEILGGRVKTLHPRIHGGILARRDLPSDQADLEANDIRPLDLVVVNLYPFEQTIAKPGVTVAEAVEQIDIGGPAMIRATAKNFAHTTVLTNPNQYEAYLQALQEQGEIPLALRQQFAGEAFALTNAYDQAIANYFSGLSGDSANQFGLSGTLRQPLRYGENPHQSAGWYQTGREATGWAKAEKLQGKELSYNNLVDLEAARRIINEFDVREPAAVILKHTNPCGVALAPTLVEAYQKAFNADATSAFGGIVALNQPLDGPTAAAMVKTFLECIVAPGCDAEAQEILAKKNNLRVLILPDLATGPSQTIKAIAGGFLVQSADDEREDPSTWQVVTEKQPSGEELAELAFAWKVCKHVKSNAITITKNKTTLGVGAGQMNRVGSVEIALKQAGTEAQGACLASDAFFPFDDSVRTAAAAGITTIIQPGGSMRDQDSIQAANELGLVMIFTGVRHFLH

SEQ ID NO: 20538 - protein, 225 aa, Candida parapsilosis
AQLYADLDKGFTPINFVFPHLPLPHYWKRDAAQQKISETYMTEIARRRETGDIDENRDLIDSLLVNSTYKDGVKMTDQEIANLLIGVLMGGQHTSATTSAWFLLHLAEKPQLLDELYQEVLNALSGKGGNLDDLSYEDLQQMPLVNNTIKETLRLHMPLHSIFRKVVSPLVVPNTKYIVPRGHHVLVSPGYAHTNERFYKDASDFNPHRWDESASTNDAGEVDYG

SEQ ID NO: 20539 - protein, 310 aa, Pichia anomala
EFVKGALTRDAFKSYVPQIREEIIHYFQNSKNFKFGERKHGISNVMATQPEITIFTASRSLMGKQMRERFDESFAGYYSDLDKGFTPINFVFPNLPLPSYRRRDYAQQKISSTYMGLIKERRENNDIKDRDLIDTLMKTSTYKDGVKMTDQEIANLLIGVLMGGQHTSAATSAWFLLHLAEKPELQEEIYQEIMKVTGGEDVTYDDLQEMPLVNNVIKETLRMHMPLHSIFRKVKNPLPVPGTSYVVPKGHHVLVSPGFAMTNENYFPQPEVYNPHRWDEDSTSKAAQDSSTVDYGFGAVSKGVSSPYLP

SEQ ID NO: 20540 - protein, 383 aa, Helicobacter hepaticus ATCC 51449
MKSTLDTLLIHGGATTDPRTGAVNIPIYQTSTYAQSALGEHLGYEYSRTKNPTRDGIESLIAQCEGGKFGFAFASGMAAIGTILSLFQSGDCIIISNNVYGGTFRILDKVFSHFNISYKIVDTRDLKALESAITPEVKAVLIETPANPLLSVTPLEQVAILAKKKGILSIVDNTFMTPYLQKPLELGIDIVMHSATKYLGGHSDLIAGLVVVNDSALAERIGFLQNSIGGVLAPFDSFLLIRGMKTLGVRLQRHCENALFLAQALSEHSGVEKVYYPGLKSDEGYQIQNSQARSGGGMLSFELKKNYDYRIFFKSTQTIVLAESLGGVESLLCHPASMTHASIPKDVRERMGISEHLIRLSVGIEYAQDLLDDLNQAIKKAKV

SEQ ID NO: 20541 - protein, 313 aa, Helicobacter hepaticus ATCC 51449
MLYRSSLELIGHTPLLELTHLNIANNNRIFAKLEFYNPAGGIKDRVALYICQKLKEKGLLHKDSVIIEATAGNTGLGIAFVAQHFGCKAILIVPDKFSIEKQILMRALGAQVINTPKEKGMQGAMDRAQEMLSCTPYALSLNQFENLDNPQAHYLTTAKEIYDDMAKVQANSENGSDALIDYLVCGAGSGGSFSGIVGYLKKQDSRIKGVLCDPVGSIIGGGEEGCANIEGIGNNFIPHTMDISLIDSVQKITDEEAYEGVRMLAKNEGILAGISSGACLIACLKLANEVQNSLIVTLFADDLSRYFSRNLID

SEQ ID NO: 20542 - protein, 452 aa, Helicobacter hepaticus ATCC 51449
MKIDNLCPFLAKIAQCDEHLNAIIYDGQRFTYGDLWAAFKEQLTFLDSIKPSVIGIVGDYDIESVSFLLACIQKKHIIVPFVEHTPEDSLKCQEAQIDYLYTGGKITSIHSPVKKHTLLESLFREHKSGLILFSSGSTGRPKTMVHNLDNLLNVYLSKKTKKMNVLLFLLFDHIGGLNTLFNTLSMNACGVAIKHRKNIDLLCKTLSDYHISLLPASPSLLNLMLLSEAHKKYDLSALKVITYGTEKMPDSLLKRLKSAFPKAHFHQTFGTSEVGITQTKTKENAIKLENIDYKIINNELYLKSKTQTLGYLNADNSVFDNEGYFATGDLVEIIESNGEEYLKIIGRSKEVINVGGEKVLPQEVENILLEMSDIKDCLVYGESNAITGQSVSVKIVLSQTNALLNNIQLKKIIRMYCKDKLAAFKIPTKVEIVESLAMSERFKKLRLIGGGG

SEQ ID NO: 20543 - protein, 503 aa, Helicobacter hepaticus ATCC 51449
MPDFLQRISYFKENIAFICDDKSYTYAALLQSIESKRQSLQIPQGSIVAIVGDYSFAQITYFFALYRKKCIIVPILPRNMDFDVGEFGIEFILQVHNGAIKRVDSQKYELLQSLKDSKQSGLILFSSGSTGKPKAIVHSLDTFLAAYSAKKANPLRVLSVYLPDHIAGIDVVCNTLGGGGTLVIPKQRQPQFILSALKQYEIEILPASPTLLRLLLLSDITKYDLDSLKLVIYGSEPMSEALLASLHQALPHTNFKQGFGTSETNAMKTKNMQEFFKIVNASYKIVNNELFIKSPTQALGYLNADNSVFDEQGYFATGDLVEVREEEGQKYIKIIGRAKEVINVGGEKVLPQEIEGILLKMPYIQDCLVYGESNAITGQSVSAKVVLDAKVLFSNLELKKQIRIFCKDKLAAFKIPTKVEIVESLAMSERFKKLRNVRGGGALNISLFVIILESQVDSKNGTFTFICNTYSQNRKKSSYSPYLKICTNHLFVPSNNYYMQRAG

SEQ ID NO: 20544 - protein, 311 aa, Helicobacter hepaticus ATCC 51449
MKMVILDADTLGACDLSEIKSLGEVVSYGFTLPNERIERSLGAEILITNKVVLDESVLSALPDVKLICITATGMNNVDLDYAAKRGIEVKNVAGYSTTSVAQHTLSMALNLLARLHYYDEYCKSGAWARSKIFVHINGGLREIENLQWGIIGFGSIGQRVARLAQSFGAKVSYYSTSGKNTQSAFTRKELNEILSQSDIISIHAPLNDKTKNLINRTNLPLLKDEAVLINVGRGGIVNEKDIAQILKSKLMYFATDVLESEPMEANHPFLDKTIADKLLITPHVAWAYDKSRERLLTLVAQNIRDFLTQKA

SEQ ID NO: 20545 - protein, 184 aa, Helicobacter hepaticus ATCC 51449
MSEVNDRRNARRSFLKLSALASVAGVSSALGNEGEKVLRKASEAELKEKYPQSQKIKTICTHCSVGCGVIAEVQDGVWVRQEVAQDHPISQGGHCCKGADLIDRARSETRLRYPLQKQNGQWTRLKYDEAMDKIATQLKQIREESGPDAVMFLGSAKCSNEQSYYIRKFAAFFGTNNIDHCARV

SEQ ID NO: 20546 - protein, 1163 aa, Helicobacter hepaticus ATCC 51449
MNKIWKIKGFTFFILIAFINAFMDLGHKITIQNTIYKVYDGSELTLLTSVINALILLPFIFLFSPSGFLADKYPKNVVMRICAWFGLLLSIIIALCYFFGYFWFAFIATLFMAAQSAIYSPAKYGFIKDLVGKDLLAWGNGVIQAVAIVAILAGMSVFSLLFESLYALSDLGFLAQKGEILQSVAPLGFVLIACALIELYLCYTLPTLTQRTQEVFDKEAYLRGSLLKANFKLLTSHRNIWLSVIGIAVFWSISQLLLATFPTYVKMTFAELNTFKVQMIIACSGFGIIIGSIIAGRFSKQYIETGLIPIGAGFICITTMLILSFSSLTSYAVLFFFFGVGGALFIVPLNALIQFHAKEGELGKILAGNNFVQNIAMLLFLLIGTLVSLGNIDVVYLFYFCMIVALCGAIYVVKLLPFSLVRMLVTLAFFQRYRLNVEGFENVPERGGVLLLGNHISFIDWAMVQLALPRKVYFVMERSYYDRWYIRIFLDFFGVIPVSNAGSRKALESIAQKLIQGHMVCIFPEGAISRHGHLNTFKNGFELAAKNVNENQAVILPFYIRGLWGSAFSHSHQGFQERRKSFAKRNITIAFGESLDIHSNAQQVKAKVFELSFSAWKSQCEVLPTLGKAWVDSAKKWGSEVAIIDSLSGSMSYTRMLSLTLILSKLFAEQTKEQQNVGIILPASLASALCNLSLLMATKTIVNLNFTAGQKAIDAAIKSAQIQTIYTSQKFMDKLEGKGVSLNFSQNVRVLYMEDLVDKVKANKLDFVCKMAQAILLPSFMLKWFYIKAQKNTDIAAILFSSGSEGKPKGVMLSHLNIMSNILQISDVIHARDGDSMLSSLPPFHAFGLTVTTLMPLLEGMLSVTHADPTDAVGVAKAIAKNKVSVMCGTSTFLGIYARSNKVDKLMFDSLRLVVAGAEKLKKDVKEAFVMKFNKEIYEGYGATETTPVASVNLPSEFDVDNWELHKASKEGSVGMPLPGSAIRIVEPNTMQEMPVGEDGLILIGGHQVMVGYLNDEEKTKEVIVEIDGIRWYKSGDKGHLDADGFIHIVDRYSRFAKIGGEMVSLGGIEEEIAKLIKKYEIDDGLKYVATAIDDSKKGESVILLVSCEKTECEKIEKIIKEAQIPALFKPSKILRVESIPVLGSGKVDFKGAKDLAQKLLNV

SEQ ID NO: 20547 - protein, 402 aa, Helicobacter hepaticus ATCC 51449
MKETGIELMKNTKSVRDIDVKDKRVLIRVDFNVPMDEDFDISDDTRIREALPTINYCIDNHAQNIVLVSHLGRPKGRNAEFSLKHVLKRVERLLGRDIAFAETIENVENLQQQSKSGSVILLENIRFYEGEEKNDEELSTKLASICDVYINDAFGTSHRAHSSTCGIAKYAKECVAGLLLKKEIDSFAKAMANPLKPVLLIVGGSKVSSKLALLYNILDVVDKIIIGGAMSNTFLKARGFDMQKSLVEDDLVSEARKILDKAKEKKVKIYLPVDVVSTDDIKEHRHIKITPAQDIPEGFMAVDMGPATSKLFSEVVRDSQTIIWNGPLGIYEIQAFSRGTFNLAHAVSDTYAFSLIGGGDTADAIDKAGERDNMSFISTGGGASLELLEGKILPAFEVLERK

SEQ ID NO: 20548 - protein, 250 aa, Helicobacter hepaticus ATCC 51449
MKSTLDTPLLSISHLKKTYDGTHFVLNDISMQVQKGEVIVILGPSGCGKSTFLRCINGLESTQGGEISLSNEIINHPKAKWSKIRQRIGMVFQSYDLFPHMSVMDNVLLGPTKVQKRNKNEVIAQAQTLLERVGLRHKIQASPKELSGGQKQRVAIVRALCMNPEIMLFDEVTASLDPEMVKEVLEVILELANEGMTMLIVTHEMRFAQKVADRICFFDEGKLIEESTPQEFFSAPKSQRAQKFLNVFEL

SEQ ID NO: 20549 - protein, 385 aa, Helicobacter hepaticus ATCC 51449
MLHQFESYPFEKLRTLLAHSSPPSGEEIFSLTIGEPQFPTPTNIIQSWQSNASLLNKYPKSSGEDELKDAQLHFINKRYNLTLTKSQIIPTLGTREVLFNFPQFYLFDLPQPTIAYPNPFYQIYEGAAIASKAQVLLMNLTSENDFTPSLTPKELKKVHLVILNSPNNPTGRILDMQALTEWVKKALEYDFVIINDECYSEIYESSPPPSILQASIQAGNTSFKNIIALNSISKRSSAPGLRSGFIAGDAEILKAYNLYRTYLGCALPLPLQKAAAVAWKDMQTPESIRHIYAKNLALAREILELSTEQISPYTFYVWLKVDNDEAFCKFAYEKKGVLTLPGSYLGRENQGKGYVRIALVYDNNTTKKALLALKEAIKLYKQECQ

SEQ ID NO: 20550 - protein, 231 aa, Helicobacter hepaticus ATCC 51449
MQDVFRQIDWERYELIPTIVQEKQSQQILMLAYSSKQSLELSLQTHLAHYFSRSKQRIWQKGEQSGHIQHIKEVKLDCDNDSLIFIVEQVGVACHTGEKSCFFRIFSLDKNCQNPPVSMPQKYPIGVYHILDDLYHIIEQRRCENIEHSYTASLLAKGVNGIGKKIIEEAGELCFALKDKDEKAIIYECADLFYHILVGLALEHITPERVLQELRRRMGQSGIEEKASRKH

SEQ ID NO: 20551 - protein, 456 aa, Helicobacter hepaticus ATCC 51449
MFDGRVKTLHPKIHGGILYRRDNQSDVGIAQQKGISAIDIVCVNLYPFKQTIEHTDDFEEIIENIDIGGPAMVRSAAKNFASVLIITDKNDYKSVIESLRAGNNTLELRQKMMIKAFSHTASYDAMIAQYMNKCFNNGFGEKVFIVGERVLQTRYGENPHQKGALYEFGSFWKEHFEIKKGEPSFNNLADINAAMKLSISFGKDAKAVSIIKHGNPCGFALKDSLLDSYIHALACDSVSAYGGVVAVNGIVDLPLAQEMNKIFVEVLVAGDITDEALALFEGKKRMKIFTQKTSYLSLPNDNYDFKHIQGGVLFQESDNVLSEEIDNATLVSEVAASKSQKQDLKIAYIIAALTKSNCVAYVKDGSLVGIGMGMTSRVDASRAALAKAKDMNLDLNGCVCASEAFFPFRDSVDMLHQAGVSAIIQPGGSIRDDEVIQACNEYNIAMYFTHTRHFLH

SEQ ID NO: 20552 - protein, 416 aa, Helicobacter hepaticus ATCC 51449
MVAFSLHFQTQHQKVCDTLFESICEERDSQKSGYYDLPFTEVAVDESSCFVNDNKAFLQTLSHLVIIGIGGSSLGLKAIDSMLEHLPHRNKLKLSFLEHTDPISITKSLQGIKRENTLFIVISKSGTTIETSSLLKFVLEEYNLLQNVQSKRHLLVITDRDSPLEHWAKVEKLTYFGIPPNVGGRFSVLSMVGILPLSILGFDTRAILRGAAGITQRFFERKEEHILHKALTYFTHKNHISMNVLFSYSSLFTHFNAWYVQLWGESLGKINAMGERVGLTPIALIGSIDQHSFLQLIVQGVRDKSVTFLSLNPTHSAQPSIPNLQIPFLESTNFVNTQSFATLLNNQRIATMQTIENEGILTDCIEVMSLCEESVGILIAYFEILTSCMGQLFEINTYDQPGVEFGKARLKKLFES

SEQ ID NO: 20553 - protein, 479 aa, Helicobacter hepaticus ATCC 51449
MSRVSIDKQAVAEFFRFCDENEVEFIDFRFSDIKGVWHHLSFSRNAINEESFEGIPFDGSSIPAWQPVDKSDMMLIPEPVRYFIDPFTADTTAVVFCDIWDIYNNKPYEKCPRSIVKRAMKYLKESGIGDIAYYGPENEFFVFDSIKIKDSVNCQYYEIDSEEGEWNRAREFEGGVNMGHRPGTKGGYFPVPPVDSMVDLRAEIVKVLNQVGLETFVLHHEVAQGQNEIGVKFGDMLEAADNVQKLKYVVKMVAHLNGKTATFMPKPLYGDNGSGMHVHISIWKDGHNLFAGEAYQGLSEMALHFLGGVLKHARALAAFTNPSTNSYKRLIPGFEAPSILTYSAQNRSASIRIPYNSGEKAKRMEFRFPDSSANPYLAFASLLLAGIDGIKNKIDPGAPMEINLFELTLDEIREKGIKQLPHTLRHAIEEMLVDKAYLKEGGVFSEEFIQTYKAYKFETEIWPWEARPHPFEFLTTYSC

SEQ ID NO: 20554 - protein, 448 aa, Helicobacter hepaticus ATCC 51449
MAKKTSIFECQFCGWQSAKWLGKCSSCGSWDSLIELKPSQIKITKSLKSNPQNLSNAIPITQVSFENIERFSSFEEELDIVLGGGIVPGGLYLIGGSPGVGKSTLLLKIAGEIAKHIHKKVLYVSGEESAGQIKMRASRLGAISEDLFLLNEIDLNIIQNALDEQQYALCVIDSIQTIYSPDITSAPGSISQVREVTFALMRLAKERNISIFIIGHITKEGSIAGPRILEHMVDCVLYFEGDPSRELRMLRGFKNRFGTTSEIGIFEMKEGGLVSAKNASKLFFTQKSAQAGSAIAVILEGSRALVIEIQALVSESSYPKRSCTGFDTNRLNMLLALLERKLELPLGRYDVFVNVAGGIKINEPSADLAVIASIISSFRNRPLNAKTAFIGEVSLTGDIREVSNIDTRLKELESYGFNKVILAKKPSNPSSTLKCFETNEVSRILEWM

SEQ ID NO: 20555 - protein, 144 aa, Helicobacter hepaticus ATCC 51449
MILSSVYPKECRFFIAQRLDIKDVWQFPQGGIDEGESPRDALFRELREEIGTDEIEIISECPEWIQYDFPKSMSKKKYKGFAGQIQKYFLVRLKNDAAINIKTKEPEFNKYEFVSRKKLLECVTPFKKGVYKQVLEYFKKEGYL

SEQ ID NO: 20556 - protein, 425 aa, Helicobacter hepaticus ATCC 51449
MVYIEAIDAQEVMDSRGNPTVRAAVRLSDGTRAAAIVPSGASTGKREALELRDGDKERYLGKGVLKACANIKTEIAAQLDGVSPYDQSKIDLILKKIDGTENYSELGANATLGVSMAIARASAQSLRLPLYRYLGGSNALTLPTPMLNIINGGSHADNTVDFQEYMIMPLGFDTFAESLRASAEIYHHLKAILKGSGHITSIGDEGGFAPNLKNNEEPIEIILKAIEQAGYKPLDEIAIALDVASSELVDENGMYHLAGEGKVLDSAGMIAYYENLVAKYPIVSIEDGLSEDDWEGWKLLTQKLGNKIQLVGDDLFVTNKKILQEGIEKNIANAILIKPNQIGSVSETMQSVRLAQRNNYKCIMSHRSGESEDTFIADFAVALNTGEIKTGSTARSERIAKYNRLLEIEREISDAEYIGKTLFKR

SEQ ID NO: 20557 - protein, 430 aa, Helicobacter hepaticus ATCC 51449
MANLSHHNLSQDTLALHAGYTYDTQRTISVPIYQNTAYSFESLEQAAARFGLQEIGNIYTRLSNPTTDVLGARLAAVEGGIFGVPTASGSAAIFYAIVNCAQSGDNIVFSNKIYGGTQTLFVHTLKRFGIQTKVFDIDNIESSLESVIDDKTKAIFFESISNPQISIADTEKITAIAKKHKIISICDNTIPTAFLHKPFDYGVDISIYSLSKYINGQGSALGGAIIERYGLNELIKDNPRYEVFNTPDASYHGLIYANLPLPCFSIRLITEWLRNIGATLSPQASWIILQGLETLELRIKKHSQNALKVAEFLQSHPKVQSVAYAGLTSNPYNRLLQKYYKDSQASGLISFEAQSFEEAQKICNATEIFAVVVNIGDSKSLIIHPASTTHSQLNADELSSAGITPCTIRLSIGLESADDLIQDLKKALEK

SEQ ID NO: 20558 - protein, 477 aa, Helicobacter hepaticus ATCC 51449
MTISILCGGSGTRLFPLSRELLPKQFANLLPSKNAQTSSHSLFQETLLRNDFLRKSHKGKFQIITNDNHYFIAQEQAHKINIPLSEFILESLGKNTAPALTFAALKSLESFSLNQNEDDIILALPSDHLIKNTADYEQSIFQAIELAQKGFLVTFGIKPNCPHTGYGYIKAKDSVVEKFIEKPSIKDAKAYVENGNYLWNSGMFCFKAEVFLQELEVHNPEVYKRCKLTFEASKESEAKDFIRLDAKMSENLPDISIDYALMEKSQKVACVSSNFIWNDIGSFESLSNEYPTDEAENASKNTFIQKECKNNFVISDKLVAGIGLEDLMIIDENDCLLIAKKGYSQQVKDIVALLKTTHPELTQIHKTAHRPWGTYTILLESQNYKIKQIVVKPKGKLSLQKHYHRNEHWIIVSGCAIITLGESQKFLKANQSTYIPMGEVHRLENPGILPLVLIEVQMGEYLGEDDIVRLSDDYQRK

SEQ ID NO: 20559 - protein, 481 aa, Helicobacter hepaticus ATCC 51449
MKIKQKALTFEDVLLIPAYSEILPQEVNTQTLLSKNISLNVPLVSAAMDTVTECRTAIAMARLGGIGIIHKNMDIDSQVEQIKRVKKSESGVIIDPIYIRANNTLADAKSITDNYKISGVPVVDEYGKLIGILTNRDMRFEQDLSKYVGDLMTKDSLVTAKVGTTLEEAKEIMHKNRIEKLPIVDENYMLKGLITIKDIQKRIEYPNSCKDSFGRLKVGAAIGVKQFERAQALADAGADVLVLDSAHGHSINVLKTLEKIKSKLTIDIVVGNVVTPQATQDLINAGADAVKVGIGPGSICTTRIVAGVGMPQISAIDDCSQIAQKHKIPIIADGGIKYSGDIAKALAVGASSVMIGSLLAGTEESPGDLIIYQGRQYKIYRGMGSIGAMTRGSSDRYFQEGTAQDKLVPEGVEGRVPYRGKVSDVIHQLIGGLKSSMGYLGSKDIQSLWERAEFVEITSAGLRESHVHDVDITKEAPNYHG

SEQ ID NO: 20560 - protein, 125 aa, Helicobacter hepaticus ATCC 51449
MKLLVVDDSSTMRRIIKNTLQRLGYEDILEAEHGVEAWQIMDTTEGIQVLITDWNMPEMNGLDLVKKVRSDERYTSIPIIMVTTEGGKAEVITALKAGVNNYIVKPFTPQVLKEKLEVVLGVNED

SEQ ID NO: 20561 - protein, 300 aa, Helicobacter hepaticus ATCC 51449
MIAQNITELIGNTPILQLQQFAPNLYGKCEFLNPSHSVKDRPAYAMIDEALKTGKITKDTTIVECTSGNMGISLAMICASLGLKIIITMPESMSIERRKMIALFGANLVLTPASEGMQGALNKAQEILDSTPNSFMPSQFDNLANKEMHKRTTALEIYKSFEGSLDYFVAGFGTGGTISGVGEVLKEKIPSIKIIGVEPAASPLLSKGQAGPHKIQGIGANFIPKILNRDVIDSIEVVENEVAIKMAQNLGKIGVMVGISSGANVAAALEIAKNNPNKKVLTMLNDTAERYLSTDLFNTL

SEQ ID NO: 20562 - protein, 435 aa, Helicobacter hepaticus ATCC 51449
MDILQSINDFNEAKQVIPGGVNSPVRAFGSVGGTPRFIAKGKGAYIYDEDDNEYIDFVQSWGPLIFGHANEVIESALSLAIKDGLSFGAPTEKETTLVKQIIALSGSAEKMRLVNSGTEATMSALRLARAYSNKDDIIKFEGCYHGHSDSLLVSAGSGCATFGTPSSPGVPNDITKHTLVARYNDIESVRACFEQSKNVACVIIEALAGNMGFVPADKKFMQDLRALCDEYNALLIIDEVMSGFRAGLKGAIGLYDVQADLVTYGKVIGGGMPLAAFGGRADIMDMLSPVGGVYQAGTLSGNPIAVSAGLATLLQIKANPTLYEHLEVLAKRLIKGLKEAAQSYEIPLQVDCRGSMFGFFFNQKEVKNFDDAKCSDTAMFARFHQKMLDKGVYFACSQFETGFICSAMNEMIIDEVIMKAKAVFGEITHEIESRI

SEQ ID NO: 20563 - protein, 399 aa, Helicobacter hepaticus ATCC 51449
MDFTHTQALDEEFVLHTYARANVAFVRGENARIFDTQGNDYIDFGAGIGVCSVGHANAKLAQTIYKQAQTLLHTSNLYYIQPQARLAQEIITLYRYNTPYTAPMRAFFCNSGAEANECAIKIARKYGKPRNAYKIITLDSSFHGRTIASLKATAQEKMHQHFGPFPDGFVYAKNLDDVIAKIDDSTCAVLLELVQGEGGVLPMDKEKINTLSTILKQKQILLMVDEVQSGVFRSGEIFASKVYEIDPDVITTAKGLAGGVPIGAVLTKLTDIFEYGDHGSTFGGNFLSCAAGLETLAILNELYNNGTLQRTITLFHAELDALVVDFADIFSHKVGLGLMCGLYTRNPDMQQEIIAQALKHYVIVLKSGKGVVRFLPPLTITQEEIKEGFARVRNALKTL

SEQ ID NO: 20564 - protein, 268 aa, Helicobacter hepaticus ATCC 51449
MSIIKVRELYTQYGDVIIHNGISFDVKKGEIFGILGGSGSGKSTLLKNMLFLEKPTSGKIEFFGENIWALPEDKRGRILNRCGVMFQFGALFSSMNVLDNVAFLLTQKSHYDTLTINRISKMWLELVGLSKEVAYKYPYELSGGMKKRVALARALALSPDILFLDEPTSGLDLQSSERFDTLIIKLKEVLKITIVMVTHDLDSIKDSVDRLILLEDKHIVFEGTLSELYHQKQQGDNQAKIFSGQRGIRFWQSFEENISKGDNKWNAM

SEQ ID NO: 20565 - protein, 363 aa, Helicobacter hepaticus ATCC 51449
MLLKENLTQAQSGQRITAKGYAVAHKSDTFKPFSFSRHALGETDILIEILYAGICHSDIHSAREEWHKGIFPMVPGHEIAGKVVAVGSKVSKFKVGDYAGVGCMVNSCGECEACKRSQEQFCENGKCVFTYDCHDCFHDNEPTYGGYSNNIVVSEKFAVNVPQDAPLEKVAPLLCAGITTYSPIKFSNVKAGDKVAVAGFGGLGVMALKYAIKMGAEVSVFARNKNKEKEALDLGAKALYTDTKGVSERFDFIISTIPTAYDVNAYAELLKFGGEMAIVGLPPADEKLSIDLTRLVFAAGKKVYGSLIGGIKETQEMLDFSLKHRIYPETEVISVEQINEAYENLTSGKAKFRYVIDMSSLKE

SEQ ID NO: 20566 - protein, 490 aa, Helicobacter hepaticus ATCC 51449
MKTILVITDGIGYSDKTQYNAFYHAKKPTYDYLFKNVPYGMIDTFGLSVGLPQGQMGNSEVGHMCIGSGRVLYQDLVRISRAIEYDEIKDNPALVEVTQQSAVVHLCGLLSDGGVHSHIVHLKALAQILSTQGKRVYLHLITDGRDVLPKSALNYLADIESICEDNVSIASVSGRFYAMDRDKRWDRVQKAYESIALGKNPTNLSPKEYIQSQYDEGIFDEFLTPVSFGGFQGMNDDESFVFVNFRSDRAREIVDCLGNPQFKEFKRERYVKLHIATMTEYDATFPYPILFPKQNVQNTLAEVISSHRLKQFHTAETEKYAHVTFFLNGGREEAFIGEERVLIPSPNVKTYDLQPQMNASAVGDAVIKAVEQGYDFVVVNFANGDMVGHTGNLEAAIKAVEAVDKELGRIVESAQKHHYALFITSDHGNCEEMKDEKGNMLTNHTVGQVWCFGMIEGVSKIENGGLNNIAPSVLKAMNLPIPPEMDKPLF

SEQ ID NO: 20567 - protein, 437 aa, Helicobacter hepaticus ATCC 51449
MLDLKALDLAHIWHPCTQMKDHETLPLIPIKSAKGVYLYDFEGKAFIDGISSWWVNLFGHCNPFINAAITKQLQQLEHIILAGFSHEGIIRYSEKLCALLPQSLQKCFYADNGSSAIEVALKMSFHSHYNAGNKDKNAFLSLSNAYHGETLGALSVGDVALYKSTYQPLLLECLSAPVPRGIWNPDDGTISGDYHMELEALEEILKHHAHRICAFILEPLLQCAGGMNMYPAAYIKEACALARKHNIHIIFDEIAVGFGRTGSMFALEQCDVTPDFLCLSKGITGGYLPLSVVVTSNNIYEGFYAPYEEQKAFLHSHSYTGNALAIAAANAVLDIFEQDDIIFSNHSLSVAIVKRWSMLAKHKKVGNLRVCGMVFAFDLQGCKLKRAGLYVYENALAKGVLLRPLGNTIYFMPPYVINLEIAEYVCNVLDAILEDDF

SEQ ID NO: 20568 - protein, 292 aa, Helicobacter hepaticus ATCC 51449
MGLSDLFKAKKEENKETGTKIDAPNHWLKCPSCNAMMYYKEVFSQSHICPKCNYHFRISAQERIEMLCDKDTFIEIDKDLRPIDPLEFVDKKSYKKRIQESEEKTGRASSVIAGEALVGGIEMQLVLFDFAFMGGSLGSVEGEKIVRAIDRAVAKKQTLVILSTSGGARMQESTFSLMQMAKTSAALNKLSEAKLPFISVLLDPTFGGVSASFAFLGDIIIAEPGAIIGFAGPRVIKQTIGADLPEGFQTAEFLLEHGLIDMVVHRKDLKQTLSDISKMLNPNYANQHLFYS

SEQ ID NO: 20569 - protein, 235 aa, Helicobacter hepaticus ATCC 51449
MTIIAGNFKANLTRIQVATFAKELDSILTDMQTSSHLQVDIFPSHTALLTNNFKHFHIGAQNAYFAQNGGFTGEIGLSQLQEFNINRLIIGHSERRTLFGENQDFINKKFRFYAEAGFEIYYCIGEPLSMRQKGKNALKDFLGAQLDGIDITYPKLIIAYEPIWAIGTGESATLEQIESTHSMLATFTSAPLLYGGSVNPTNAREILCTPYVNGVLVGSASLNIQSFTDIIRASK

SEQ ID NO: 20570 - protein, 216 aa, Helicobacter hepaticus ATCC 51449
MNKDILVAPSMLSADFAKLGQEVEDICKAGCDFVHIDVMDGHFVPNLTMGPMIVQSIAKSSSKPLDIHLMVKNVPFFVDLFLPLKPAFMSVHIEEVQHLHRLIWYIKESGVKAGVVLNPHTNEQSLEYILPDIDLVLLMSVNPGFGGQSFIPHSVKKLQNLKKMRDRLNPSCLLEIDGGVSDKNIDILKNAGIDIVVAGSFIFGSTDYAQAISALR

SEQ ID NO: 20571 - protein, 267 aa, Helicobacter hepaticus ATCC 51449
MSAQPKPQLMGHIIAGYPSFESSLYAALGICQAGASYLEVQFPFSDPNADGRVIEEACNKSIAQGFKVAQGFKLLHTLSQHINQDNKQPTRLIIMTYANLIFHYGIEAFIKEAKKCGVWGIIAPDLPIESDESLRILAKKHHIRIISLIAPKVSISRIKKIAKISDEIVYVVARAGITGEKTHIDKALFEWIRLIQKHCKKPIALGFGINSYEQVAALKDKVDIIVAGSYFVRFISELSTQSQLSPQDYMHKLQAHAQMLMGWDINE

SEQ ID NO: 20572 - protein, 386 aa, Helicobacter hepaticus ATCC 51449
MKEKSAKASRREFLKTSAALATMAFFSSSAFAKDSKESTQARKESTNTKNRVILQRKIGDFKVSAIGLGCMGMSANHGPTRDKKEMIKLLHKAVDLGYTFFDTAEVYGPHTNEELLGEALKGYKDKIVINTKFGFYYPFGKQQLDSSRKSIMRAVDGSLKRLKRDCIDLYTQHRVDIDTPIEEVAGTMKDLVKMGKIKAWALGEAGIKTIERAHKVFAPVAMQSQYSMAFRELEQNGIMDTCQKLGITIVAYSPLDRGFLGGSFNKNTTFHKTLDFRASMPRYTKEALEANQSVIEFIKKVAQSKSINGKPASVAQVALAWILSNKSFVIPIPETTKIHRLEENLNASLLHFSLNELKEINKELSKIVIIGDRYAPNSDAAKSVGL

SEQ ID NO: 20573 - protein, 365 aa, Helicobacter hepaticus ATCC 51449
MPQIPQDTILQTLRNEIDSIDSEIFDALQKRMALVAQVGAHKTKQGGAIYRPEREREIIERLSQRESKYLNERAIEAIYQEIFAISRNLELPEKVAFLGPVGSYTHQAAEERFGAMSKYIPLNTISAVFESLAYKRVKYGVIPLENNTNGMVGESIDFLAYYDFKIIAEIILPIHHSFLSSCEHLSEVKKIFSKDIAFGQCQKFLHAHNLHHIEQIPTDSTARAVQLAASNPQSAAIGSKIAGKLYNLPLMFEHIEDSQNNKTRFVIVSDFANAPSGKDKTSLFVNLKNDDQVGTLFRLLGDFEKEGINLTKIDSRPIRSNESFKTGFFIDCEGHYLDKPLQRLFAKRSDEIKWLGSYIFTDIKK

SEQ ID NO: 20574 - protein, 385 aa, Helicobacter hepaticus ATCC 51449
METFDYYEILEITRTSDKETIKKAYRKMALKYHPDRNPDDKDAEEQFKRVNEAYEVLSDDSKRQIYDKYGKEGLQNSGFSGFSGRDFSDIFGDLGSIFESAFGANFGFSTQKRGGGKYNLDEIVGLELSFTEAVFGCKKEIHNSFKIACSDCKGTGAKGGKLNTCKDCGGKGQVYMRQGFMTFAQTCPTCKGEGQSASEKCSKCKGSGFEISEESFEVSIPEGIDDGNRIRIGGRGNADKNGSRGDLYIAVSVAEDENFVRDGENVYIEVPVFFTSIVLGTTLKIPSLRGELELKIPPNTRDKEQFVFDNEGIKDVNSAYRGKFVAQIKITYPPKLNAEQRALTEKLQESFGIESEPYKNVFEECFTKVKQWLHKHSKNDKDTTK

SEQ ID NO: 20575 - protein, 402 aa, Helicobacter hepaticus ATCC 51449
MFDEIEFDKIKRLPKYVFAAINEIKLEMRRNNEDVIDFSMGNPDGATPEHIIQKLCEAAQKGKNQGYSVSRGIYKLRLAICNWYKRTYGVELDPESEACVTMGSKEGYVHLVQAIANPGDNAIVAEPAYPIHYYAFILNGANVSTFGLKWNEQMELDVEDFFINIKRVLKEVMPRPKFVVVNFPHNPTTIVVYREFYERLVAFAKQERFYIISDIAYAELCFDGFKTPSILEIEGAKDVAVESYTLSKTYNMAGWRVGFVVGNKKIIQALQKIKSWIDYGIYTPLQIAATIALEGDQSCVKDIKNTYEKRMEILIKSFGEAGWEMKKPKASMFIWAKLPECVGDMGSLEFSKRLLKEAKIAVSPGVGFGDYGEGYVRIALIENEKRIRQAARNLKSFLKQFQ

SEQ ID NO: 20576 - protein, 477 aa, Helicobacter hepaticus ATCC 51449
MKNIYQSTIFLDKRACEKYHLTPEILMENAACALESLINSLTHKGSVITILCGSGDNGGDGYALARRLSGDYSIRIFQVKEPKSPLCIQAYERACECGIKFIKKILPCDVVVDCVVGSGLKGSLEREASEILSLANKNARLCIACDIPSGLSDKDEGFVFKADYTLCMGAIKLVCLSDRAKDYVGELYIGKLGLSGNHYEVTSNLKMLESSDLALPQRINKNVHKGDFGHLAVFVGEKSGAGILSAQSALHFGAGLVSIISQKDLQIPFDIMQTHTLPHNTTAIALGMGLGVKNVAQILQNLQESTLPCILDADVFHTPMIKNFLDKSLNQQTLDFSREIILTPHPKEFEALLKHCDLGDYNPQKRIDSMLSFTQKYPHTTLVLKGANVFIAKAQDIYINPLGINALAKGGSGDVLSGLIGALLAQGYNGLDSALQGSLAHTLAAREATKHIANYALTPSMLLESITTLQSHKRIHK

SEQ ID NO: 20577 - protein, 330 aa, Streptomyces toyocaensis
MTHSEKAHIAVYGCGPDEAVLFRELAPGLGVQPVITDAPVSEANSELALGSRCVSISHKTPVTHATLRALGRVGVGYISTRSIGYNHIDVEYADSIGIVVENVSYSPDSVADYTLMLMLMVLRDAKAIVRRTDMHDYRLSEVRGKELRDLTVGVVGTGRIGTAVLDRLRGFGCRVLAHDNHPADRPGVAEYVPLDELLRRSDVVTLHAPLTTATHHLLDQQRLARMKDGALVINTGRGGLIDTEALVHELESGRLGGAALDVVEGEEGIFYADCRDRPMESKALLRLQELPNALITPHTAYYTDHALRDTVENSLTNCLTFRKQESAWPD

SEQ ID NO: 20578 - protein, 483 aa, Acinetobacter sp. ADP1
MQHVQLLIDGQSVDAANQATFERISPIDGHVASVAAAATLEDVDRALESASRAFQIWSKVSPTERRLRLLKAADLMDQNTEKFIEIGMRETGSTATWYGFNVHLAANMLREAAAMTTQIDGSLIPSDVPGNLAMGIRVPCGVVVGIAPWNAPVILPTRALAMPLACGNTVVLKASEACPATHRLIGAILNEAGLGEGVVNVITHAPQDAPQVVERLIEHPAVKRINFTGSTKVGKIIAETAAKHLKPVLLELGGKAPVVILNDADLDEAVNAVAFGAFFNQGQICMSTERVLVQDGIADRFIEKLIQKTASLKAGNPTQQGSMLGVLESRRAAERIQHLLEDAQQKGANLPLGIQIQDTLMQPTLVLDIQPEMLLYREESFGPVCTVQRFASIEDGVRLANDSEFGLSSAVFSQNFGLAMDVAKQIDSGICHINGATVHDEAQMPFGGTKSSGYGRFGSKASIAEFTELRWITVQTQPRHYPI

SEQ ID NO: 20579 - protein, 304 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDQDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELE

SEQ ID NO: 20580 - protein, 314 aa, Capsicum annuum
MGSKYSKATNSINDALNSSYLVPFESYRFPLVDLEEATNNFDGKGGFGKVYRGVLRDGTKVALKRHNRDSGQSIEPFRTEIEILSRRSHPHLVSLIGFCDERNEMILIYDYMENGNLKSHLYGSDLPTMSWEQRLEICIGAARGLHYLHTSAVIHRDVKSTNILLDENFVAKITDFGISKKGTELDQTHVSTDVKGTFGYLDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 20581 - protein, 321 aa, Capsicum annuum
MGSKYSKATNSINDALSSSYLVPFESYRVPLVDLEEATNNFDHKFLIGHGVFGKVYKGVLRDGAKVALKRRTPESSQGIEEFETEIETLSFCRYPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSIGDVLWKLEYALRLQESVI

SEQ ID NO: 20582 - protein, 314 aa, Capsicum annuum
MGSKYSKATNSINDALNPSYLVPFESYRFPLVDLEEATNNFDGKGGFGKVYRGVLRDGTKVALKRHNRDSGQSIEPFRTEIEILSHRSHPHLVSLIGFCDERNEMILIYDYMENGNLKSHLYGSDLPTMSWEQRLEICIGAARGLHYLHTSAVIHRDVKSTNILLDENFVAKITDFGISKKGTELDQTHVSTDVKGTFGYLDPEYFIKGRLTEKSDVYSFGVVLFEVFCARSAIVQSLPREMVNLAAWAVESHNNGQLEQIIDPNLAAKIRPESLGKFGETAVKCLAPSSEDRPSMGDVLWKLEYALRLQESVI

SEQ ID NO: 20583 - protein, 321 aa, Capsicum annuum
MGSKYSKATNSINDALSSGYLVPFESYRVPLVDLEEATNNFDHKFLIGHGVFGKVYKGVLRDGAKVALKRRTPESSQGIEEFETEIETLSFCRYPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYTLRLQESVI

SEQ ID NO: 20584 - protein, 330 aa, Oryza sativa (japonica cultivar-group)
MVISSKGKVCVTGASGFVASWLIKRLLEAGYHVIGTVRDPSNRDKVSHLWRLPSAKERLQLVRADLMEEGSFDDAVMACEGVFHTASPVLAKSDSNCKEEMLVPAINGTLNVLKSCKKNPFLKRVVLTSSSSTVRIRDESKHPEISLDETIWSSVALCEKLQLWYALAKISAEKAAWEFAKENNIDLVTVLPSFVIGPSLSHELSVTASDILGLLQGDTDRFISYGRMGYVHIDDVASCHILVYEAPQATGRYLCNSVVLDNNELVALLAKQFPIFPIPRSLRNPYEKQSYELNTSKIQQLGFKFKGVQEMFGDCVESLKDQGHLLECPL

SEQ ID NO: 20585 - protein, 510 aa, Vibrio vulnificus
MSAKKPLALVILDGYGYREDTASNAIANAKTPVMDALIANQPNTLISASGMDVGLPDGQMGNSEVGHTNIGAGRVVYQDLTRITKSILDGEFQQTAALVEAIDTAVKAEKAVHIMGLMSPGGVHSHEDHILAAVEMAAERGAEKIYLHCFLDGRDTPPRSAEGSLQRFQDLFAKLGKGRVASLVGRYYAMDRDNNWDRVQVAYDLLTQAKADFTYDSAVAGLAAAYERGENDEFVKATEIKAEGQESAAMQDGDAVIFMNYRADRARQITRTFVADFAGFERAVFPAVNFVMLTQYAADIPLAIAFPPASLENTYGEWLSKQGQTQLRISETEKYAHVTFFFNGGVETEFAGEERQLVASPKVATYDLQPEMSSTELTEKMVAAIKSGKYDTIICNYPNADMVGHTGVYEAAEKAIEALDASVGQVVEAIKEVGGQLLITADHGNAEMMVDPETGGIHTAHTSLPVPLIYVGDKAVEFKEGGKLSDLAPTMLSLAGLEIPAEMTGQVLVK

SEQ ID NO: 20586 - protein, 231 aa, Griffithsia japonica
MAHSSTLEFPPGFMWGTATAAYQVEGSSTADGRLNSIWDRFSATPGKVHNGDTGNDACNHYTLFREDVARIADLGTSHYRFSIAWPRIHAWQILPDGAVELRENERGVAFYNALIDELVARGVAPVATLYHWDLPSPPRRCTGGWAGDPALAHAFARYARACFAAFGDRVKRWAPSTSPWCSLLAYENGEHAPGTRRASVKGTGPGTPFWLGRARLHVTNQSSRAPRGACG

SEQ ID NO: 20587 - protein, 187 aa, Griffithsia japonica
ARGRKVISDNVYGSMFDAIGNTPLIRLARASRETGCEVYGKAEFMNPGGSIKARAALYLIKDAEDRGLLTPGKPGIVVESSGGNTGISLAEIATARGYKSICVIPDDQSKDKKDMLRQAGATLVEVPRVPYTNPNNYIRLGRRIAANLGAVYSNQFDNTANRQAHVVSPAPEIWAQTGGKMDGFPAR

SEQ ID NO: 20588 - protein, 157 aa, Griffithsia japonica
MSATKLSDLQGLKDIEGGAIDPSRFAGKVVFAMNVASACGYTKPGYELLKRLTDKFAPADFVAVAIPCNSFLWQESGSAEDVKTFALARADKLLVTEKAAVNGNHPHPIVALAKQAFPGRVMWNFDGRFVFDRNGVPVARFGNSAKPEEIEAAIANA

SEQ ID NO: 20589 - protein, 217 aa, Griffithsia japonica
GTRARHVGLAHTRWATHGAPTTSNCHPHTSDPDSQFVVVHNGIITNYRPLKEMLMTKGFHFDSDTDTEVIAKLLKYLYTTIRENQRPLTFPRLVMHLMHEIEGAYALLLRSTAFPNELVACKVGSPLVLGLKPSHRAEIIVQKGTIRKSEVPSTSSPNTTSHSNAHSHFPKMEADPTEVQYYLSSDASAIIEHTDKVVYFEDNDLVHVGATGRLGNV

SEQ ID NO: 20590 - protein, 190 aa, Griffithsia japonica
ARGTGGVYATAERCAVTTTLAGATGGVVTLIVIKIRDHIFDLLACLNGILAGLVAITACCAFVDPWAAVVIGAIGAVVYIGAAMLLLKFQIDDPLEAFPIHGASGAWGCLAGTLFNKQGHQVTAGFTDQIWGLFYGGGGRLLGVNALGMVVITVWTVGLVTPLFLVMKFTGILRISPEEEIIGNDVSKHG

SEQ ID NO: 20591 - protein, 171 aa, Escherichia coli
TQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKE

SEQ ID NO: 20592 - protein, 477 aa, Nicotiana benthamiana
MEPLMKIWSFDLVAWRAFLFSALILNFVFACQFLFLQPLVSALDTKPGDAAALFERVSQNVKVKKYSEALNDLNSAIEADPALSEAYWHRASLLRQLCRYEESERSYKRFLEMKPGDSAAEKELSQLHQSKSAFDSATNLLDTGDIKRALEYIDKVVLVFSPACSKAKLLRRSYCSQIKIIPVTYLRRDTYLKKMRIIWRLYCYEAVPTTIWLIMMSPKALPKRSSVRPRAWELKKAYLLEKLTEKTKSAEDNASKGKLRLAVEEYKATLTMDPNHSAHNVNLHLGLCKVLVKLGRGKDAISSCSEALELDGELIDALVQRGEAKLLTEDWEGAVADLKEAAEKSPQDRNIREALMRAERSFKLSQRKDWYKILGVSKTASVSEIKKAYKKLALQWHPDKNVENREEAENKFREIAAAYEILGDEEKRTRYDQGEDIEDMDSGMGGGGFNPFGGGGQQYTFHFEGGFPGGGFGGFHF

SEQ ID NO: 20593 - protein, 495 aa, Pirellula sp. 1
MSVATQHTLLPEVQSFLDQSPLASFVGGKHYPSEQGNVLATIDPGSGDQLAEIHDLNAAEIDRAVEIANEAFPAWAGLSQQERSSILLKLADAVESHKAIIAQIEALDAGKIEAQAAGDVQNFVDTMRYFVGLSDKVEKRTKLDVPGHDAYTVKQPWGACAFIFPWNFPFLLIGWGISPALAAGNTVVIKPAEDTSLSAIYLAQLAKEVGVPDGVINVVTGRGATAGAALTNNAEIKRMSFTGSPEVGRLVGESCGRNLVPVKLELGGKGAAVVFDDVDVKATAQALVGAITFHTGQVCCDATRWLIHENIYDEFVAECKQLMEKVRIGHPLDPNSDMGPVVNPKQRERVLGYQEKGTAGGAQCLCGGGPATVDGLNGNYVKPTLLAGSLDNVAAREEIFGPVAYLAKFSDEADAIAKANDTDYGLANSVWTTDVERANRVAESMIAGNSWINAHNVFAHGVPYGGVKKSGMGGGVLSPETLMDYYRSTSVVRPL

SEQ ID NO: 20594 - protein, 467 aa, Pirellula sp. 1
MISALKEVLRVAVPLMVSTGMFSLVLFVDRTLLLWHEPSQMGAAMAAGNLFWVSVCVFVGIASMTSAIISQYIGADQPKRVGQLLWQATWFSAATLPWFVLVGSFGESLFRLTDQPEHLIPMQAAYFRILMWGGAGEVLQTALSGFYSGTHRTRTIMLVSLASGVLNLLLDLVLIFGVGSADPETGLRFLELGIAGAAIASTLSFWFKAVCYAVLLMKPIERERYGILRGIRLNRRMMKRLIYFGLPAGLMYVTEAGGFTVIVLQIGRLGDVPLQATTMAINFNMIAFIPLVGMSIAASVLVGQHLIRTGPGPAIRCVIAALVVGWAYSLAWAIAYVFAPGGLIALYSLSPTGVDSEVAFEIAEKLLGFVAIYVILDATQLILAGALRGAGDTWFVLLAGLFVSAVAVVVGTVWQPVAARFQDPDGQAAALVALDWWWWVITGWVCTLAIVMAGRFLQGKWQRMRMV

SEQ ID NO: 20595 - protein, 192 aa, Pirellula sp. 1
MSRFLLLTLALGCLMNAPQPVSAADSTADHECVLAHEAKTIEGKEVDLHDYEGKVVLIVNVASKCGYTKQYAGLQSLYEAHKDDGLVILGFPCNQFGSQEPGTNADILEFCSARYNVTFPMMGKVDVNGDDASPLYKQLTSVEAKPAGKGPISWNFEKFLIGRDGQVVGRYKSKVAPSDEELVSAIKSALKG

SEQ ID NO: 20596 - protein, 474 aa, Pirellula sp. 1
MKTARHELVILGGGPAGYVAAIRAAQLGIDVACIDDNPRFGGTCVRVGCIPSKALLESSHLYEEAQHKFADHGLNVSNVEVDLDVMMKRKEKIVESLTGGIDMLFDRRGVTAYHGRGRLRDVDSIEITPSEGAAEDQPTLVTADQIMLCPGSVPAQLPFVEEDGDRIGNSTTALSFPEVPEELVVIGGGYIGLELGSVWNRLGSNVIVLEAFDRIMPGLDKEMATLAHRSFKKQGMDIRTGTFVASAKVDPKPGDKKPCVIKIKNGETIRCDRVLLATGRAPATKSMGLEEAGVKLDERGFIQVNHQFETSVTGIYAIGDCIGGAMLAHKAMEEGIVCVEQMAGIASEMNYEVIPAIVFTHPEIAMVGKTEEELKEAGIEYNKGVCPLGANGRARTLGDIDGRVKILADAATDRVLGVHIIGPRAGDMIAEAAAAMEFGASSEDIARTCHAHPTLSEAVHEAALAIDDRAIHTA

SEQ ID NO: 20597 - protein, 492 aa, Pirellula sp. 1
MSGDCDFGLIGLAVMGENLALNVESRGYKVAVYNRTTSKVDALMEGRAKGKNFVGCHSIEEFVKSVKRPRRLMMLVKAGPAVDALIEQLLPHCEPGDIIIDGGNEYYVHTERRTKQVEEAGMLYVGCGVSGGEEGALKGPSLMPGGSAEAWPHIKEMFQSIAAKVGPNNDIPCCEWLGAGGAGNYVKMVHNGIEYGDMQLICEAYQLLKELGGLSNDELYDVFDEWNRGDLQSYLIEISRDIFSVKDDQGGDGYLVDKIMDVAGAKGTGKWMSQLALDLGVPSTLVTTAVFARGLSAQKEARTRASKTLNGPAESSNPEMRAIAQSLVGDRAEFVEAVRQALYASKIVSYAQGFVQLQAASAEHNWGLDYGAAALLWRGGCIIRAQFLDRIKEAFDADPNLENLLLAKYFEDAVENAQEKWRKVVAIASIMGIPVPAFSTALCYYDGYRMERLPANMLQAQRDYFGAHTYQRVDKEGTFHSEWIQLRKEPKA

SEQ ID NO: 20598 - protein, 349 aa, Pirellula sp. 1
MLLSQPSMNQLSSRVCNGVLDAIGGTPLVRLNRFLDRPDIELIVKWEAANPGGSAKDRPAAKMLSEALKRGEIGPETTIVESTSGNMGIGLAQVCRYHGLKFICVVDPRAQKQNLSIIEALGGTIELVTQPLKGDFLAARIAKVCELIETTPNSYWPNQYANTDNPRSHFKGTIREIDETLNGEFDVLFVATSSTGTAQGCRDFLKSRGRDVQVVAVDSVGSVLFGGSSGPRKIPGLGAGKEPRLAAGQSFDHLVRVSDLECVVGCRRAAQREAMLIGGSAGGVLMSVGRMQEQFAGKRCVAVLHDSGTRYLETVFSDEWVSESLGCTSEELNYLVGSSSFEFFEGVSA

SEQ ID NO: 20599 - protein, 451 aa, Pirellula sp. 1
MSSEHFDLVVLGTGPSGGTVATKIAKAGKRVALVDSRTFGGVCALRGCNPKKVYVNAGQLVDQIHRGDGKLISDASVKIDWKQLHAFKMEFTQPVAEKKEQSFQEDGIETFHGVARFVSPDTIDVVGTKLTADRFLIGTGGRPRELSFDGAEHVTRSDEFLELESMPEHVVFIGGGYISMEFAGVVARAGSRVTVIEMNNQILSGFDPDLVNQLTDSLREHGIRFQMNAEIIGIDKSADGHLQVHLANEQSPIVCGLVVHGAGRVPNIDELCLSQGEIEHGEKGIAVNQFMQNPTNPRVFATGDCADNGMPRLTPVANEDARIAAKNLFSETLERTPDYGQVPKVAFTIPSIASVGLSEEAARDSNDNLTVLSDDISSWGSVRKTGPTVAGYKILIDSKTDAILGAHLLGPSAEETISLFALAMKFNLTATDMKSTLFAFPTFASDVRSML

SEQ ID NO: 20600 - protein, 315 aa, Pirellula sp. 1
MPTEKHFGPQGWTPDRIGSLQGKTYVITGANAGAGFEATRALLSKGAKVVMMNRNADKSAAAIETLKREFGRDADVTFVRLDLAVLDSVREAASELLDTVPQIDALICNAAIAQVAKQEITVDGFESQLGVNHFGHFLLCGLLFDWIEQSHGRIVVVGSNAYKMGLKKIQFEDLNFDKNYTAWNAYAQSKLAQMMFAYELQRRVEASSKHVQVRVCHPGASRTNLLNDTASLPMKMLWKVISPFIAQSAERGSWPEVMCATEDGLKPQALYGPTKRAETVGPVGECPLEPLALNQEAATQLWSVSEQKVALTWSP

SEQ ID NO: 20601 - protein, 498 aa, Pirellula sp. 1
MSSISAFTTQELSGGPTGFRFAWLTMVLLVGMMGIGGSLASVASAQDEPAAATDTAEVADAGDADSEEPAADAGVGYAFDNGFLFLCAVLVLFMQAGFAMVEVGLNSSKNTVNILSKNLMDLSVGALLFFFVGFGLMYPGSYGDVTNGYFAFGGTGIYDSSPDQTFSPQVDWFFQAVFAATAATIVSGAVAGRMKFNAYLIYSAILTGLIYPISGFWKWGGGWLMQFGEQAADGSFAMGFQDFAGSAVVHAVGGFAGLAGAIFLGPRLGRYTAEGKSVPLPGHNVAFAALGVFILWVGWYGFNPGSQLAFQSSADIDATVFIAVNTTLAAAAGVIVATAVSWGLFGKPDLTMGLNGALGGLVGITACCDAMSNSMSIVVGAVAGALVVLSIVVLDKVKIDDPVGAFPVHGVCGVWGCMALGILPNAHLESESTNFMIQLIGTASICAWAFISMSVVFGVLKAVGMLRVSPQEEQAGLDISEHGMHAYPSDAVAGGSVI

SEQ ID NO: 20602 - protein, 168 aa, Calycanthus floridus var. glaucus
MPRSRINGNFIDKTSSIVANILLRIIPTTSGEKEAFTYYRDGMSAQSEGNYAEALQNYYEATRLEIDPYDRSYILYNIGLIHTSNGEHTKALEYYFRAIERNPFLPQAFNNMAVICHYRGEQAIRQGDSEIAEAWSDQAAEYWKQAIALTPGNYIEAHNWLKIARRFE

SEQ ID NO: 20603 - protein, 475 aa, Calycanthus floridus var. glaucus
MSPKTETKAGVGFKAGVKDYKLTYYTPDYETKDTDILAAFRVTPQPGVPAEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYTKTFLGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSMPGVLPVASGGIHVWHMPALTEIFGDDSVLQFGGGTLGHPWGNAPGAVANRVALEACVQARNEGRNLAREGNEIIREASKWSPELAAACEVWKEIKFEFEAMDTL

SEQ ID NO: 20604 - protein, 505 aa, Calycanthus floridus var. glaucus
MGKWWFNSIEGLEHRCGLSKSMDSLGYLIGNTSGSEDPTLNDTNKNIPSWGHSGSYSCNNVDHFFSVRDIWSFISDGTFLVRDNNGNCYSVYLDIENQVFEIDNDSSFLSELESSFSSYMNSSYLNSGSKSDNRYYDRYTYDIKYSWNNHINSCIDSYLRSEINIDSYISSGSDNYRDSYIYSYICSGESVSNSKSGSSSIRTGGNSSDFNRRGRSNDFDLNKKYRHLWVQCENCYGLNYKKFVSFKMHICEQCGYHLKMSSSERIELSIDSGTWDPMDEDMVSMDPIQFHSEEEPYRDRIDSYQRKTGLTEAVQTGIGQLNGIPVAIGVMDFQFMGGSMGSVVGEKITRLIEYATNRSLPVIMVCASGGARMQEGSLSLMQMAKISSASYDYQLNKKLFYVSILTSPTTGGVTASFGMLGDIIIAEPNAYIAFAGKRVIEQTLNKTVPDGSQAAEYSFHKGLFDPIVPRNPLKGVLNELFRLHGFFPLNQNSSRALGSVICSEL

SEQ ID NO: 20605 - protein, 263 aa, Triticum aestivum
  misc_feature (246)..(246): Xaa can be any naturally occurring amino acid
RGKIIRLHILTDGRDVLDGSSVGFVETIENDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMXALEIAERTRDAILSGKV

SEQ ID NO: 20606 - protein, 333 aa, Lilium davidii
MSKARVYTDVNVIRPKEYWDYEALTVQWGDQDDYEVVRKVGRGKYSEVFEGINVSSNERCIIKILKPVKKKKIKREIKILQNLCGGPNIVKLLDIVRDQHSKTPSLIFEYVNSTDFKILYPTLTDYDIRYYIYELLKALDYCHSLGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGADELNTYLNKYRLELDPQLDALVGRHSRKPWSKFINADNQHLVSPEAIDFLDKLLRYDHQDRLTAREAMTHPYFLQVRAAENSRTRPQ

SEQ ID NO: 20607 - protein, 154 aa, Griffithsia japonica
HEARLHPRLYTPHTHHTSFLSRANQPPPHTMSGKVKKTSQSRSSKAGLQFPVGRIDRFLRKGGYADRVGAGAPVYMAAVMEYLTAEVLELAGNAARDNKKSRIIPRHIQLAVRNDEELNKLLGGVTIASGGVLPNIHQVLMPRKKSKGDASQEV

SEQ ID NO: 20608 - protein, 124 aa, Griffithsia japonica
MSAKVKKASQSRSSKAGLQFPVGRIDRFLRKGGYADRVGAGAPVYMAAVMEYLTAEVLELAGNAARDNKKSRIIPRHIQLAVRNDEELNKLLGGVTIASGGVLPNIHQVLMPRKKTKGDASQEV

SEQ ID NO: 20609 - protein, 109 aa, Griffithsia japonica
RFTRALLNLVTRNPDGRRRALLCGGGVANFSDIAATLAGVQQALTDFHGKLQVAKVKVFVRRGGPNYKTGLQLMRDLGNSLDIPIDVYGPETNMTSIVALAIKWIEEGV

SEQ ID NO: 20610 - protein, 207 aa, Griffithsia japonica
ARGCTRCGGQGIVIQTRRIGPGFVQQIQTHCPVCGGKGKVSTGACRSCPSGQFEEAEKTLLIDIEKGMSDGEAVVFEGHTDEVPDHASGDVRFEVVSEPHPRFKRMGSDLRYTLHVSLSEALVGVNRQVRQLDGRLVPIQTDRVITPGEELVIEGEGMPARGGGEAGDLVVELWVDFPKNLTAEQKQKVLELHGEIPALDVTGDGTN

SEQ ID NO: 20611 - protein, 154 aa, Griffithsia japonica
MNPEYDYLYKNLLIGDSGVGKSCLLLRFADDTYTESYISTIGVDFKIRTIELDGKTIKLQIWDTAGQERFRTITSSYYRGAHGIIIVYDVTDQESFNNVKSWLQEIDRFASEHVCKLLVGNKNDMTSKKVVDTETAKNFADSLGIKFLETSAKT

SEQ ID NO: 20612 - protein, 157 aa, Griffithsia japonica
ARGKMKWSVEDNVPDMTGKTVLITGSNSGLGYHCADQLLSRGATIVLACRNADKMGAAAVSLQAAHGTPASRILQLQLDVSDLVSVRAAPAALLELGVSALYGLVLNAGVNGRDVVTFTTDGLERVFVTNILGHWLLTGLLLPLMRDVEGSRVVAVS

SEQ ID NO: 20613 - protein, 160 aa, Griffithsia japonica
PIVRLPIHPTPNSRRPQPLSTAPPSPASRLSFPPRRRRLCPPAIGAAASASVYDLSAFKNGRPYPFSPLSGKLTLFVNVASYCALTPQYEGLVALHTAYQPKGFEVVASPCNQFGRQEPQPDDEICAFVKERFGARFVLLDKLVVNERPADGRSPRSTVS

SEQ ID NO: 20614 - protein, 476 aa, Neurospora crassa
MSLPKDFLWGFATAAYQIEGAIHADGRGPSIWDTFCNIPGKIADGSSGAVACDSYNRTKEDIDLLKSLGATAYRFSISWSRIIPVGGRNDPINQKGIDHYVKFVDDLLEAGITPFITLFHWDLPDGLDKRYGGLLNREEFPLDFEHYARTMFKAIPKCKHWITFNEPWCSSILGYNSGYFAPGHTSDRTKSPVGDSAREPWIVGHNLLIAHGRAVKVYREDFKPTQGGEIGITLNGDATLPWDPEDPLDVEACDRKIEFAISWFADPIYFGKYPDSMRKQLGDRLPEFTPEEVALVKGSNDFYGMNHYTANYIKHKKGVPPEDDFLGNLETLFYNKKGNCIGPETQSFWLRPHAQGFRDLLNWLSKRYGYPKIYVTENGTSLKGENAMPLKQIVEDDFRVKYFNDYVNAMAKAHSEDGVNVKGYLAWSLMDNFEWAEGYETRFGVTYVDYENDQKRYPKKSAKSLKPLFDSLIKKD

SEQ ID NO: 20615 - protein, 178 aa, Neurospora crassa
MKAYFYDNLPGDQRLPHDSGKEVTVAELEKVGVLYFRFPDVEGVNTLAAERGYKNRDEIIVSPEKMGAIYETKVRQFFDEHLHEDEEIRYIRDGAGYFDVRNEGDEWIRIKLVKDDLIILPAGIYHRFTTDDTNYIQAMRLFKEEPKWTPLNRTEGLDENPYRQEYVTQFLKAQAEQA

SEQ ID NO: 20616 - protein, 425 aa, Neurospora crassa
MDDRKLAFFTAIEDQGGVIVKGRTRFERLFHIGRSSVPLCVDALKAAVQEAKAGSDILRYQMAVNSLFQAAPNEPEALLDKAWMESKEKENRDTTAHLQAELQGYKNNLIKESIRMGNEDLGKHFEAIGDVEAAMDSFWKMRTEVSSTEQLVDLGKLLVRVAIERRDWKSIGNHLKPLNSVNDSDPKAKALKTYSKIANGIAALGQERYKEAAFCFVEASSGVPPEIYNQIASPNDVAIYGGLLALATMDRHELQANLLDNDSFREFLQREPHIRRAITQFVNGRYAACIEILESYRPDYLLDIYLQKHVPKLYADIRTKSIVQYLKPFSCVRLDTMQKAFNGPGPSIEDELFTMIKDGKLNARIDAINKSKALQTLENYEKQALDRIRRMNIMAADLEVKGSRKPGGMNDIPFSMTTDDTVSLA

SEQ ID NO: 20617 - protein, 452 aa, Neurospora crassa
MAPLADTASNGGSTLSLDHLITGSDKYHAAATNVAIAAENEYAAHNYHPLPVVFAKAQGVHVWDPEGKHYLDFLSAYSAVNQGHCHPELVKALTEQASRLTLSSRAFHNDVFPVWAAKVRSVFGYDMVLPMNTGAEAVETAIKIARKWAYKVKGVPHDKALVFSAADNFHGRTMTAISLSVDPESRDNYGPYVPQIGAVSPSTGKTIRYNNIADLEEVLEAHGKETAAFIVEPIQGEAGVVVPDEDYLQKVSALCKKHNVLFICDEIQTGIARTGRMLCSDWANIKPDIITLGKAISGGMYPVSAVLADKEIMLVVEPGTHGSTYGGNPLGCAVSLRALELVEEEGLVEKAEKLGQIFREGVEAFKSPIVKLVRGKGLLNAVVIDESAAAGRTAWDLCILLKEKGVLAKPTHGNIIRFAPPLVITEEELRGAIKTFGEALQELPTVTKSEGH

SEQ ID NO: 20618 - protein, 248 aa, Neurospora crassa
MGESRQELLQWINSLLQLNLTKVEQCGTGAALCQVYDSIFGDVPMSRVKFNVNSEYAYIQNFKILQNTFTKHQIEKSIPIEALVKCKMQDNLDFLQWTKRFWDQYYPGGDYDAAARRKGGALPATMSGASRASAGSAAARRPGGATPTGGPRVAARAPAANSAATQALQQEVATLKEAVGGLERERDFYFHKLRDIEVLVQSAVEEDPELEKQEDGLIKAIQAILYSTEEGFEIPEADAEAADDQETF

SEQ ID NO: 20619 - protein, 361 aa, Neurospora crassa
MSVPEKFTGFQVNGPETWTEFHKNEFQPKPFGDYDVDIKIECCGVCGSDVHTISGGWGEQKFPLAVGHEIIGTALRVGPKVTLIKPGQRVGVGAQSYSCLDCRQCKNDNETYCRKQLDTYGAVWPDTGIVSQGGYSSHVRTHEHWVFPIPDALPSTVAAPMLCAGLTAYSPLVRNGCGPGKKVGIVGLGGIGHLGLLFAKALGATVYVISRTHSKEADARKMGADGFLATADPNWNEEHIMTFDLIINTANSFEGFDLDAYLSLLDVHGKWVSVGLPEDEEGIRVRNQTFLKNGCFFGSSHLGSRRETLEMLQLAADKGVRTWVEEVKINEENLKGVMQKMKGAGGRYRFCLTGYEEAFGA

SEQ ID NO: 20620 - protein, 495 aa, Neurospora crassa
MEVELTAPNGKKWMQPLGLFINNEFVKSANEQKLISINPTTEEEICSVYAATAEDVDAAVSAARKAFRHESWKSLSGTERGALMRKLADLVAENAEILATIECLDNGKPYQTALNENVPEVINVLRYYAGYADKNFGQVIDVGPAKFAYTVKEPLGVCGQIIPWNYPLDMAAWKLGPALCCGNTVVLKLAEQTPLSVLYLAKLIKEAGFPPGVINIINGHGREAGAALVQHPQVDKIAFTGSTTTGKEIMKMASYTMKNITLETGGKSPLIVFEDADLELAATWSHIGIMSNQGQICTATSRILVHEKIYDEFVEKFKAKVQEVSVLGDPFEESTFHGPQVTKAQYERVLGYINVGKEEGATVMMGGEPAPQNGKGFFVAPTVFTNVKPTMKIFREEIFGPCVAITTFKTEEEALTLANDSMYGLGAALFTKDLTRAHRVAREIEAGMVWVNSSNDSDFRIPFGGVKQSGIGRELGEAGLAPYCNVKSIHVNLAA

SEQ ID NO: 20621 - protein, 372 aa, Neurospora crassa
MSSRTATAPTSEGTRERSHRRKVAFLGPFASYSHQATKSAFPNQDKWELIPTTTIREVVDEVQASNVDFGVVPFENSTHGTVSFTLDCLADRASTYPNITICGEAYLDVHHFLLGRRKSSLLPNVDQNAKGTPLTSLSHVKRVYSHPQAFGQTAKFFATYLKGVETIEVSSTSKAAELAAADATGSSAAVAGEVAGEMAGLDVLARCIEDREDNTTRFFVLRRRPCSSRSDDGVEQEVQLPEGLPWTTDRAESLLGSPTSGGSPVSLSPRPSSSVSGSYGGRNDDTERIDAYKGLYKSMVSFTVPHHTPGALADVLGCFKRRGLNLTSINSLPSLIAPFQYLFFIEFEGNRWDDPEGRKSSTIYQSSAKQMD

SEQ ID NO: 20622 - protein, 369 aa, Neurospora crassa
MLLLFALGSNGSGQLGIGHKEDVSVPKDAHFDADLPATASITKIVAGGNHTIILTTTGDIYWSGDPNTGACGKFTQTQISQPPRFHPVDISSVSTPQDPFRVGMVAAAWEASIFTRLDAQGRNTRVYSCGTGLKGELGLGTFIFRTATPSLIPDFPPPDTEVVDLAACMGHVVAVLSNGDVWGWGNGRKGQIGAPEDIVHSPRKIEGLGFKVVKAVCGKEFTCFLGSPESGNIMVLGSDKWGIRGEVPDQVVGWREVGASWGNLFILKGDGSLLSWGRNDHGQLAPANLPQTKHIAVGSEHALALSEEGDVTAWGWGEHGNCGPLSSSDVTKGQQNVIASSKFIPSGAKITTIGAGCATSWVAIQMPST

SEQ ID NO: 20623 - protein, 349 aa, Neurospora crassa
MTKVLLTGGSGFIAAHILEQLLAKGHTVVTTVRSEDKAQNIREAYPDKASSGELKVVIVPDIAKLDAFDEVVKEPGLEVVLHTASPFHFKFTPKEDPKTELIDPAVNGTTGILKAIARSAPTVRRVVITSSFAAILDENKITDPNHTFSEASWNPVTIDDIHRNPATAYRASKTLAEKAAWDFVRDPANNVKFDLATINPPMVFGPVVHHLASLSSINTSNERIVDLLQGKWKEGVPSTGAATIWIDVRDVARAHIRAGLEVPEAGGKRLFTTAGTFSNSEIAEKVRKNFPEYGDKLPEGEALKSGELPPDDQRFKVDNKATNELLKIDFISVEQMVVDTVKSLKEHGA

SEQ ID NO: 20624 - protein, 337 aa, Neurospora crassa
MSSSSKFRSSHHYHSQSVSSILGRHDSTSPGAELQRRPTTTSSYTSSGSASRRVPRDNGTRSSDGTVSTMMSTTSSTGRESAATTAMTEGPAYSKKVVVVGDGGCGKTCLLISYSQGYFPEKYVPTVFENYITYPTHPPTGKTVELALWDTAGQEEYDRLRPLSYPETDLIFVCFAIDCPNSLENVMDKWYPEVLHFCPYTPLILVGLKSDLRNKKTCIDMLKTQGLTPVTTEQGLAVAKKMGAQYMECSSKEMKGVEEIFEQAILTVVANDRKTLEQEAANGMLGVGAGSGSGKGSGISFSSGDKAGSGIGPVKAAGVGGTIVPKTRKKKRKCGMM

SEQ ID NO: 20625 - protein, 505 aa, Neurospora crassa
MGIIHEKAHYVVAVALVAFLIRAFVLSQWNTIKRNGERLKKPPNTLPLVGNGLQFLQSRWKLFSWFDACQRKFGYETVAISVPTLPPGVLIHDPRNLDYVFKNEGIFTKGNFVKGRTWDLFGNGIINAEGDFWKTQRKAGLSFLNTANLRVLTDVALPQYLSESISQLRSSTNGTVVDLQHMAMHADDEFTVSFDYASGGTAERFQNPLWFVTEIFLGAELRKSIAVVKNFGRHIVTKAVQDRQEKEFGEEEGKLDQISGSLIQSLLDAIQDEQMVADAALTYLSAGRDTTGQALTWTFYLLMRHPRVVAKIREEATQLLKEKNVTLTPDQFDSSLFNPVTMPYSMAVFYEVLRLYPPIPFEIRQCNEDVTLPDGTFLPKSSILVWCLWAMQRSKLTWGDDADEFRPERFLDGNKLISRSPSEFPVFYGGPRTCLGRKMAEAIAAQVIPTMACLFDFVPTSDEERTSKTSLTLPMEGGLPVTVKTLTGEEREKLVRIPEIRFSEH

SEQ ID NO: 20626 - protein, 438 aa, Neurospora crassa
MPISKIHARYVYDSRGNPTVEVDVVTELGLHRAIVPSGASTGQHEACELRDGDKTKWGGKGVLKAVQNVNEVIGPALIKENIDVKDQSKVDKFLIDLDGTPNKTKLGANAILGVSLAVAKAGAAEKGVPLYAHISDLAGTKKPYVLPVPFMNVLNGGSHAGGRLAFQEFMIVPSAAPTFSEALRQGAEVYQILKSLAKKKYGQSAGNVGDEGGVAPDIQNPEEALDLITEAIEKAGYTGQVKIAMDVASSEFYKEDVKKYDLDFKNPESDPSKWLTYEELANLYSELCKKYPIVSIEDPFAEDDWEAWSYFYKTQDIQIVADDLTVTNPLRIKKAIELKAANALLLKVNQIGTLTESIQAAKDSYADGWGVMVSHRSGETEDVTIADIVVGIRSGQIKTGAPARSERLAKLNQILRIEEELADNAIFAGEKFRKAVEL

SEQ ID NO: 20627 - protein, 492 aa, Neurospora crassa
MGSDPQYAKWPLLPLAQHVFTLTNPYAARPAQQAAVKNLQDAITEHKMAPFYRYLAHPTEGVLNSVGEGGSNTAGAGRLGRKSSIAAGMIATHKPTTSLSLPWDENLYQQLQAENEKELEEFQKEEDEAVEKAGDTEIQAAKGKRAEFWARVGDKEKAIAAHQDLLEKTSILGTKIDLVLALIRLGLFFGDKQLVQKTVERAKSLVESGGDWDRRNRLKAYEGLHLLTVRNYSGAAPLLLDSLSTFTSYELCTYSNLVVYAVLAGSVSLKRVDFKSKVVDAPEIKAILGDGEDKLLALTGAISAGPGADASMQDADNAPVAARTAVVNLTTLGSSTEQPEAEMAVDFDPLAQLVSSLYNGRYKLFFQALALVEEQFLTQDRYLHEHKNWFIREMRLRAYQQLLQSYRVVGLDSMANDFGVTVDFLDRDLAKFIAAGRIPCTIDRVNGKGVIETNRPDDKNKQYQDVVRQGDQLITKLQKYGQAVRLRGSERA

SEQ ID NO: 20628 - protein, 1030 aa, Neurospora crassa
MPSLSSISGPTYVNSQLLVQQTAYKLSDKIFSYSPETFDLDVAVKEWAEANEKNVHGETTTVVPLQTRAGAGAFALGYIFSKDFDLAKRHVPQTLLAPSLSLRHLRSSLDQLALLYGVSSPFVAHVAAADYSAEKGLGADYATALQIAEDLGLALVSSSSAYEVQHMSLLATLLASVLPTLHIYDGIRTARESLRVVDALGEAHIADIYAKISKEAAALNKRLDTAGKVVELLKAFNNELGTSYAPFEYHGHEAPETVLVVFGSAEAQLAKQVASALAAEGKKVGTIVVRVYRPFVEEAFLEVLPASVRQIAVLGQVADAAAVEDANVQSALYSDVLTAVSFTDKLSQAPEVVDVRYAVTDAHTPSSIASIFNKLTSKGEAEPVAFSLTAVEEAQQYVFWDVDNSSAAASASAVGKLLETEQSNNVYVHQTYDNLVQGGVVRTDIRVSQKSIEAPYPVESADVVFVGEEKLLKEIAIVKGVKAGGKLIVRLPNFKEDELEKRIPAAAQKEIQEKGIELYVLDSSSSPALEKEAGLLVDVAFLRVARADITKFDSLSADQTALTEAVNALDQSVRKVEVPAKWAEVENTVAPLVDSVKPNSFVAFQKEEEEETSSLENWQSAAKGFAFKEAYGTQNQLRPDLTVKTYTIKVKENRRLTPTDYDRNIFHIEFDLGDSGLTYNIGEALGIHADNDPEQVLQFIQAYGLNADDLVQVPSREDPAVLETRTVYQSLVQNVDILGKPPKRFFEALAQFATDEEEKKKLERLGSKEGADEFKRLTEEDTVTYVDVLDMFKSAHPDFNDLVRIVDPTKRREYSIASAQAVTPNSVTLMIVVVNWVDTKGRTRYGHATRYLSGLAPGSTITASVKPSVMKLPVKDTAPLIMAGLGTGLAPFRAFVQYRAMQKAQGKEIGSILLYLGSRHQREEYLYGEEWEAYLDAGVITLLGAAFSRDQPEKIYIQDRMRQTVTDIVKAYIKEEGSFYLCGPTWPVPDVTAVLEEAIAAEAQESSRKVDPRKEIERLKEDGRYVLEVY

SEQ ID NO: 20629 - protein, 492 aa, Neurospora crassa
MSTTTPQPRWRIAVGCDDAGINYKNKIKSDLSSDPRVISVIDVGVAHDSQDRSTAYPHIAAAAAKLVASGECDRALLICGTGLGVAIAANKIKGIRAVTAHDSFSVERAVLSNNAQVLCMGERVVGLELARRLAKEWLGYVFDESSASAEKVRAIHEYEGREGGREAEWVKGSTADFKKNTLEGEVKQESTTMSSASPSRERRRLVGVSTKMYFSHARTTNFITSFLDLMQHHTSTKTEQSNDNRNNLAAALASKIDIFIIPDHLSLQSAINRTANHPSQSGPTDPKILFGAQNCHWEDSGPFTGEVSPAVLAEVGCSIVELNHAERRRHFAETDAITCLKAQAVIRNGMIPLICVGEGSPGQIPALSEVAIMKAAAEVVDQVELCLEGVDPTKEVWLAYEPVWAIGAKEPAGVEHVRGVVRTIRKSEVVRGREERGGVTRILYGGSAGPGLFGQLKEVDGVDGLFLGRFAHEEGQFWKTICEVAEVEWEGR

SEQ ID NO: 20630 - protein, 482 aa, Neurospora crassa
MARKRVKKRTHVGAKNPVSSAALNGHADRKDPKSMVIRIGAGEVGTSISQLATDVRRVMEPGTATRLKERKANRLRDYVTMCGPLGVTHLLLFSRSESGNTNLRLAIAPRGPTFNFRVDKYSLAKDVRRAQRHPKGGGKEFLTPPLLVMNNFTDPNADANSKVPKHLESITTTAFQSLFPPINPQRTPLKSIRRVLLLNREKSPENDGSFIINFRHYAITTKAVGMSKPLRRLNAAEKLIKSKSRKGGLPNLGKLRDISEFMIGGEDGQGYMTDGTSGSEYDTDAEIEILDQGPKKVKSAKARAAIAAVEAAEEEEEGHDDNVERRAVKLVELGPRMRLRMTKVEEGMCSGKVLWHEYVHKTQEEIRELEKKWEQKRREKEARKKQQKANVEKKKAEKAAHKKATGGKGKDDSDDEDEMDMDDYPYDSDMYDAEDGFDSEGLAGDAEEQANTKMEQDGEWEDEEEEIAQEAQAKGKKKPALK

SEQ ID NO: 20631 - protein, 484 aa, Neurospora crassa
MSSTMASDDNIDWAAQSPGIHDTINMIERICSIPSVIGCVFIITTFCLSERFQKPINRLAFFATFGNLATNVATLMGRDYVSNPTGAGCQMQGFLIQMFMPADAFWVLAMAINVYLIFERQYDAQKLRAMEKWYFLGCYGLTFVVALAFCFIESPKKGKMYGNATLWCWVSPKWDIFRIATFYGPVWVSIGFTFFIYIRAGRDIYRNHKQIKKFNITSSLAGGPVEDTLVSRKVTEVYITHEIATGNAIALADLERNNGAQEHSGNSAAQRAPSNAYSVTISADNQKVPEATDGDNLARITTTTVTGGVSGSANNTRTKNKHNSAMWHYSKCSLFFFTALLVTWIPSSCNRVYSVVHHNQTVKVLEYMGAGVLPLQGFWNALIYAVTSWKACQGFFGEDVKGWFSRDTDSGDSQRREGGGHHRSSSKTINGQAASGKANPFHKMGGRTAHPCPETESTEELAACGSRRTSYGGGTDSIPSKDMK

SEQ ID NO: 20632 - protein, 338 aa, Neurospora crassa
MADLLLPEPFASIPREPLTFGPSPIQPLPRISQALGGKVNVFAKREDLNSGLAFGGNKTRKLEYIPPPALAAAASKLGLHAALVQEHWVPDWTDPGYDKVGNIQLSRLMGADVRLEPLAGFGIEHKQTLAKLKDDLEKEGRKPYYIPAGASDHPLGGLGFARWAFEVVAQEEELGIHFDTVVVCAVTGSTMAGMVAGFKLVEMLERHSERLGKVNKRRVIGIDASAKVEQTRAQVLRIAKQTAAKIGLKEEDITESDIVLDDRYHAGVYGVPDEKTIEAIKFGARTEAFITDPVYEGKSLAGMMDMIKNGEIEAGSNVLYAHLGGQLALNAYSALGLE

SEQ ID NO: 20633 - protein, 1176 aa, Neurospora crassa
MANTSLDMASSTSPSPSPESTTTPRKRIVVVGLGMVGIAFIEKLIKLDTQRQYEIVVIGEEPHVAYNRVGLTSFFSHREVEQLYLNPLEWYKQHLQTSSLTHHLSTAALSLSPATKSLTISPPPSTPSLTTLPYDHLILATGSSALLPTSTPGHDASGVFVYRNIADLQSLITWSSDTQIKGSTGVVVGGGLLGLEAAKALMDLQVFGRVVVIERNGWVLSRQVDGEAGALVLEGVRGLGVEVLTRKRVKEVECDESKDEGEKEKKRVKGIRFEDGEYLACSTICFAIGIKARDELAREAGITCAERGGGGIVVDDSLQTSAPDVYAIGECASWKGQTFGLIGPGVEMADVLAFNFTQAHLHTPRVFKRPDLSTKLKLLGVEVASFGDFFADRDGPKELPPKLRRELKKSGGKAEVKALTYKDPFLSVYKKYIFTSDGKYLLGGMMIGDTTDYVRLVPLVKTHKELDVPPSQLILGAKKSGDDNGDDDLPDDTQICSCHNVTKADLVAPLKSGECTSLGDLKSCTKAGTGCGGCMPLVTSIFNRTMASLGTEVKNNLCPHFPEYSRADLYNIISVKRLRTLPDVMREAGADADSLGCEACKPAIASIFASLWNDHVMSPAHHGLQDTNDRFMGNIQRNGTFSVVPRVAAGEITPEKLIVIGEVAKEYNLYTKITGGQRIDMFGAKKQDLLKIWKKLVDAGMESGHAYAKSLRTVKSCVGTTWCRYGVGDSVGMAVRLEERYKGLRGPHKIKGGVSGCTRECAEAGNKDFGLIATEKGFNILICGNGGTTPKHSVLLAKDVPPTNVIPIIDRFLMFYIRTADKLQRTARWLEALPGGIDYLKEVILEDRLGICASLEAQMQELVDSYFDEWAEALNNPAMQERFKQFANTDEGQPPMEVEIDRGQERPVMWPREDEGGSAKADFKGLRDKWSSTTWQPVLEASYFQGADDLPNGISASIKRGDTQLAVWRIKGKYYASQQMCPHKRTFALSDGFVGTDPSPSSCSSSALPPSPPSTPPRSSSPVTSPPQSPTSSATPATTASSSCTTNPSGPASPWISCPFHKRNFSLTSGSCKNDNELSIATFDVEERDDGMVYIKLPPVDELDRELGTKKWMVKKGEAGEGQLRELDELNKSKGVEGKKGRRGRKPGASEAGKEVGKKLVEAVGGGGCGGPGLEW

SEQ ID NO: 20634 - protein, 364 aa, Neurospora crassa
MGYPETFEGFVVDSPKTWNQFHRHELKPKPFGDDDIDVQIECCGVCGSDIHTVTGGWGDFEGPLCVGHEVVGKAIKVGKNVTEIKQGDRVGVGAQVWSCLKCDVCKSKNEQYCPHMVDTYNANYEDGSTAHGGWASHIRAHQYFTFKIPDAIPSHLAAPLLCAGITTYSPLVRANVGPGKTVGIIGVGGLGHLGIQWARALGAEVHVLTHSAYKADDAKALGAQNVIVTSDDEKWAEPYKFKFDFLLNCADATHKFDMKTYLSVLKVGGEFHMCGIPDKPLPPLEVLAFMQNGAKLSANHLGNHQEMKAMLQLAAEKGIVPKVETVQLGEDGCKEAVERVKEGNKVHYRLTLTGFDKVFGKVEY

SEQ ID NO: 20635 - protein, 1617 aa, Neurospora crassa
MTQTHLLWKYYWEDDVEKFRRLLSLAAHGPQPAGRSSNITQGQAGGAGSLGTSPRPSGKSRKQPNGALSRIDVNSRDHVGLTLLLRAASSTTKNAVSFAEALIEHPAIDIHAQDPESGWNALHRALYAGNISIARMLLAKERRVLAGPTASFLRVGQLIKTKDHEGNSPFDLYNATIGERDLIALRELGGAQDEEDGSDNEAEVAQESVSRKPRHGALGEDLYTFGSNRNLTLGLGDQDDRQFPERVYLERPAHLLQRFYNEYLESAGLEGSTAQNLRDIPALVLNRPIVIEDVVMSKLHSAVLTTDPVSNLYVSGVGRGGRLGLGDENTRFKFTPVQGPLGDKKIIQVALGQNHTMALDESRALWTWGSNAHSQLGYTLPEPTKKDEDPISTTPRQVFSSLKKESIQGIAASSIHSVAHTGISLYCWGKNVGQLALMDSDSRSLEYQQTPRKVAASLFSSPIVMVSAIDKATTVLLQNYTVCVFTGYGYNIVKFPFASMDTIGHLSMSNRYEPGRSQISYITSGGETIAALTKRGDLFTMHLDHKMETNPPATSTTNPSKIKGAVTQPQCIWSARKDGVRSVGVGEYGSVIISTHSGAVWRRIKRAKVKDAYSWSSESKRNDFKFQRVPHITKVAAVRASPFGAFAAVRRDLDVLKEQLVVSEQSLWKDVAPLNPLADFRASEPKPRVRNKEKVKFWGNETLKSNLGSVAYEVLKSSDLEEDLESYLVEWNHLHQPLDALGLDVITLLNFVHFMYEDKVIPAWNFTRQAPPLAYRYRQVRQEVMRLATRLNMHNLEAAARLQVDPKKCMDEDFRLAIKDRTFFDDGDILLELDGREVAVHSSFLCQRCPWFQVLFHGRSRGIWLATRREEAERENERIGIDLKHMEPGAFAYVLRYLYGDYGAELFDPTMCDTFADFLDLVMDVMSMANYLMLDRLSQICQTIMGRFANIRNIANFLNAISPCSITEFRDAGLEYICLQLESMLENHLLDELDDDLLLELDAIVRDNQAAQSPFVRSGRFEMLLHEAHPELAQDIDEERQIRVKEIAFRASREDDRKLSTAFKGKGGSGVDDASASTPAADKTRRASKAARNEPFGHSPELKPKTSQADLIFDMEEEDGPATLSTPLGAKAPKVPSSAVDKDQFPTLGSSWKGKAPIRSGQSPAMASRSSLQAGTSPATKAGGVPWANAPMPASKVGLRDIIQLETTTTPVAAGRSALSEGLAAQQQQQTGKEGTSAPKVAQPKLSQKERKKQQQEQAAAQAALHFAKASLANKPAWGDTESKAPPPWKMVTANKAKPAPPHVNPPVSSPPVAKPLVAAEATPVVRRTASPDTRFAGQRTSSNNSVHTANPNPKSKSTPTLSSSSAQQFPSLGDSSSKPIVPHSKVYIAPARKDEHLLGFSMEEIILQQKLEQERIKGAMSKRSLQEIQEEQAFQEWWDAESKRLQEEEEERKRKATEKEERKEKGDKARGKGRGRDTVNGAESSKAGGDATAKGTGKPGGGEAKTGERKGEGRGGRGKGGPSGKKDGPPPGEGKGAVVASAASTSATPAIPTGPKGHGGAAAPQHHSRKADGGEGSSNPRRRDRGRDRGKGGRDATQVAGAVSTPTGPAIPAAGR

SEQ ID NO: 20636 - protein, 347 aa, Neurospora crassa
MASEIPPTMRAWQYSQTTGGLEQNLVLKDDVPVPTLSPRVGDKELLIEVLSASINPSDYKIAELPLNLGRAVVRTPATPAWDFCGRVVKTTNIVDNFRVGEIVFGRQAPTQHGACGQYIVASANACASLPSGVDVDEAASLPCAGLTAYQTIAPNVKPGDKVFLNGGSGGVGSFGIQIAKALGCHVTVSCSAAKAEQCKALGADDIIDYTAVDVCQALKERGQVFKLSVDNVGLPAELYKAGDDYLLPDGKFVQVGGPVSLAALSSTMSRLLRPSFLGGGKRKFQLYTLMGDQHQDLAILGQMVAEGKIKPVVEHAYDFEDVPTAFRDLRKGKTHGKLVIHVSEKGA

SEQ ID NO: 20637 - protein, 374 aa, Neurospora crassa
MSTQDQQPATTTLRLASGNGPITRSILPHPPRDALPSELPIISLAPLFSPSSSLSSRLEVAKQIRQAATTNGFFYITSHGIPPSIIQEAQESAFQFFRSPVSEKEKASMHNSLYKYGWKPPRTQRLNPFESVDHRESFSWRYDPRYDPSVKNVEEEIPDEVKAMIKHDPDDYPWSAVPPEFKAAVIRYFQAVLHLGRVLQRAFALSLGLEETAFDEKSRWPDLGMAVNYYPPLSASGKEEGKGDETKVSIGSHTDFQLFTILGQDEVGGLQVLSRSGQWLNAKPIPGTFVVNFGDYMQRITNDKYVSTVHRVQNYSGKERLSMAFFFGFNLNETCEVLDSCVEEGEEPKYEAVSCWEWTQRRVRMMHDVKGNGS

SEQ ID NO: 20638 - protein, 501 aa, Neurospora crassa
MLSTGVDIEGRPPNLEPVKAADAEKVAGSRADIAHNEVASLSSGTLGDNTHRKLKSRHIQLIGIGGTIGTAFYVQIGKGLLNGGPASLFLAFTIWCTFILAIAMCMAEMVTYLPISSPFIRFAGRYVDEAFGFAAGWNFFIFEAAMVPFELTACNLIIHYWSDAVPVGGIIAITLVIYGLVNLLAVEWYGETEFWAALGKFLLIVGLLIFTFVVMVGGNPLGDRFGFRYWKDPGAFTELYYTGSLGRWLGFLQCLIQASFTIAGPDYVAMAAGEAENPRVVMPRAFNAVFYRLTAFFVLGSLAVGILVPYNDAEMALAFSSGAPGAAASPYVVAMNRLRIRVLPDIVNAMVLTAAFSAGNSYVYCASRSLYGLALEGKAPKALLKCTRSGVPIYCVMIVLCFGLLAFLQVSNSAAVVLSWFISLMTASQLINYSVTCTSYLRWYAALKAQGIVKKTKFHKAEEIDLHKNLDEVEEYQANYVPTPSRGTLVDPRLESASVTL

SEQ ID NO: 20639 - protein, 231 aa, Neurospora crassa
MDLHRRVQSQTSSTSTATPSKHAFETRVADVKSPKSDINALILDYLMMEGYPKAAEKFQKEANLKPRQEDPTINARQQIQHAIHVGDIQKAISDLNELDPGLIELIRNARGYDPSAAINFAQEKLAPRAASNEQFLKELEKTMALLIFPADKLQPDLAALLHSDLRRNTAAQVNEVVLQRHTERREAAIRQLVRMRAWAEASCRSKKRNLPDRIELGLNGDDNGHDPMVTT

SEQ ID NO: 20640 - protein, 1520 aa, Neurospora crassa
MASTTQIKTPQEAVARIAYLASDVVVSVQPSLAAESDFSATLKSLASSRTQSLVAKAADAVTEIIPVRHNNDPLLSVFTPIRSGRLVSVTTTSEVLLPSIAHLYKLAQLPVVLHVALGPKSLPDYTAITSIRNSGWTFLQSNSLQEAQDLALTAHALAVQSGKGVIHFFDPSSSASEQPIAAEDLSLVQEILNLDNVRRFQSASISGSSIYANDGRVAVVSEQSEPVASQTVLDARQVEAATATATDSLAPAQDGSDESAQTSQEQSEASEASATPSASVATTIDEQAPVVTSEHIYNAFEYSGPSNAENALFVFGSGSPLFAQAIAQAQSDDSFAKAGVLTARLYRPWLGAKLLEAIPKSVKRVAVLEQVSRKTTKWGPLLIDVLTSVKSGPGGVQTIVGHQLGYISQETVVQALRGIFQNLTSEKPVQNLEVGEREAPKEASEYGLEKPKLETAYTKILDQLFGERAYIANSIEKDNAGISNTISATPEYGFGALLARKERKQKFVSEVKEAASNGQFSSDAPKQALAKWVANAEDSKKVEEVASEAVSKLSEDGSDLSKSLLEYKQFFRKQSLWLVGSDAWSYDLGNSGVHHVLASGENVNLLIIDSTPYSERAAADANRRKKDIGLYAMNFGNAYVASTAVYSSYTQVLQAMDEADKFNGPSVVLAYLPYFGEHDSALTVLQETKKAVDIGYWPLYRWNPENEKKGEPSFSLDSERIKKELKEFLDRDNHLTQLMKKEPSFGAVLSEDFGTEIRAQQKRKAKDAYNQLLEGLFGAPLTILYASDNGNAISLSKRLGNRGRARGLKTTVMSMEDYPVEDLATEENIVFITSTAGQGEFPQNGLSFWHAVKDNTSLDLANVRYSVFGLGDSHYWPRKEDKIYYNKPAKDLDRVLANFGAKPLAPIGLGDDQDPDGFQTGYSEWEPKLWEALGVANVDGLPEEPAPRTNEDIKIESNYLRGTIVQGLNDTSTLAISPDDCQLTKFHGTYMQDDRDIRDERKAQGLEPAYSFMIRCRLPGGVSTAKQWVQMDDIANELGNETMKLTTRQTFQFHGVVKSKLKPAMQAINRALMTTIAACGDVNRNVMCSPLPAHSKYHRAVHACAKRISDHLLPNTTAYHEIWLTDDDGAKTQVGGNAVQDFEPLYGPTYLPRKFKVSIAIPPHNDVDVYAHDIGLIAIKNEDGSLAGFNLLAGGGMGATHNNKKTYPQTGRMLGFVTAADVHLACEKVMLVQRDNGDRKNRKHARLKYTIDDMGVDVFKAKVEEYWGQKFEEPRAFHFDSNVDTFGWTKDETGLNHFTMFIENGRIEDTAEFQMKTGLREIAKVHKGEFRLTPNQHLILSNVADEDKPELEKLLAQYKLDNLHHSGLRLSSSACVAFPTCGLAMAESERYLPVLITKLEGVLEEVGLKQDSIVMRMTGCPNGCARPWLAEVAFVGKAYGAYNMYLGGGYHGQRLNKLYRSSIKEEEILTIMKGLLRRYAKEREEGERFGDWTIRAGIIKATTDGRNFHEGVAEEEGDEE

SEQ ID NO: 20641 - protein, 224 aa, Neurospora crassa
MGKEHQLTPNTRDGHFVPNLTWGPPIVAKIRGHVEKPTEAYGKGTFDCHMMIAEPKKWVKEFKKAGCDLYCFHYEAAFSTAAESPEAKSDKKTSPKELIKYIHDQGMLAGIALKPATSVDVLWEILESEDPKERPDMVLIMTVEPGFGGQKFMASELPKVQELRKRYPELNIEVDGGLGPSTIDQAADAGANVIVAGSAVFGAQDPSEVIALLREAVEKRNGKL

SEQ ID NO: 20642 - protein, 423 aa, Neurospora crassa
MANNTITPSSSEPEMTQIKSYGATTLVTAEQTTSNTSGAAPNNNAVLTGLDEPDLVALGIQKLEAQNVHWYSYLLTVDFWLVILIGQILSLCITATNTFSSFLSELGTSIPAIQTIFVYALIFLVYFPIALYKTGGPRKFFEQTWRNSWKYIILSFLDVEGNYFTVLAYRYTNLLSAQLLNFWSIVCVVIISFALLKVRYKWFQIGGILICCGGMGILLASDHITGSNGGPGVNMLKGDLFGLLGATLYGISNVYEEWFVSKRPVYEVLSFLGFFGVIINGVQAAIFDRQAATDATWNGPVAGYLVGYTFAMLIFYSLAPLILRMGSAAFFDISLLTANFWGVIVGVKVFHYVIHFMYPIAFVCIILGLVVYFLAGSVLGDSKKPWLGADQSEGVAGVGTAKLKALNAARQKALADGEAGARV

SEQ ID NO: 20643 - protein, 322 aa, Neurospora crassa
MQRSGYGQSPPLHHPVPQHVSTVPQLRSPPPPTSQPHSGYDGSPYQQQGRAPSGNMFGQYGNFINDPAAQLASQFGQTAFKQGQEYLEQNVNRFVSVSALKHYFNVTNSYVINKLYLVLFPWRHKPWSRKQTVGPGGQEGWYLPPRDDINSPDMYIPVMSLVTYIFLQTLIAGLRGQFQPELFGYIATTALVVVIVEILGLKLGCYLLSISNESQLLDLVAYSGYKFVGVIVTISIAEIVNGGKGTGGVIGWTVFGYTFFANALFLMRSLKYVLLPENNNNAQGPMQTMPTEGRAKRSQRLQFLFFYAYIVQLFFMWILSRP

SEQ ID NO: 20644 - protein, 334 aa, Neurospora crassa
MTTMDLRVGNKYRIGRKIGSGSFGDIYLGTNIISGEEIAIKLESVKAKHPQLEYEARVYKSLAGGVGIPFVRWFGTECDYNAMVLDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGSLPWQGLKAATKKQKYDRIMEKKMTTPTEVLCRGFPNEFAIYLNYTRSLRFDDKPDYSYLRKIFRDLFVREGFHQPQPADSKEAAQAAARKDPQQALRSGSRKPMTGETPETSRAVGGSDRM

SEQ ID NO: 20645 - protein, 357 aa, Neurospora crassa
MANTPLNLTQEPFIPLNSLILVTGVNGLIASHIADQLLSAGYRVRGTVRNKARCAWVEPFFTTRYGFNRIEVIEVPNITAPGIWNAHVAGVSAVITVAGVAWLDDRDVPKAVNEELKCLYGLLDAAKMHSNTVQAFIYTSSSWAAYTPKVGIRRTLTEESWNHEAVALAEDSGIPDAEKGLAPFMAIKVKVEEALWDWVAREKPTFTFNAMLISTVVGPILDPDNQPASTAGLVRALYNGKPKDALDVIPTFGPQSSIDARDAGRLYLGVLVSGLTGSRVYGLAEQFSWNQTLDILKELYPEKNDWVELPSSNQIDETEIPADIPFLLLHAVGQEGWTGLKESIKDAAESFAPTGRC

SEQ ID NO: 20646 - protein, 488 aa, Neurospora crassa
MSLLFAEYGIHTHYYDPSKKNIEALQSHAKESKHEDKITYHDDHKSLCEALEDGDKPKVFMFSIPHGGPADDSIDALEPYLKPGDIIMDASNEHWKATERRQARLEPKGIHYIGMGVSGGYQSARHGPSISPGGSKEALDKVFPFLQKIAAKDNRGRPCVAKLGPGGCGHYVKMIHNGIEHGMMTALCEAWAIMNIGLGMDYEEIGTIFEKWNGDKQRPLRDNFLIDIGADICRTKDEKGNYVLANVRDKVVQDVDNSEGTGTWSVQEGTRLHVPDPTIAVSHLFRVASADAARRETVNKALDGKGVKPAQIEGVDKAKFLEDLYNAVYASFLMCFIQGLHVLSKANEENDWKLDFADVLQLWRNGCIIQSDGVADLLETVYRSREHDNDDLLGHQTIAGELAKTYPSLKRVVLKAIEFDLHAGALGTSLEYYKYSGSTELPTQFQEAELDYFGAHMFDLKTAEPGKPVTGKHHFEWKPARGILETND

SEQ ID NO: 20647 - protein, 494 aa, Neurospora crassa
MAPKLKDPSLFKKDVCYVNGEWVKAHSGKTFEVNATGKLIGTCPEFDAQDTKKAIDAAETAFETFRHKTGRERSKLLRKWYDLMVENHDDLTTLITLENGKPLADAKGEVTYAANFFEWFSEEAPRIYGDTIPSSVPGNRVWTIKEPVGVCGLITPWNFPAAMITRKVGPALAVGCTVVCKAPGETPFTALAIAELAHRAGIPPGVVNVITALENTPEVGSTLTTDPVVRKISFTGSTAVGKLLMKQCSGTLKKLSLELGGNAPFIVFDDADVDAAVTGAIASKFRSSGQTCVCANRIYVQRGIYDEFSQKFAEQVKNNFRVGNGFEEGVTHGPLIHHRAIEKVEQHVRDAEKKGAKVVVGGHRLESLGPNFYEPTVITGMTPDMAMASEETFGPVAGLFPFDTEDEVVKLANATQVGLAGYFFSRDIHRCVRVAEHLEVGMVGINTGLISDPASPFGGVKESGFGREGSLYGIGEYQVTKMVTVGGMGQPLQK

SEQ ID NO: 20648 - protein, 434 aa, Neurospora crassa
MLLFPTILTAALAATGMAAAIPSRDDTTANKGTASLLQVRNPSFEFRHGPLALAKAYQKFGAPMPEDLRAAIARFRQNQKRTTGTIATDPEKHDVEYLTPISVGTPSQDLVVDFDTGSSDLWVFSTEMSTSDIKGQTVYDPNNSSTSEKVQGSTWKITYGDGSSSSGDVYLDTVTIGNLTVPSQAVEAAKKVSSEFTDDSHNDGLLGLGFSAINAVEPTPQNTFFDNIKGSLDAPLFTVDLKHGTPGSFNFGYIDPAAYIGNISWTPVDSSQGYWGFTSPGYAVGTGAFRNHSISGIADTGTTLLLLPKSVVSAYYKEIQGAQYDSDQGGYIFPCSPTPPDFVFGVNKGIVTVPGDMVSYAPADSANQNCFGGIQTDTGIGFSIFGDVALKTSFVHLHGSIVPGYYADCAMRFNRMLRSYSNDQLVDFSSSGPL

SEQ ID NO: 20649 - protein, 500 aa, Neurospora crassa
MAHKNILDFDLPRTRRDSGIITPSLALNSFLEYFGNPDAPIRGAIVSVYQAGADSTPTIAWLGSASVGITSDRIGRRKAIAFGCVFGVLGGALMTGAAHVAMLIIGRILVGYAVGTITGVAPVFGAEIAKSKNQRSYPDELSRPHPKSWLRVTDLGVGEGKWHNPNQWRLGFAVQSIPALALGVGVLFIKESPRWLCLKSRHAEAEKAFRSYHHNGSNDEWCREEFRHLQANIAIELQARGCLSWAELLKAPAFRKRLFVGSFVWAAAMLSGISFIQYFQPAIYATLQYNQDQQLLISGLYGSVAPVTCLVSLLFVDRIGRKKILVFSASLLSLCYLIITIIAAVFPARPGFPTNEAAQRGLIACVFVVSANYSALLGPMTWIIPYIKSCPIMIAENITYEPKLGEANDWASWLTAHQIFFVLTNALCAIVFALVYPETRGKSLEDMSEIFGDIKRRTEPELDEVHSSPSGKKDSEISEYAIEKTESKYHRDRRSDIFRV

SEQ ID NO: 20650 - protein, 338 aa, Neurospora crassa
MSQYYGAPPNQGYAPSNAQNLQFYPSSYTQPVSGHATPSQAAYGYGGPSSSGGYGVGTGGFSSGFGGSSAAGGVSGRMGEQGGLRTGWLAAFSTEGYEGEPPLLEELGVNFGHIRSKTLAVLNPFGRIDQHLMDDSDMAGPVLFFFLMGTFLLLSGRVHFGYIYGLALFGSISLHVILSLMAPSAGVPSSSSASASGPVGPGGAPAQAYSSYPGPSATSISSASMSAADHDHSAGRSTLTFARSASVLGYCLLPLVATSLVGIVMPMDTPLGIVLTSAAILWSTYSASGIFCAVSRMRSMRALVAYPLALFYVGFGIMSVFSSKGSGSFAKVGTTSSL

SEQ ID NO: 20651 - protein, 510 aa, Neurospora crassa
MNGIKDLGLGFSKASTRLHFFSLLLALGSFVWGYNVGVLASVLAHPGFRETIPGYGPYKRGLITSINYLGTWLSYIFFSRPATDLLGRRYAAMVGMSVLCVGQALQAAASGSVALSMVIFGRVVSGLGTGIVSTSVPLYQSEIAPAKQRGRLVVLNHVGFVAGLASGFCSHGYLSGWRLSVSLSFIPALIFFVGLPFLHESPRWLVEHGRPDEALKALQFYREGSFTPSQIQSELTDIKRNVCAYQATSLKKWTSLFTNPSLFTRLWRAALLHFMAQMCGATAMKYYLPDLFRVLGLSPRVSLLAGGIESTLKIGCTVLEMFVIDKVGRRMTLAVGAGIMAFALLINGALPLAYPNNTNRASDYTCVVFIFIYSLGYSMGFGPAAWVYGSEIFPTAARARGLSFAASGGAVGSIIVSQLWPIGIAELGSKIYFFFMAVNLACVPIIFLLYPETKGRPLEDMEVLFGGYEGGTPSTTSLLLADEREDGNEEDEENETLGRPLLGDGRGMAR

SEQ ID NO: 20652 - protein, 410 aa, Neurospora crassa
METDPESDLSALGSQLSSDVADNQLDIESTLRSSQSKIKELRRELNAVDIVIDKLFASYTALTKAWSKVDQKAGLRRERESREGNDNGEDGEEGRDEKEDDDDKKRKRKDSSETEEPTATTKSRRRSSNSSSPPIDVSEATLDAVARILPLPLPQLEEDSGKSVEEGDMTEAATGGVGGEAGGGGGGGSSTSHQQQQQGIRKKINLGKREVKRVRTVSPESGSGSGSGPGSVMKSIEGDEVDGSHERDSPTLESEGEYGQEELPDNGGEVNFRKDLQVNVVFLEQQFERYEEDINKGLELYKSDMNRRVERLENDMNERVEKLERKVHKSFEKLENWMSWNEWVGETITYGGDDADDEDEEEEDSEEDDEDTDEHEDDDDDDDNDDNDDNYNGNLPSPPDDHPLTNSANH

SEQ ID NO: 20653 - protein, 1223 aa, Neurospora crassa
MMRGGLLQPATPSAGGGGGGGGWGGSWKPAAPATPATQTTPEPGTAQSQPKSANAGLLPHEVAARQRLLRMAEAAVAAQPAPRPARNPAPEPPKRASSDRPVRRLPEGQQNEFNRAPPRKEQQGPVVRRMLLHPKQPGQDPTTETPGPKTEREAQRSQAPVRKVLEPFGIRRFPARAPQTQQPAPKESPSSQTAPREPTPSRPTQSLASTSQPTVSSLSSLSSGASLKPGPASQLSEQTDGASGESSWDALEAASSASSQPPKPASGEWGTSSWGASSWGASSASSQPASQSQTERLLPHEKVARDRLQQRHAQSHPQAPARNLKSLADGLFAHDRQTGQLSAKDLRKRQETGSLKNDLLNAEEEERRADNTDAWDDIFSTQPPPPPPPPSTRRTSAREVYQSISSKFAPPPAPPSDSKSSRETEGQWAGLIRRTAGANVGNGRLTGNNDFVKTAPPSETEKRSEPRDSRNFWKQAEDRYATSPAPHAQPETASESTREATEAFKKQMSDGWDWADDYGGKPKEKEGQKLEQQDFEKPRGRDNARQTRGDRVALEEIPIPSRYIKEEKKPKKKGGRRRDYNEDDDFDDMAYEYKRRERLAKKAEKERLQFEETGPIPILLPEFISVANLGMALGVKTDLFISQLGELGFEDIAKDSIMTGETAALVAQEYGFEPTVDAGEDEDLRPRPPSEDPSSVPLRPPVVTIMGHVDHGKTTLLDFLRKSSIAAGEHGGITQHIGAFSVQMSSGKQITFLDTPGHAAFLSMRQRGANVTDIVILVVAADDSVKPQTIEAIKHARSAKVPMIVAINKIDKDQANVERVKSDLAANGVEIEDYGGDVQVVCVSGKTGQGMDDLEDNILLLSEMLDIRAEPDGMAEGWVLESSIKPIGRVATVLVKRGTLRPGDFIVAGRVFAKVRSLRNEAGIEVEEAPPGTAVEILGWKEPPEAGDMVLQAPNEDKAKSAVHYRIEQKEREEAMEQITEMERLKREREAERIAAEEAEKGEDGAEAAEEKPDGPKMINFTVKGDVHGSVEAVCASILEIGSNEVRPRVLLSSPGQITESDVEHAAVSGSTIINFNNPIPGHIKRMAVENKVRIMDHNIIYNLTEEVRQVLSESLAPTISFKVLGEAEVAQVFAINIKGRKYKNIAGVKVRNGMVMRNGRVRLQRKGEVVFDGTISSVKHGKKEVTEMRKGTECGLEFGEFDDIKEGDLIQVVEEIRERRYL

SEQ ID NO: 20654 - protein, 497 aa, Neurospora crassa
MASSTSDAKSASSQRTSPSQTSSIKSFDLSSRSPHLAAQNGHPVPTSSAEQLPKPSEKASVKDRLTRMFSTKDPGRVAAAADAATSRNTTPGNRSTAPSPPPSAGSKPVPQRKMSITDAKAKTNGNAPPSRFVLIPEAQGGHEHHLKSSRRQEKLTDMIKGFLGRKIEQPAPENDLSLVSSWVDTLKQEKDGLATAEKKGVSTAPTTLVEKYGKCQEIIGRGAFGIVRISHKKLENGLGEKLFAVKEFRRRPEETEKKYSKRLTAEFCISSSLRHPNVIHTLDLIKDAKGDFCEVMEFCAGGDLYTLVLAAGKLEVQEADCFFKQMMRGVEYMHEMGVAHRDLKPENLLLTTHGALKITDFGNGECFRMAWENDAHMVSGLCGSAPYIAPEEYIDKEFDARAVDVWACGVIYMAMRTGRHLWRVAKKDDDEFYARYLEGRRDEEGYQPIESLHRARCRNVIYSILDPNPSRRITASQVLKSEWGREIKLCKAGEEGL

SEQ ID NO: 20655 - protein, 344 aa, Neurospora crassa
MDVVLEVTDQFMFDYMYAWLLPARPALYDFPDKTNGTAQAFSSWVYEPATKFFSLEPSQAAYQSIWTRDNIYRQALSLFLILWLFGLVTYYVFASLSYIFVFDKKTMEHPKFLKNQVWLEIKQTNAALPVMAFFTFPFLVAEVRGYSLLYDTTAEGPGRWYDFFQFPLFIMFTDFGIYWIHRGLHHPLVYKHLHKPHHKWIMPTPYASHAFHPIDGFAQSIPYHIFPFIFPLQKMAYVGLFVFINFWTIMIHDGEYYANNPVINGAACHSVHHFAFNYNYGQFTTLWDRLGGSYREPDGDMFAKEKKMSTTTWKKQVNEMEKIVKEVEGEDDRLYEPTETKKSK

SEQ ID NO: 20656 - protein, 271 aa, Neurospora crassa
MKFALAVTAFFAVATATPTPTRDSEGRVPLAKRATVSDIANLGYATQNGGQFTAAVSEKNTAPAIVVVDGVIKGNTKVRIGSNKTIIGLPGAGFNGVGLHFRRQSNLILRNIVSSFVEADNGDGLTIEKSSNVWVDHCEFYSTLARDKDFYDGLVDISHGSEWVTISHDSNGSEDTGHLHVTYANNYWKDCGSRGPLIRFGTAHIYNSYYENEYSKQVGYAVEIDNDFGGANNTAPTGTMTSSSPPYSYSLLGSSNVAATVPKEVGAILSF

SEQ ID NO: 20657 - protein, 253 aa, Neurospora crassa
MASNEVDPHGGVPAASDRPAFIPLEANPELMTSLLHKLGLSTSLQVHDVYSLTDPDMLAFIPRPALALLMVFPVSAAYESARLAEDSLLEDYSGKGPLEPVLWFRQTIRNACGLMGLLHAAINGPARQLVEEGSTLDKIIKDATPLDPVARARVLETNSELANAHKSAATQGDTEAPAATDEVDLHYVCFVKTEDGGLWELDGRRKGPLKRGELGKDDDVLSQAALTLGPLKFLERGGGDLRFSCVALASSFD

SEQ ID NO: 20658 - protein, 306 aa, Neurospora crassa
MASAVLNATVAGLSSTDTYFTVLEEVSKYNVQLSYPEKLWAAWYLWMQNDVLATGLMSFFMHEIVYFGRSLPWMIIDALPMFNKYKIQKEKRPTWREQFECAGLVLLSHCTVELPQIWLFHPIATYFGLDYGVPFPPLWKMALHICIFFVMEDAWHYWNHRALHYGPLYKAIHKIHHTYSAPFGLTAEYASPIEVMLLGIGTVGSPILWVSITKDLHLATMYVWIVLRLFQAIDAHSGYDFPFSLRHFLPFWCGAEHHDLHHERFIGNYASSFRWWDYCLDTEAGEEAAKARRDKKLAAIKAKKAQ

SEQ ID NO: 20659 - protein, 236 aa, Neurospora crassa
MADTNAPKPSSSVKLVLLGEAAVGKSSLVLRFVNNDFQENKEPTIGAAFLTQKCNLPTRTIKFEIWDTAGQERFASLAPMYYRNAQAALVVYDLTKPTSLIKAKHWVAELQRQASPGIVIALVGNKLDLTSDSAGSAEASGGGDDNAEDSGDARKISTDEAKAYAEEEGLLFFETSAKTGHNVTEVFTAIANAIPETSLKSARGPGASHAGVSRTEEQRVNLNGPRDLDAKEGCAC

SEQ ID NO: 20660 - protein, 197 aa, Neurospora crassa
MASHPLLGRGCIRRVKSKPAFSSHRSGSSKQALATFSKKNDPRVAIGLRYMHQKGFLHRDLKPLNILVDTPGPGWKVKLADFGIARNIAGPTLPIHPLHCKDWTWRTRSWITSGYVSMERTVMNKSNPKKKKKKKKKRKKKKKKKKKKKKKKKKKKKKKKKKKKKKKKKKKKKKKKKKKKKKKKKKKKKKKKNDCRS

SEQ ID NO: 20661 - protein, 207 aa, Neurospora crassa
MVTGTIKYAKTNHPLSRECVVVGDGAVGKTCLLISYTTNKFPSEYVPTVFDNYAVTVMIGDEPYTLGLFDTAGQEDYDRLRPLSYPQTDVFLICFSVASPASFENVSQKWAPEVNHHCPGVPFLIVGTQKDLRSDKELRDKLAQRKQSMIEFKQGEKLAQDLDAVKYVECSALTQEGLKNVFDEAIVAALEPPQKKTSKRDKKCLIL

SEQ ID NO: 20662 - protein, 170 aa, Neurospora crassa
MLIYSDIITGDEIISDSYDLKEVDGIAYEVDCAMIEEGAVQVDIGANASAEEADEALDDGVVKVNNVVHSFRLQSTQFDKKGYLVYLKGYMKSVKNALKEQGKSDEEIKDFETKASAFAKNVILAKFKDWEFYTGESMNPDGMVVLLNYREDGTTPYVVVWKHGLKETKV

SEQ ID NO: 20663 - protein, 481 aa, Neurospora crassa
MSAKSILEADGKAILNYHLTRAPVIKPSTLPNPTKHNPPPRLASLHFAEDADVNGVLSQAEVTYPWLLQEGARFVAKPDQLIKRRGKSGLLALNKTWAEAKAWIAERAGKPQKVEHTEGVLRQFLVEPFVPHPQETEYYINGDWILFYHEGGVDVGDVDAKAEKILIPVDLSQYPSNEELASTLLKHVPKGIHNVLVDFIARLYAVYVDCQFTYLEINPLVVIPNEDATSAEVHFLDLAAKLDQTADFECGNKWAIARSPAALGIVAQSSNTGVNIDAGPPIEFPAPFGRELSKEEAYIAELDAKTGASLKLTVLNPNGRIWTLVAGGGASVVYADAIASAGFADELANYGEYSGAPTESQTYHYARTVLDLMLRAPVSEKGKVLFIGGGIANFTNVASTFKGVIKALREYGKALIEHNTQIWVRRAGPNYQEGLKNLKAATQELGLNAKIFGPEMHVSGIVPLALVPGKWEESGAVEFQA

SEQ ID NO: 20664 - protein, 487 aa, Neurospora crassa
MTDNPEEPLIANTQSTERDQDDGSHDVEHAHDSRGGKQHISPPGLFIWLLTFSAGISGLLFGYDTGVISATLVSIGTSLSHRPLTSLDKSVITSCTSLFALLALPFASALADDRGRKRVVLFADTLFIIGALCQAASRTVEVMVIGRSVVGIAIGAASFVTPLYIAELAPATHRGRLVTMNIVFITLGQVVAYVVGWIFGTYGSPETTGWRWMVGLGAVPAVCQVVILLWMPESPRWLVKDGRSQEARAVIAKIAAGDDAQDPSTRREVDAVLKSIEIEGLQQLCGFNSLMYFSATIFTMVGFSEPTLTSLVVAVTNFAFTLVALVLIDRVGRRRILLWSLPFMIAGLVLAGYGFSFIELPNSETSSPSTTGGQGGAVIILASIMIYVAGYAIGLGNVPWMQSELFSLSVRSVGSGVATATNWSANFVIGLTFLPLMEALSPSWTFVLYAVICAVGYGLIWTVYPETAGLSLEDAATLLEADDWGVR

SEQ ID NO: 20665 - protein, 492 aa, Neurospora crassa
MALGDTVLLTGATGHLGWAILRFLLGEGYHVRCAVRKAEDEHTIRARPAVRRLNPGSRLSFIVVPDITTPGAFVAAAEDAAYIIHTASPLPSKSAHWITTDDARETFIKPAAAGTLNILDAAEQSGTVRRVVFTSSIAAIVPISQMEGKEQRTRPVLPEDRIPVDQGPYQSEFAAYAASKCRALQVAEEYMKNERPPFDAVYIHPGFVLGANTAATTEKQAMRGTNSMLAALLLGHSQGVYAGLSVHVEDVARVHVKALSPKILGDQSFILGEQVRWTDAIDIAEEEFPELFASRLLTTSGYYQTVSIPIDISLTTDTFGTGFISFTDQVKSVVEHWAKVRQPRGVPFSSTATGPQTESLGWESGKIARVKSPMVYRPSPSGGHEPSIPDVHLSLPNGIAGLEEHDYGAAVLPPATEEETWESIIQRHMIPSEAFSSSGESGGSNWSTASNHTEGITSGSSGDEEGPTNSDDSDAGDDSRVQKRNSLPSIRP

SEQ ID NO: 20666 - protein, 459 aa, Neurospora crassa
MKFLAFAALVAAVVSAFPAPELPAGIPRSLSEFKEKHPYTVKRSSHCRKTVSIRASQNDTDDVADDFLRGLKQANNGGTLYLPKDKTFVIGKPLDLTFLNDVQVHLEGEIKFTNDTAYWQKNAFAHPFQNSLMFWKWGGKNIKIYGNGVLNGNGQRWWNEFAGSEILDPGNTYLRPILFYAENTTGIEIEGIHFKDSPCWTTFFVTSKHISFKDVACTAESNNATALPKNSDFFDSLNVEHVSVERAWVNIGDDCFSPKSNATDLYVNTMYCNGTHGQSMGSIGQYSGEKSFIRDVVIENLWMLNGQHGARLKSWAGPDVGYGFIDNVTFRNFWNANNEYSAFLDSCYFNVNATTCSAYPSQVNISNVNFENFSGYTSGKYGRAVARLTCSPNAVCENIKFKNFNVTSPCGGEPVVICDGISGDLGVPCVNSTSPEAKAALKNKCSTAMATLPKPTPWS

SEQ ID NO: 20667 - protein, 188 aa, Neurospora crassa
MTTIGSLQRLSATSLSKLILAEQASTAAAAAGTENSRSTLAIIDVRDDDYIGGHIKGSQNVPSHKLDAMLPTLVRQLQDKETVVFHCALSQQRGPSAALRYIRERDRLMPKEVETKLAASVEEAVGADGEGEVKKKQGEEEGEEKKKPVDQKVFVLDRGFVGWQEAFGLDERLTEGYSKELWRDGYWM

SEQ ID NO: 20668 - protein, 355 aa, Neurospora crassa
MAEFIRAQIFGTTFEITSRYSDLQPVGMGAFGLVCSAKDQLTNQNVAIKKIMKPFSTPVLAKRTYRELKLLKHLRHENVGLPDSIAQAIGNHATNMLAQQVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADSSAVDLLERMLVFDPKKRITATEALSHEYLAPYHDPTDEPVAEEKFDWSFNDADLPVDTWKIMM

SEQ ID NO: 20669 - protein, 496 aa, Neurospora crassa
MSTSVNINGVEFQPRLLINGEFVEASDKGTFNVVNPATGEMSCKVPEATEDDTNRAVAAAKAAQPGWAALDPAKRGAYLKKLAALIREHKSTLHHLEAISMGVPVNHFFHADFGADELDYFAEAWPHIQGQSSVNTPGYVTMTFRQPFGVAACIIPWNAPLYFFATKAAAALITGNTVVLKSSEKAPLAVAYAAELVAKAGFPPGVFNILSGHGLPSGRCLARHMDVRAISFTGSSRTGKLIQEEAAKTNLKSVTLELGGKSPAIIFDDANIEQALTDTMSSIVLNAGQVCIANSRVYVQKSVAPKFIEAFTKRMATIRGGNPLDPQTQMGPQADEIQYKNILSYIEEGKKSGKLAVGGKGQLDERKGYFVEPTVFLDTPEDAKIMKEEIFGPVLNINTFETEEEVVAKANDTEYGLWAAVFTNDLSRAMRMAKALESGYVSINCSSPSIGRDLPFGGYKGSGQGREGRLHSMNHFLEIKSVIIKLDEKASLQWNM

SEQ ID NO: 20670 - protein, 309 aa, Neurospora crassa
MRTSILSSPATRALCAACRNEASRTNAGVAFSTACASKSSNRRPEVPEQSRPRVTTTTTTTTTREIQKHRLFPSARAYEYSTSSTPSDNTSPKPQPPNSSTSSSSDCNKPIPRYYALFPITLPLGPPPSGPFDIDVRALRREFLRLQAASHPDFHHSANQFDSNSSNGNSDESLLQRRKAEATSSLINSAYKTLSSPLLRAQYLLKELYDVDLAGDESTDYQNGSDPTLLMTVLEAREQIDEAKTEADLEPVREENEARIKESEEKLSEAFAKEDVEAATRECVKLRYWMGIREGCNEWEEGKGFVMHH

SEQ ID NO: 20671 - protein, 329 aa, Neurospora crassa
MVSFQGKQVGNIGFGLMGLTWRASKLSDEEIFAVIKAALDAGCNYFNGGEFYGPPDHNSLTVLKRYYDKYPEDVDKILLNVKGCMLPGLLADSSPEGVRASIENSVRLIGGKGRIDQFEAARKDPKVDIEVTMKAMSEHIQAGDIRGIALSEVSAQTIRRAAKVAKITAVEVELSIWNTEPLENGVLEACAELDIPVLAYSPLGKGFLTGQVKSFDDIPEGDFRRMLPRFQPEVFETNLRLVRKVEELAARRGCTPAQFAINWTLALSKRPGMPTIIPIPGASSPERVRENAVERELTEEDMADVERIFKEFAPVGDRYHKHGMELLDK

SEQ ID NO: 20672 - protein, 434 aa, Neurospora crassa
MADFTQKKTSSPAAPGVPFYTPAQVPAAGTPLPSTPGDVPTLFTPLKIRGVELQNRFAVAPMCTYSADDGHMTDWHLVHLGSFALRGVPLTIFEATGVLPNGRITPECSGLWQDSQIAPLKRIVDYIHSQGQKAGIQLAHAGRKASTKAPWHYQRGKSELAGPEQGGWPENVWAPSAISYNEETFPFPKEMTVEQIHELVEAWKASAQRALKAGFDLIEIHAAHGYLISEFLSPISNQRTDQYGGSFENRTRVLREIISAVRSVIPEDMPLFVRVSATEWMEYTGQPSWDLQQTIELAKILPDLGVDLLDVSSGGNNKDQKINVHTYYQIDMAEQIRAAVHEAGKQLLVGAVGLVTSAEIAKETVQEKEDGRVTIQRENGAKTRADMVLVARQFLKEPEFVLTVADELGVDVKAPVQYLRGPLSSRPKKLTTVP

SEQ ID NO: 20673 - protein, 248 aa, Neurospora crassa
MARKFFVGGNFKMNGTRKDLKAIVDNLNNAQLDPNAEVVIAPPALYLDFVKQNLQKPNVEVAAQNVFNKPNGAFTGEISATQLLDLGVKWVILGHSERRNELGESDEFIASKTKYALDNGISVIWCCGESKDTRQAGETIKFVENQLAALAKEINDWKNVVIAYEPIWAIGTGLVATKEQAQEVHAAIRSWLKQNVSDKVAEETRILYGGSVNAKNCKDLAKEQDIDGFLVGGASLKPEFVDIINANL

SEQ ID NO: 20674 - protein, 1817 aa, Neurospora crassa
MSSHDKNGRATSSSGKASSFFSRATGKNKADKRNASDEGGRYLAADNDAASTHTARSSRHYRDSSVISLDRPDTPESGLNMTAGVVTTIPYDPVSPDNRSPVALDHLPRPDQMPLRRELVPHHLNKGTGDFHQYPTIDQSPSSPYNGQSPSASSSRSTLATANITMASTGRQAQFQQWGPPRESSLPGYNSRGHSYMTTRSSGDNASIYSGRDGHYQEAPGTSHRSSRIGLPSTSSQSSYLSPHAHKDRDTQRLTKVAAGHQGSEGFNFPKPDDDNVIEQMFINLMQKRGWHNLPDQAKRQMIAYPAAKKWTLIYQDRLTEWQGEQKRRQTAKIGQYSNVDITQSSDDEGSPEWYVRKVMENALDSKGLGGLEVNLRTQQIGWVKRFIDCQGQIALTNVLLKMNRKTAYGPAQPDNGRLDKNLDREYDIVKCLKALMNNKFGADDALAHQQVIVALATSLISPRLTTRKLVSEVLTFLCHWGEGKGHVKVIEAMDVVKAQQGENGRFDAWMRLVEVTVDGRGKMGSLVGASEEVRSGGIGMENLLMEYAVATLILVNMLVDAPEKDLQLRIHIRAQFTACGIRRILNKMEAFQYELIDKQIERFRSNEAIDYEDMLERENSSIKDSIEGEVKDLNDPVQIVDAIQQRLNGTKTQDYFVSALQHLLLIRDNDGEERLRMFQLVDSMLSYVAMDRRLPDMDLKQSLNFTVQSLLDKLHTDSEARQALDEALEARQIADAAMAERDEMKERLALGADGLVAKLQKQIDEQAMFIEAQKRRAEGLKSELASLQTLRAKEAQRYELETRELYLMLRDAQDVAASNATKGNAKLGEEDVARMQGILDRERLLERLQMQIERQKTQFKLEGRVWGEVIGPSDRLRALREEMDGFGDDTPEVVPPKDFTNSMLGSVKRSTRIPRKPVGSRSDHVEDVLEESDVEIGDDGEIVYEKPRVVKIRRPVVDPKQTNGMFNELTGKVRRYDASDSEEGDGITTGPSHPSMESQTPITPSDTETPKIQVTDATGPSAPAAASGPPPPPPPPPPPPPPPGFLPGAPAPIPGAGGPPPPPPPPPPPPPPPGGLPGAAPPMPGAGGPPPPPPPPPPPPMPGMAGMPPPPPPPPPMPGMPGMPPPPPPPMPGPASGRFLAQNAGLPTTNSVGLPVVRPKKKLKAFHWDKVDTPLATHWAAHTPSPESREEKYHELSKKGILDEVEKLFMAKEIKKLGGGGAKKDDKKQIISNDLRKAFEIALAKFSQFPVEKVVQMIIHCDKDVLDNPVVMDFLQKDDLCNISDNTAKVMAPYSKDWTGPDAGKDTREQDPNELTRQDQIYLYTAFELHHYWKSRMRALALTRSFEQEYEEITEKMRAVVAVSESLRDSVSLMNVLGLILDIGNYMNDANKQARGFKLSSLARLGMVKDDKNESTLADLVERIVRQQYPEWEDFAKDIEGVIAAQKINIEQLQADAKRYIDNIKNVQMSLDSGNLSDPKKFHPQDRVSQIVQRVMKDARFKAEQMQLYLEEMVRTYNDIMVFYGEDPSDDNARREFFSKLASFITEWKRSREKNIQLEEQRKRNEASMKRKNAQFKALQASEAQGPASPTSTGAMDSLLEKLRAAAPQTRDQRDRRRRARLKDRHQVRIASGQQVPDFNEIPEVEAALQTGKSAASATTDDDGAGNGLVSPDALPPTKEAPDAEEDDVARRAAALLQSFQGGDGAEDDAEKRESLRKSRRQTAAEERNMRRRRREKAQTSTAGEEGKDESTAADGSEAAPSASAEDLSAAEAKTDGPSSPRPGTATGAEASEETETTPTATATDTNPEESKETTG

SEQ ID NO: 20675 - protein, 301 aa, Neurospora crassa
MASNKTSMAGHLRKCHGDRFICRANDCMFAGSKGDVDSHLKEVHGYLGCPEAACDFVSRHEGALSRHYIKAHARRLRDEKCRANNCSFTGSKDEVKLHMKEVHKYLECPEAGCDYMGPNKIALHQHQKGIHGEKMHCPVAGCDWDGTARNFLHHKHKHGPTYKCPEPNCPVTHTAVLLKKHIRRAHARPTFTLEMVRKCEVARQAKDHEGLDWSIINDADEDEDDEDDEDDEDDEDDEEDGEDGDDEDDEEDEEDGDDEDDEEDEEDEEDEEDEEDEEDEEDEDDDEDDDEDDGDYDDTVR

SEQ ID NO: 20676 - protein, 423 aa, Neurospora crassa
MDIDEDEDFYAPDEPQAAPPTTAATTTTPATTTTTAAPTTTTTTTSTTTASAPPTTTSSSTKPEDELEEGEEEDEGGGAMDEDDDSDIDIITERKDGSAPPPPVQSRYSEIRNIPQRAAANDNGVKTAPVKKSDGTNSNSNSSSNKFGGGGGIGNEQKTRQGSGAAGGSGAELPPVRTSKIEVDGIPVYKPVGKPITGVVIDEDLPENDKPWRKPGTDLSDYFNYGFDEFTWALYAQKQEALRGEYNAEAIAANNKKMMEEMTNMMMMGGMMPPGMGGPGGPGVGPAGPGAMGPGGPAGAGGMGGPGGGLDGMPPEMQAMMQQMMGAAAAQGMDPSQMGQMGMAGGPGDMGGMGGMFGGPGGGPGGPGTGGMGPGGPGGQGGQGQQFGGGFGGNQGQGGYGGYDQMGGAGGGGRGGRGRGRRW

SEQ ID NO: 20677 - protein, 363 aa, Neurospora crassa
MALPMAPPPKGPLGRYRLLSPTASVRVSPLCLGSMNFGDSWQDYMGECNQETTESILDFYYENGGNFIDTANNYQKEESEKWIGEWMKKRGIRDQLEIMANFGGNGTKSMRVSVEASLKKLQTDYIDLLYVHWWDFATSIPELMQSLNQLVTSGKVLYLGVSDTPAWVVSKANQYARDHALRQFCIYQGRWSAASRDFERDIIPMCRDEGMGLAPWGALGGGSFKSEEQRQQQANEGRKIKATEEQIKISRALEKIAQRKNTAITSVALAYVMHKAPYVFPIVGGRSVEHLKGNIEALTLALSDKDIDEIESAVPFDIGFPSSFLYGEKVPAHPSQVWLMGMAGTYDYVPVPKPIVPAAENGQ

SEQ ID NO: 20678 - protein, 492 aa, Neurospora crassa
MTGKGKSRWADSAEDAALEAQLKKEKEEKKRLKAEKARKAEAEKKKREAEAAAAAQRQQQQQQQTGDDDDANGPPAKRRRLSPDRDAAAAAPTASSNDSSKLLRFEGGRFGKCRSVENYDKLNDIEEGAYGWVARAREIETGKVVALKRLKIDPKDRSGLPVTGLREIQILKDCSHRNIVKLKEVVVGDDTSKIENIFIVLEFLEHDLKSILEDMPEPFLASEVKTLLLQLCSGIAYLHSHYILHRDLKTSNLLLNNRGQLKIADFGMARYVPDPPPPKLTQLVVTLWYRAPELLLGAARYGPEIDMWSVGCIFGELLTREPLLQGKNEVDELTKIFELCGLPTDESWPGFRRLPNARSLRLPSSSSSSSSSSKPPSTGGLIRAKFPLLTAAGVSLLASLLSLNPSRRPTASEMLEHEYFRQDPKPKQEAMFPTFPSKAGQEKRRRRETPNAPQRGQKVQDLGQVDFSSLGGIFGSGREREERGGGFSLRMV

SEQ ID NO: 20679 - protein, 418 aa, Neurospora crassa
MSLSNKLSIEDVDLKGKRVLIRVDFNVPLDAEKKVTNPQRIAGAIPTIKYALDHGAKAVVLMSHLGRPDGKPNPKYSLKPVVPELEKLLGKKVTFAPDCVGPEVEEIVNKADNGEVILLENLRFHIEEEGKGTDAEGNKVKADKAKVEEFRKNLTKLGDVYINDAFGTAHRAHSSMVGIDLPVKAAGFLMKKELQYFAKVLESPQRPFLSILGGAKVSDKIQLIDNLLDKVNTLIVCGGMAFTFKKTLQNMPIGNSLFDEAGAKIVPDLVKKAEKNNVKLVLPVDFTIADKFDKDANTGYATDKDGIPDGWMGLDCGEESVKLFTQAINESQTILWNGPAGVFEFDKFAKGTKATLDACVKAAEEGRTVIIGGGDTATVAAKYGVEDKLSHVSTGGGASLELLEGKALPGVVALSERQ

SEQ ID NO: 20680 - protein, 363 aa, Neurospora crassa
MGSKEHQKPKILLLGTIEHAHEAWSRITSIADIIQPTSTDRTSFLSECASGAFSSCLLAYRTFDSTTLTGPLDHDLISALPPSIKYICHVGAGYDAISIPACTARGIRVSNTPSAVDEATADCALFLLLGAMRNFNAGMTALRRNEWRGGTTVEEEQTKTIKMPPLGRDPRGKTLGILGMGGIGKCLARKVAGAFGMKVQYLNRKRDWEGEKELKEEQGGGSPRVEVEWVETMEQLLGTSDVLSLNLPLNAETRHIISTKEFAMMKPGIVIINTARGAVMDEAALVEALESGQVQSVGLDVYENEPEIHPGLLANPNVMLVPHMGTWTVETETKMEEWAISNVQMAIEEGKLRSIVPEQRNMQ

SEQ ID NO: 20681 - protein, 206 aa, Neurospora crassa
MSTGQIPPGGTYLNTLKRSFTDVPVQADNGNAIPTTEFLEAAESLVSIFDVLGSAAFSPVKSDMLGNVEKIRQRFLAAPTESETLQDLVNNEQKAKENKAGQALLWLVRGLEFTCKGLANNVAAADQELSTSFRAAYDVTLKPHHSFLIKPIFSAAMSACPYRKDFYTKLGDDQDKVNAQLKEYLAALENFVNILKAFLDSKGIKK

SEQ ID NO: 20682 - protein, 289 aa, Neurospora crassa
MSQPMRTHLVFGIGEFVGTFMFLFFAFAGTQVANTAPANAAKLPSTSNLLYIAFAFGFSLMVNVWAFFRVTGGAFNPAVTLALVLVGGFPAVRAVIVIVAQILGATAAAGLVQVIFPGPLAVETTLGGGATVAQGFFIELFLTCELVFVILMMAVEKHQGTFVAPVAIGLALFLSELVGVYFTGGSLNPVRSLGPAIVNRHFPGYHWIYWLGPVLGALLACGFFKLLQALRYDDINSGADDDGRGDLEGARHAHQDGLKHTPTNLTQPLANGEAAALHNQPAQVPREEL

SEQ ID NO: 20683 - protein, 236 aa, Neurospora crassa
MALKTLSAKAAAALDRELMSTGAFSIDQLMELAGLSVSQAVARVHPTKQGRRVLVAVGPGNNGGDGLVAARHLFHYGYQPAIYYPKRPKNDLYQRLVKQCEDLEIPFVDDFFAALESTDHVVDAIFGFSFSGEVREPFPAVINAMAETKVPVTSVDAPSSWDINEGPPKSGVGSNFHPNVLVSLTAPKPLVKYFKGRHFVGGRFVAPSIAKKYDFDVPKYEGIDQIVEITDNQVKI

SEQ ID NO: 20684 - protein, 351 aa, Neurospora crassa
MTSHPEFNERTTGTEVASVFADQIRGKTILITGISPKGIGASTALAFASQSPALLILASRTKSKLEAVAEQIRTKFPSCHTNTRIELVSLDLSSQSSIRQAVTDITRLLIGGNKLDILINNAAINTTTRQTTPDDGLGLELTFGTNHIGTFLFTNLLLRNNLLSPPPPPPARIITVSSAGHRLSPMRFSDYNFSHPEKEVPAEEDYLKPLPGAFAKCTEDGYNGMVTYGQSKTANILFTLYLQKRLKGRRRGVGAYSLHPGTIETELGRDQDPEVKQEFHKIEAYWKSLDEGCATTMVAALDPALDETKGLYLVDCQISDPHPHAQDEVAAERLWKLSEEIVGEKFTLEDF

SEQ ID NO: 20685 - protein, 476 aa, Neurospora crassa
MAETYTVPFFINGEEVRTSRTFDVTSPATQKVVHKCSSATDTEVQAAVNAAAEAFKTWRKSHPNQRRDLFHKAAEILEKRKEELGQYVMDETGAPRQWADFNIQVAKDLLMDVAGRCNTLEGSFPVVNDPESGALVLQEPYGVILAVAPWNAPYILGIRSILYPIAAGNTAIFKATELCPRTMWGLCSVFHEAGLPKGVLNMLVHEPANAPAITSSLISNPQVKKVNFTGSTAVGRIIGRLAGENLKPVLLELGGKASAIVWEDAELDNAATQCALGAFLNSGQICMSTERILVHKSVRAEFEKKLVRAVENIFGPPTPAPILINSLAVDKNKKLLSDALSKGAKLLYGNPDAQEETTTRMRPVIVSGITTDMDIYKTESFGPTVAVYEIETEEEALRIANDTEYGLTSAVFTEDLRRGLRMAKEIETGAVHINSMTVHDEATLPHGGAKASGYGRFNTSRGLQEWVKSKTVTFKF

SEQ ID NO: 20686 - protein, 374 aa, Neurospora crassa
MRSFVFFYLGIGGVAVHGIPHSFSSSSSSSFWVSSNNRGHPASLDDSTVDDIDIVTGSQFHGLKTFASLPLSPDDQEPVMGRQELELEVNALEDSITTRVTAPRFQLTRCNGWLLADEDALHEWATIVDCGDATLTWLDNTVAFKHLDKAHRVISGRPTANDTVATVPRILTLGGDHSTTLSALRSTFRRWGQVSVIHFDSHIDTWSPDVLGGISDYAGLNHGTFLHIAHEEGLIHNTSIHAGTRGPIIMHSDRDNDKRCGFAVITARDIDKHGIDWIISTIKARVGNSRVYISVDIDVLDPAFAPGTGTAEPGGWSTRELLTIIDGLRGLSVVGADVVEVSPVYDNTGETTVLAAAQVGLSLISLMVARPVSD

SEQ ID NO: 20687 - protein, 369 aa, Neurospora crassa
MGKSTKDSKKRSRTAEEDVNSIAVVKKSKLDESGNAEVTKVETEAPKVKKDKKDKKEKKSKTETTEEPKEEKKEKKDKKKDKKEKKDKAAATEESKTEEKTEESADKKSKKKDKKKNKDKTEEKKTEDGGEEATNEEEQSQANGAKGARFIIFVGNMPYSITADDIKEHFASVHPISVRLLTHRDNPTKSKGTAFVEFGRFDHMKTALEKFHHSEMLDDKGVPRKINVELSAGGGGKTAHRQDKIKEKNRKLNEERLNRQQNQEKAKQEKAAAKANGGDGDAAAAAPAPERNDEDAIHPSRRARVAYDGNPGGGDFDEEDSYGGGGGGGGGGGGFGGRGRGRGGGRGRGGGRGGGGRGRGGGRGSYKKW

SEQ ID NO: 20688 - protein, 160 aa, Neurospora crassa
MLTGEMLTLDFLLLTCLLISYTTNAFPGEYIPTVFDNYSASVMVDGKPVSLGLWDTAGQEDYDRLRPLSYPQTDVFLICFSLWHPEIQHHAPGIPIILVGTKLDLREDPDTIQSLSQKRMAPITFEMGVNCAKEIGARKYLECSALTQRNLKSVFDEAIR

SEQ ID NO: 20689 - protein, 368 aa, Neurospora crassa
MSGTDYKFEGWLGFDKSSAHGNMQWGEFEPKPWEETDIDIKIECCGVCGSDIHTLRSGWGPTNYPCCVGHEVVGTVVRAGSKVEGGIKVGDRVGVGAQSDACRNRTDKHCKICADGNYNYCRVHHVGTYNGVYMNGGKSYGGYATYQRVPSFFAVKIPESMPSSHAAPMLCAGVTTYAPLKFHGVGPGKRVGVIGLGGLGHFGVMWAKALGADEVVVISRSSSKKADAMAMGATGFIATGEDPEWLNKNRSSLDIILCTASSADMPFNDYLFLLDLDGVFIQVGAPDDDLPRIKQMALIFNRIKLTGSLIGSPDDIREMFQLAVDKKVQPWISEIPMKEANKAIVDFEDGKPRYRFVLKNEDYTPVQA

SEQ ID NO: 20690 - protein, 1687 aa, Neurospora crassa
MASPYDTLLSYAQATRQLRLKAASGLDCSQQQQVLNSFRVSYTSLSAFIQPSSKPALSTPDLSTALTHGSLRDFTNNFALPSKALDVPQRGQLTKPIVCIALPNGPVLAAVCLAVANTCTASPVNCDKAVGAEQFRADVRQTGASVILTSAKDAERLGLTGPSSWTALEGLTVLLVESDLAQRGQPTQISIRDLTGQLVTPQVAGCSQPAPNGTDDVAIILFTSGTSGTKKLVPITIQNIVAGVAFVIDSWGLTPDDVCLNMMPLFHIGGLVRNIFSPIFSGGSVICCSAFDPTLFWDVMQDHGATWYYASPSMHQMILDQAEDRPEALAKSRVRLVCNAAGGLLPALAVKLKETFNGAIVLPSYGMTECMPISTPPTNYKLDKPGTSGVAVGPELAILDWNNIRQPSDTVGRICVRGEPVFPGYLTAEGQYDSSTFTPDGWFDTGDLGRLSSDGYLFITGRSKEVINRGGEIISPFEIENAIIAAAQDPKSPIFNRVLQALSFSVRHDVLQEVVGVVLVTPPGAQRVDTRQLHQALKQSLQQVKWPGLIVYMEDVPKSNNKVLRIKLADRLGLPELTDSSRYCDVHYEATCPPPNTPLSVSISSTLCSIDGTTVYRGITALLPLETAHHVHQNPQSGGFEVYLAPKKEISDVSELNKVIDSLKSKLPSLVSGYLVPHRFHILQSPLPVELGIAPTREALESLLYKENNRPGTSDPSASGNTASQVTRIMASILSLSAHEITVDADFFDLGGDSLRAGRLLSALRSEFGLSLPIDLVFRGGSVDALSAFIDEKLASRPSSSAYTSYSDTTLCDSDAEQQARCEGLPTPIKTHSSTNPFLMVLQLLPMAILYPLRRGVHWAIFLLTLAHMERWPTSRWPFGRLVNIVTTLLFARVVMSVVRPIIGILAKWLIMGRYKEGVYPMWGWYHTRWWLTQKVIALTGQGIFRHHNYTIVWYYRLLGAKIGSGVELNDCQLGEYDLLTIGPNAFLDKCIVRPFGAEANTSMYLGKIMIGANASVGLAANVAPGTQVSDGACIGPNSCSWELNDATEANRDLSVHRAPQPHWALTLFLTMPLYGLVSLVAGGPWLLGMVGLVEGRPPRAVAPLPDIITWWAGNDRIGYHYLAVGLGVMFGPFFEFAAVMIIKTLLDLMFGKLKPSSATGRGQIERWRLDLMRTIYPNRSLKTLTGLFGQHYEMTSVILRMLGAKIGKRVYWPGTGPGITDYHLLEVGNDVVFGSRSYLVTSDGLGSEPIKIGDRAMIADRVVCLPGVTVGEDTVLGSGALTRRNKEYVANGVYVGSKGGDSLCLSTGAAPKGGDKSRVSRRNARAAQQPAQTQEENTFIESVRYPQGTNDPEEGRSTPSIPITRPVSDIPGDFTHSNSDTEAEDPTSAPAVKSTPFGRAFYLGLAPYHVYSPFTITAYSIFNRLFTALYWTAPSISTIQIINVFIARHPDHPVSHAILSQPMALFGLLTAVFAVFNTLLAFVALLITIAAKWILLGRRQPGTHSWDISPYCQRWQLLLSIEQLRRTCFAGQGVLGMLTGTCFTVAYFRALGAKIGKDCALFVNGRPSLVFTEPELLVLGDRVTVDDASLVAHINTRGKFDLNRLRVGDGAVLRTGSRLLSGAEMQRDACLLEHTLVMGGETVKEGVTVQGWPGEEFRRVGRRELGWNQGLWTPGVNDPTNQRDNK

SEQ ID NO: 20691 - protein, 243 aa, Neurospora crassa
MLTCLTFRVPTASPLHPTSSPSLSRLDRSPPPPPPKNPADDATRYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMTDKKVVEYTVAKEFADSLGIPFLETSAKNASNVEQAFLTMARQIKERMGSSIATNNTKASVNVSPGHGVSNNSSGGCC

SEQ ID NO: 20692 - protein, 200 aa, Neurospora crassa
MASGSPQNVIRRKLVIIGDGACGKTSLLSVFTLGFFPATYIPTVFENYVTDCRVDGKSVQLALWDTAGQEDYERLRPLAYSKAHVILIGFSVDTPDSLDNVKHKWVTEANERCPNVPIILVGLKKDLRGDPVAIEEMRKRSQRFVMEDEGQRIAKEIGARKYLECSSLTGEGVDDVFEAATRAALLTFEKKEGSGCCVIL

SEQ ID NO: 20693 - protein, 168 aa, Neurospora crassa
MADAVEDAGSVSEPMDLVRLLLDEVVCVKLRGDRELKGRLHAYDSHCNLVLGEVEETIYVVDDEDTEEDDLKAVYVERPVDEHDFRHRYGIKPFSGGPLGQDRLPIGRWNLLHVADEAQFWEGVDREEEEHLEEKGKETATAEGSGQSAAEGGGYLKVERGGAYKGNR

SEQ ID NO: 20694 - protein, 364 aa, Neurospora crassa
MSCRRRLVFLPAAAEVVLSLVTVVVMAWGGHLYGPVYVSSLRGLRGSLPSPDEASRQSQTATHGDYEAFLLRQFVPPSSRDAYNALRTLNLELARLPETVSNPTIARMRMSFWRETVNSVFAGNPPREPISILLHQAIQDLKARAGPNSASSLKFWLLRLINTREQHMENRPFVSLNSLEDYAENTYATLIHIGKACGIVATLRGIPVLAAPSQPIQGPAGSVGNTRHPALLLPLDVMAEVGVREEDVFRHGPNAEGLQDSVFKVATRANDHLITAREMLKNLKAGEEVGHDYEHEGEQEHIYSSGGVDATQADIKRGFGVLLEAVPAADYLERLEKADFDPFKVKASWKLPWRLWRALKTQHI

SEQ ID NO: 20695 - protein, 353 aa, Neurospora crassa
MDYIPFLSGGVSFNPRTDIPSSALHGKTILVTGGNAGLGKQSILEFVRQPAASLPSRIWLCSRSLERAQSAIDDISAAVQSSGINSDFDASSIIKPLELDLTSFDSIKSAARTVLAESDRLDILMLNAGIMAAATGVTAEGYEIQFGTNHVGHALLTKLLLPLLLKTARSAKGNDLPQPADGTPTAPPDVRVVVLSSEGHRLPPLLGINFATLKSDQSSMLTWQRYGQSKLANILFGKQLAAHYPEELTVVALHPGAVNTQLFQPFRNSGWIGWAVTGFLKFFLSTVEDGAKNQVWAATAPREQVQSDGKGKCAYFLPVGKRVGESGWAKDEELASKLWQWTEGELEGQEVDA

SEQ ID NO: 20696 - protein, 368 aa, Neurospora crassa
MAAPEVHHLFHHPIADHSFSADRQTLAIARDTQVELYGRVGNAFKLKDELKGHDKLVTSVDIAPNTGRIVTCSQDRNALVWEPSPTGYKPTLVLLRISRAATFVRWSPSEAKFAVGSGDRVIAICYFEEENDWWVSKHLKKPIRSTITSVAWHPNSVLLAAGSTDAHARVFSAFIKGTDQRPEPSPWGERLPFNTVCGEFLNNSAGWVHSVAFSPSGDALAFAAHDSSITVVYPSAPEQPPKAVISINTQLLPFMSLFWNGETEIIAAGYDCEAFRFQGGEQGWQLAGTLEKAKAGGRPGLGDEDREESALNMFKQMDLKGKVSKDDTMLKTVHQNTVTMLRPFEESGGRVTKFSSSGVDGRVVIWHT

SEQ ID NO: 20697 - protein, 329 aa, Neurospora crassa
MPQLVGKQVGPTGYGLMGFCTKNPPTPKEQAFKAMRAALESGANFWNAGEFYGSPDWNTQKLLAAYFKQYPEDAEKVVLSVKGAFLFPQMIPDCSPAGLKRSIDACLADLDGTHKIDIFEPARIDPKVPLEETLKYLEDEYVSKGIIGGIGLSEVSAATIRKAVKITKIAAVEVEISLWATHTLENGVAEACAEFGIPLIAYSPIGQGMLTGQIKTLDDLAADDFRRHYPRFYPENFHLNIQLVSELNELAKKKGYTPAQLAINWVKSLSKKPGYPTVIPIPGATTAERVKENNVDIDLTSEDLKKIDETLKKFEIAGRRYPDAVPIDG

SEQ ID NO: 20698 - protein, 274 aa, Neurospora crassa
MSILQIPYREGRDGFWGEQTSTLNWCEEDYNITYYCAELVNTLTNLMFMWLGVKGLRNVLEFKHSPIFILAYVGYLVVGLGSMAFHATLKSTHDLYRLYHVLCHIFLQEIPEDPITDCLDHGWAWYLHHCKQVMISFGRSLGREILPRAAGLCARCGRWHWFVSDARPFVPNEDYTDTWNIIAIITFVGGFFIWNMDNIFCRHLTTAKNQLQLPWSIVLEGHGWWHILTGLGAARRRNSCLIGGLGGLFLRSFPEPTRVQPRAANNIRQEGERP

SEQ ID NO: 20699 - protein, 503 aa, Neurospora crassa
MASTTDYKIDFTNFYNIINNELKSTPTTRAAVNPSTLAPLPAVPVSTKADVDAAVSAAKAAFPSWRDTPIEKRAALLNTFADAIMANFMDFASLLALEGKPPTAAQFEVDFAVKHLKGTAQLRLDDEVIEDNEEKLTKIRYTPLGVGVGIVPFNYPFFLGLGKMGPAVLAGNAFIWKPSPYTPNTALKLVELAAKIFPPGVVQALSGEEDLGPWLTAHPDIRKISFTGSTPTGKKVMAACASTLKRVTLELGGNDAAIVCDDVNLDEVVPKVALGCFNNAGQVCVDIKRLFVHEKIYDQFLAKMVEVVKTFKFGGSEDTEGAFFPPVQNAMQFEKVKELFSSIEKEGLKPVIGGEVEAEAGAKKGYYFKPTIIDNPPENSRIVQEEPFGPIVPVVKWVGGEDEVVRMANNTDMGLGASVWSKDLEKAERIARRLEAGSLWINTHQDLAPNVPFGGFKQSGMGHDWGVIGLKGWCNTQSLMTRRSGVCLPRHDPGPIVIGVNFR

SEQ ID NO: 20700 - protein, 302 aa, Neurospora crassa
MSVLITGPSEGGLGAETAISLAHANPALLILVGRSLNKIQPTIDAIHAVNPSIAVKFIAADLTSLNSVREAARSILDDASIAHIDVLINNAAVMACPYELTVDGFEMQFATAHLGHFVLTKHILPKLRASAGAGKPQTRIINVSSLGNTLGGIRWDDPSYTKRPEEYKPWDAYGQAKTANVLFTVALNKRLLAKTGIRSYALHPGGIYTPLLRHMNDELMEEITQRVTKGEMQLKTVQQGCATTLRAALDPELEKAGEDGVFLSDCQFTKDPELVAPRALDEEDAERLWGLSEELVGEKFEL

SEQ ID NO: 20701 - protein, 291 aa, Neurospora crassa
MARRGKYSEVFEGINVVNYQKCVIKVLKPVKKKKIKREIKILQNLAGGPNIVALLDVVRDSQSKTPSLIFEYVNNTEFRTLYPRFNDFDVRYYIFELLKALDFCHSKGIMHRDVKPHNLRLIDWGLAEFYHPGTEYNVRVASRYFKGPELLVDFQEYDYSLDMWSLGAMFASMIFRKEPFFHGQSNSDQLVKIAKVLGTDELFDYLDKYEIELDAQYDDILGRFQRKPWHSFINAENQRFVSNEAIDFLDKLLRYDHNERLTAKEAMAHPYFAPVRDEATRARYLAGETIN

SEQ ID NO: 20702 - protein, 273 aa, Neurospora crassa
MALRRAARVILVGAPGVGKGTQSERLLRRFPQLSSISSGDLLRYNVQQRTPLGIKVESVMKSGGLVSDDIILRLISNELTQRGWLNSAHPAGNVLTLASSALSAEGAHSFQDDAEVAAFLSSPAQARGFMQSQLSNDPAHSFLLDGFPRTATQAKRLDEIVPINLVVSLKTPVEVILERISGRWVHEPSGRVYNTTFNAPKVPGIDDVTGEPLVRRADDDEKVYLARYKKFQETAEPLLEHYARQGVLWEVEGMSSDEITPKLISEFERHFVE

SEQ ID NO: 20703 - protein, 449 aa, Neurospora crassa
MDSSVTTGRSGIGTGQGSPAASGQPISKAGQAIPNLRDRIPKLEPRRRKQEPSNPTPVPETPALPPRPDPSTLVFQTPVRRILLLKDHELFLASPSFNLILSFVFSLSESVADTPISAIKDSDLSEPVKAILRILDETEALCKESPPDDQGGSRFGNKTFRLFLDKVKQRGHQWHAAFLGGKLPDAAVTEASAYLNQSFGNRTRIDYGSGHELNFIMWLLCLYQLSVLEQSDFKAVVLRVFARYLEVMRLIQMTYYLEPAGSHGVWGLDDYQFLPFLFGASQLLHHHFITPRAIHQELTLEEFGHDFLYLGQVAFVNSTKTVKGLRWHSPMLDDISSAKNWEKIEGGMRRMFVSEVLKKLPVMQHFLFGSLIPAAEGMSEQDPNALGSEENEEEGGEVEVYDDSDGKRHVHQPTGWGDCCGIKVPSSLAAAEEMRKRGQVESLRRIPFD

SEQ ID NO: 20704 - protein, 454 aa, Neurospora crassa
MADLVGRKIFKVFNQDFIVDERYTVTKELGQGAYGIVWYVHLLLLPFLLSRLCFWAAAHLHVSCHILMIQADLPFLLNSAAVNTQTNEGVAIKKVTNVFSKKILAKRALREIKLLQHFRGHRNITCLYDMDIPRPEMFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQNYTKAIDVWSVGCILAELLGGRPFFKGRDYVDQLNQILHILGTPNEETLSRIGSPRAQEYVRNLPPMPKKSFQQLFPQANPDALDLLDRMLAFDPTSRISVEDALKHPYLAIWHDASDEPDCPTPFNFDFEVVDDVGEMRKMILDEVFRFRQLVRTVPGGQGQGGAQPQAPAQVPMPTDVHSQQWTAEDPRPHEYGAYNGGLEAELGGM

SEQ ID NO: 20705 - protein, 137 aa, Botryotinia fuckeliana
MTGGKSAGGKAGTTKNAQSRFHPKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQSLLPKKTAKTAGGKPASQEL

SEQ ID NO: 20706 - protein, 1786 aa, Neurospora crassa
MYQNGQRDPPRPFAVPPPPPPMSPPQVGSGVAGINSVMNIPPPPPRYPGAPGTVGGSLLPPPPGPPPGNPGFPPSAIAPPSALGAAPWHGAWGRPYNGQTAFNLPPPPPGGNGGLQAYNPLLHAQAAAAAAAAAASASNTPGPPATSITIPPPPPPSEQMSATYIPSAGDTYGEGVGIPGLGLPEELGGPGNWTGAEQQRLGGTSMEDAHRLHAAPTADRGLSTTSNTPNSSSAIPPELAAQWPLDRVLMWLQANSFSQDWVNTFKVLNLHGAQFLELGSGHGGRGNFGMMHQQVYPQLAHECQMSKTGWDQTKEREEGKRMRRMIRGIVTGRSVDPSKVAASGGAQGGAGGAGGGGHARRESVSASVPPSAGPDSADSPNVEFSKSHLFVQEEQVQSGPKAPGPGFAGRRFSQSRATTMPLLTSTMSSGEPNHRSMMRNLDIDSARRHSPSTSNVSESGDLNAGTFRTVGRERQDSPIGGSPNPSSALFPSNAGNTILSSSPHRSGSRFGHRSRNSSDSVSSNAAQYGSGIPADAAAMFKNGSLADMIKNSFNSNNPDRRNGQDGGRPLGVVETGDRSAGTDPPNSAKGPKSFLSFLSRNKRKEDGTSPDELDSPTSPATGFKAHSLGSRAGHVSETSLDQRPGSSISTHEHSVGFQSGHSRKKSVVSTRVYLLATLDHWNYRMLDVTDIDSAHDLRQLVCINLGLPDSEGAAIYVTELGKFDHEEPLDDMKLLTNKRLRADAIGTLKLFVKPGGLTSSPYPGPGTQSGQPSSYVPRDAPPMDEETFNRLNGQRQRSSSSPPTSRQNTISSKDRDEKMPVPEPVEHKAEPPRKHAIKETSPIGETTPFGIVGRKVDFDQPRLSPFEDKRPDHLFPVRKAPAPPGDPSATLKKVNSLSKKTGQGFRPSTAHATQHHHHNAIDHGYHQRRVSTDIRENMTSERQTRRPAAIRGTAEVPSPSGGIGSLLINIGGHLGGIGHPVAGGARALSPNRVASAPVGHGGEMSEQQRDAKLRYQAARAPSPSLSPNARRRPSESHISQQQYQQNHRPPSSQQHHPHLQHQAQPQPQPQPQQQQQQQQQQQQQQQYQPRQQQTQQPQQQQQAQQPQQQQQAPAQHEESKRKSHGPDVDFSDNDVRFTPPPESESLNASSNHQDYADDQDDSDDSDDGLFAVPISKNKTAETSKTKDNSGGSDEGLGKRPSLKVATDRSKKNLSVAFTTPQASPRMASFTDETEHASVPASSGHGHRQSAPVPSGSSKEWEQDETECKIGRRKSFIEKDVWANRPPTDALINNLEDFFPNLDVDQPVLEEGGDTEVEVDAPSPIAEVDESQFQTRPQPMAETMAQSNTAVASSSNNNAPMLPPLNRVSSAFNESDTLGSDESTLKALESRPPSMVSGSVRRSRGLGRMKSIREVARGAHEAHKRYTQTSMQTNVATPAVPNATTNLMRRKSTKMFNANIVQIEPRRGSILSTIPQETLPTQDNINTLPKRQTTFRWFKGQLIGKGTFGRVYLGMNATTGEFLAVKEVEVNPKAAQGDKKKMQELVAALDQEIDTMQHLDHVNIVQYLGCERKETSISIFLEYISGGSIGSCLRKHGKFEEPVVASLTRQTLSGLAYLHREGILHRDLKADNILLDLDGTCKISDFGISKKTDNIYGNDKTNSMQGSVFWMAPEVIRSQGEGYSAKVDIWSLGCVVLEMFAGRRPWSKDEAVGAIYKIANGEAPPIPDDIREEITPIAIAFMLDCFTVDPTDRPTADVLLSQHPFCELDPNYSFMDTELYAKIRGTY

SEQ ID NO: 20707 - protein, 1123 aa, Neurospora crassa
MQTAKGKAEALGRKAKLASSYQELLDEFSSKDLRSVGNYTLGRLIGKGSFGKVYLATHKLTNGSKVVLKSANKDDTNLAREIHHHRQFVHPHIARLYEVVVTENLVWMVLEYCPGDELYNYLLQHGKLPVDKVQRIFAQLVGAVCYVHRQSCVHRDLKLENILLDKHENVKLCDFGFTREYEGSAKYLQTFCGTICYSAPEMLKGEKYAGEKVDVWSLGVILFALLCGELPFDDDDEQVTRRKILGEEPVYPDTLPEDALSLLKTLLSKRPLIRPSLPDILAHPFLAEYAPQQQEILKLEHPPPFSTPLEKETLHRMRSAGVDTEAVMESVIAQKCDALAGWWTLLIEKEERKAARRERKRREKEENRNSRRFSQASSRLNALATVEESQYAPFGEHSQRPRGRSESRRSGHYPALLIPDMPNLADYPRSATDTRSPIEGDMPPPPLDKDSIRGRSTSSSRHRKPIPPPKEGILRSARSRGSTLHLVTTSEVLDLNGSLQLPDDQNQVKKRPSKTKIFWKNWTHWLFESTRRHKNSQKRASQSTPNLADKAAVQSVKDGKSKDGDIQRPQTTNGYANKASPALSAGSAPFKNSNGCVGLSSSLPSSLPPVPRTYTSGSHKRQSLSPSPVTPRSTMRRASGTAGLRGRKSTSSSVSSIRSMHPTHHHTHSKASSTSSNNSVSTSVSKSALQASRSPHHSVKVLPATPTTVGFPSNIRYVRDRTGPPLGIGSIGGPSLFANSPNDYGSSDDGRLNAAFLGNGGGGRGGLSALNTNTQYYHMPPAPGSPNPFASVNSGGYFAPRAPGNGSPVVGPGGHGGVMFAKRKKNIFKGPVLNFGGSSAGASSRQREERSNSGASGSASASHSRSASASGMGRRSGEITIQEEEEPGEEEEEEQNAHGGGGYTGGGGGGYHNSHWGGSRTGAGWGGLGMAGMEEEEEVEEVDSFSPIITGPGEIVEERIIEDGEEEEEDDDAQESADEGTITDQRSRRSRPRSQDYDEEEEGMDVAGDARRHSNSNSNSNSNPIQTPTRPSAHGVEEEEEEEDHVDVGEEFKGLGYDVGVAITTAPHRLSADGPPLSSSTVRAVPEQQQKRGHRRGWSNGTSSSGGGGSNNNGEGSSGKVSR

SEQ ID NO: 20708 - protein, 452 aa, Neurospora crassa
MSAANGRQPEVQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYYESDAADLIRATLSAVAYLHDHGIVHRDLKPENLLFRTPEDNADLLIADFGLSRIMDEEQFHVLTTTCGTPGYMAPEIFKKTGHGKPVDIWALGVITYFLLCGYTPFDRDSDFEEMQAILNADYSFTPLEYWRGVSDNAKDFIRRCLTIDPAKRMTAHEALQHPFVAGWARGTDGAEADKGANLLPTVKKNFNARRTLHAAIDTVRAINKLREGQFMNGGRSREPAKKAAAALGPTLGKEASMVSTASSNVTKDSGYATQPEGEGGSRDGDDVLMKDASVPAPTSSSPAPCRVSYGRAVSRIRLSRLVKACGMGLVLSDDQFLGLSSLTNGGWFCSIVIIF

SEQ ID NO: 20709 - protein, 436 aa, Neurospora crassa
MSRILARRCPQGLLRQAFSPSRTNVTTTPVRAFASATSNAPSFNWEDPLNHKSLLTEDEIAIGETAERYCQEQLFPRVLQAYRDEHYDPKILEEMGDLGLLGATIEGYGCAGVSSVASGLITRAVERVDSGYRSGMSVQSSLVMGPINDFGTAEQKERFLPGMAKGKIIGAFGLTEPNHGSDPGSMETVARPHPTKEGVYLLSGSKTWITNSPIADVLVVWAKLQETGKIRGFLVERSACPPGTLETPQIKNKTGLRASITGMIQLDNCPVPKENMFPEIEGLKGPFTCLNSARFGIAFGMMGALEDCLARARTYALERKQFKGNPLAKYQLVQKKLAEAATDVAYGTLAAIQVGRLKDEGKATPEMISMIKRQNCDRTLYHARTLQEIFGGNAVSDEYHIGRVVANLYVTQTYEGQSDIHSLILGRAITGVQAFV

SEQ ID NO: 20710 - protein, 379 aa, Neurospora crassa
MKITASLLPAFLGSAMAASIPSTSGNHIKASSSCTFSGSTGFDLLNKGHSSCQEIVISDLQVPAGKTLSLDKLNPGTTVTFSGKTTFPYTSSGFAGPLLSISSSSKLTIRGLSSSVLYGSGEKYWDGLGQKGPIKKPKFFQVHNLEDSVIEGVTILNAPVQVMSINGCKNLTVTSFTLDNKAGDGDWKAGKGGRNTDAFDIGSSSNIVIDGAKVYNQDDCVAINSGTDITFRNGLCSGGHGLSIGSVGGRSDNTVKNVLFENSVIANSENGARIKTNYGTTGLVSNITYRNVKLQNITKYGIMVDQSYGSSSKNASPTNGVPITGFTLSNVTGNVLSSGTNIFINCGDGSCKQFEWNQVDVKGGKKSSKCLRVPSGAWC

SEQ ID NO: 20711 - protein, 1233 aa, Neurospora crassa
MDNRTGSRVSVRQPLGDATNRANIAAMQTSSRPKLEANAKSWKNTNRSKSNPPIITDIPLVQHHIVTIPSPVAVPDVPSMSRLRHPSSLQQMNTQASDARRVSQFSNVSSNASITRLQKTHIGPWQLGKTLGKGASARVRLARHRTTHQLVAIKIVAKSTAHVTQATSMANLDRVDYRKPSISTDGVRRMPLAIEREVAILKLIQHPNIIKLHDIWENRQDIYLVTEYVEKGDLFDFINWNGSLNEEEAIFYYRQIMSALEYCHSFNICHRDLKPENILLKADGQIKIADFGMAALHQEPTHHLKTACGSPHYAAPELLKHQPYKGSAVDIWAMGVILFAMLAGRLPFDDSDMDAMLQRARKGYYKMPSELSREAKDLIRKILVVNPLQRITMKQMWKHPLIKKYDYVDDYQQSDGQPQDVLRNADIGPIPEKEVDPQILRQLKAMWHAYSEAQIKEKLGQTKPNDQKVFYWLLYRHRHAQLENYNNDIPISKSDFHHLKPPNWGKRISTCEFTQSSRNGHGRSISKFTVISNVAEVNDSGTVRSYDPYRASQVLRNCASEASHARIIVHRNPSEPGTRSNTSNIAHSYNSYTSFGGSFRRRPRMSSQRTNTTGRLRSSMGSMGSLRSLNGTPRVRANNRSRRGVDFSSIRARDRLQARVRENVRAAPSSAAGSSVVDRRNSCRQQQRQKAAIIHSADNTLKSRDETLIWDEELQQLGYRIAMDCDEAFRSSLVGSETSVAVSGSRENSPFSLSLGASSPSPQPESPTALPLQQQAVNHSWVNRPLPPIPSIEISPVVNQTYGVNVVRPAPLRIERLSLGNCASASQTLVPDRRIVSEPVYTTPANRDPRQLPSINETASEDWTRNASTRWASPDTPSPAENNKALNYLARAENTIRVVNSPTAGPVPMPEPLNVRKVSKATPAASGESNYRKTALSNIPPDFKENCPPGTQQEEQGVGDNTVNAGAPAKKRVPSWFRRSSKDNTSFATTANTAAIHNDSTIISDIHQQLDGLESQSSARPDPYPNKKKAFSLAFWKGSKSENSSPTASTFDISTSKEGGGKKHKSSKSESRVVSGATSQSWGEGEGVGRQIEVQQNWLARLFRVKPATRHLCFSMPRRRARQEVAILLREWRQFGIKDVEVDKERNIIFARVGAQNVHNVKEVSFAIEIMMVIEHGKRNQRTQLSIARFTQEKGAASSFHKVVDAINVEFRNRGLLVTDKRKTQMMIKTLNS

SEQ ID NO: 20712 - protein, 485 aa, Neurospora crassa
MGLRPPKIRDSGLFGIKFIKTNVKMAAEHKNLQFWQQMFRSIGGYTGEVRLVGHRIIFTSEPENMKAILATQFEDYGKGEGFHQEWKDFLGDSIFTTDGDLWHASRQLIRPQFIKNRVSDLQCFENHMQMLFRTIANGGALNGEDQMVDMEAGNGKPVDISDLFFRYTLDAATDFLLGKDIKSLSTPVQPFADAFQEVQRVQIVIARAGPLNRFVPKKTFWEGLKVIDETINFYIDRALRLDEEELASKSKGDEGYTFLHALAGFTKNRQVLHDQLMAVLLAGRDTTACTLSWAIYELARHPEAVAKLRAEILSVVGPDRAPTYDDLKSMKYLQNVMNETLRLVRMALKDTTLPRGGGPDGSQPIVILKDTPVGYSPLAMQRRPDLYPPVSEKFPDVEMFSPDRWFHWQPKPWQYIPFNGGPRICIGQQFALTEMGYVLTRLFQRYDRVVSYMDEIDGGKPRMKTDIVLMPGDGVKVAFFEAKRE

SEQ ID NO: 20713 - protein, 328 aa, Neurospora crassa
MPQLVGKEVGPTGFGLMGFTWRPNPVPQEQAFATMRAALSHGLNFWNGGEFYGQPPYNSPILLERYFSLYPEDADKVVLSIKGCGGVDGMHPDGSATEVRRSLDTVIQQLNGRKKLDIFEAARRDPKVDMEETFGVMQEYIDKGLLGGISLSEVSAETIHKAVKITKVVCVEVELSLFATEVLDNGVAAACKEYGIPLIAYSPLGRGILTGQIKSRDDLSTFPMLLHFPRFSEENFDINIQLVRQVEEMAKKKGCTPAQLAISWTRCLSRRPGMPEIIPIPGATTVERVNENAVFVELTDQEMDEIDATLAKFDVKGARYPDWIPTDT

SEQ ID NO: 20714 - protein, 353 aa, Neurospora crassa
MSKAADIPKEQWAQVTEKDGVITYKKIPVPTPGHDEVLVNIKYSGVCHTDLHALDNDWPLPRKTPVIGGHEGAGVVVQKGELVTNVDIGDKVGVKWLMSTCFHCTFCQQALESLCPKAQLSGYTKDGTFQQYCVANAAHLARFPPQTDLSAVAPIMCAGLTVYKGLKESDTRPGQYVAIVGAGGGLGTIGIQYAHAMGLNVIAIDGGKEKGEACKKLGASMYIDFKESKDLVADVKKATHDGLGPQGVVLLAPQEQPFQQATGYVRSHGTVVCIGMPAGAKVSMPVFDTVVRMIKVKGSYVGNREDTAEALDFFLRGKVHAPYKVIGLSQLQSVFDEMRANRVIGRYVMDMSK

SEQ ID NO: 20715 - protein, 369 aa, Neurospora crassa
MGLAAAKNKRKLGTDPNNTKWSRNETTFGQKILRAQGWQPGEFLGAKDAAHAVHHTEASSSHIKVTLKDDNLGLGAKRNNGDECTGLFDFQHLLGRLNGKSEDVLEAEKQKRENHIRNHYLEQKIGTIRFVRGGWLVGDVVKEKVTEEDGVPQSDTVDQQVETVPSQDTKDAEPTKRKSKKRKADSDEEDEKEEKKDKKVKKRKTDTEAETDSESSRSKKKEKKDKKEKKDQKEKKDKKDKRKLKDAKQSEESSSDDLESSATETKKSKKDKKKEKKEKKDKKKDKKEKKRKEKELSDSATESEDSKSKAQKRTKDGAEIETSTPGGSGTSTPTVTSSTRFLARQRFIAQKKMAFTDSAALNQIFMIKS

SEQ ID NO: 20716 - protein, 501 aa, Neurospora crassa
MKTSAVFSAVLSLLSLASRGSAHGHHHHHKHSDSGTSSASAPATFTPPQVFKNVNLVHIVSLEKNYVKESINVVIENIDKEAQSDYILPFANEQLSRLGGLEVRDRKNAESGPFVVEPVEFESFGPNQYVRIGLPTPLAPGAQQTLGITYYLLDAYKPLPASIKQEEQQFLSYSFSAYCPSVYTTSKQKTEVKFASTNIPDYTKLPGSGDVKEFPQKQGSKLVYGPFDEKPAGALEPVQVRFEFNKPVIHISRLERDIEVSHWGGNVAFEERYDLEHRGANLSSLFNRVKWQQSQYYNPATHALKEMKFPLRVGSADPYYTDVIGNVSTSRFRSNKREALLEIKPRYPLFGGWKYPFTIGWNSDAKNFLRNTATGGFVLNVPFLEGPKQPEGVEYEQVVVRLILPEGAENVKWTTAIPKSSISEAGVQIHKTYLDTIGRTALVIKGRNLVDDFRDRDLTVTYDYPMSAVLRKPLVVFSSSMAVFVSLWLLSLINLKFTTRK

SEQ ID NO: 20717 - protein, 1078 aa, Neurospora crassa
MAFGIPRALALAALSLSCVASAYQNYTSIDMLRAQMELMADRPKDCPPCFNCNLPMYSCGQFASCSEYSGKCICPDGFGGDNCLEPLCGSLARGPDRLARKGKSCECDDGWTGINCNVCTNDNVCNAFTETGDGGVCYTGGEVVKQNYQICDVTNKAIRNLLGTKVPQVTFTCKKETGECDFQFWVEERESFMCHLRECDSTANFDFDNGKNTTSYKCEKIQCECIPDRMLCGEHGSVDIGDFLSEQIKGPASFECTQTTGEEKKCAFKEPEMNNLINDVFGDQSILLTCSAGECLYHTEVPGYTPTVPKINTPLIAGVIAACGLFLVAVILGTWYLSRRKFNYGPIHLDDSDDEAIKLMTDHKPASLYFENVVYNLNGKEILSGIQGMAHPGEVTAIMGASGAGKTTFLDILARKNKRGQVSGDFYINGEKVSDPEYKNAVGFVDQEDTMLPTLTVHETILNSALLRLPKDMTRAAKEQRVIEVEKQLGIYHIRDSLIGSEEGKGRGISGGEKRRVGIACELVTSPSILFLDEPTSGLDAYNAYNVVECLVTLAKTYKRTVIFTIHQPRSNIVALFDRLILLAQGKTVYSGPLHQCQEYFDQIGYTCPPGFNIADYLVDLTMHAGSTSSYDDGTLSVDGVSVGPSSTRAVKSIASVSGVSIGDDSLVESSSSRPRNKRRDSVRRRQERELYTRRKQAVDTAASSDAGDEIGGYKLQKQPPVTPLRSTNDDLHDLPPLAATGTDLDVLIESYIHSDIAASTHEEIHQAIAAAVNSNGQNSNGYVADGNIYTGTMGKGYARVGLFRQFVILSQRTWKNLYRNPMLMLTHYAIAILLAVFAGYLFYGLTLDIAGFQNRLGLFFFVLALFGFSTLTSLGVFSQERLLFVRERANGYYSPITYFAAKVLFDIVPLRIIPPILLGAIIYPMTGLVADYQRFFVFILVLVLFNLAAAAICLFIGILCKDGGVANLIGSLVMLFSLLFAGLLLNHNAIPAAALWLQWLSIFHYGFEALIVNEVTQLTLVDHKYGLDITVPGATILTTFGFDNSAMWRDIMNLGLFGMTFIILAYGAMHILLVEKR

SEQ ID NO: 20718 - protein, 1448 aa, Neurospora crassa
MYWPIGTPRIYATSASCPPSYPHLYSHDGLPAPDQRPTRASLLSPGPTADGHDASSVPPTPITPVAPFTPAIKSVEHDYYDDGQSEPPSPPPPEPSRSNAPPREPILALRVARAGHLFAVITSTSMTIWQTKPTVVLAVVVRSEASLKSYGTNTSLMLRPDAAIFVVRTSLGYLITYSLATDADSRVYKPHFSSHTNVQKRRQTHAGGPGAIAPDQILWGPGEGSGVRDVSVRFRMVIKVDAGIESALALDDELVVATRKPAAVQCIRWTPDSSGSQTSTELLSRMGWVDKKVMVREMTHDRRMNLSTWVTSDGKAYAVQRISGSQLEPDTNQPPDPKKLFKGYCFYTPQTPGEQAIRCIVNAVFSLIAVGCADGNIRVFSAKDYSGNIPASHVHNLPASNNTCGRLTTLSYSPDGYCLFAGYEKGWATWSVYGKPLSNSFGADQTIASTTGEEWISGVLDAAWIGGGCELLLVGRAHESIWLLEMARSAVTGCYNSANLFRTVLQSTSSVMVYRGYDLPDLTSISAEPGLWHTARIPASYLMNHWPIRCTAISSDGRYVAVAGRRGLAHYSVNSSRWKTFADGDAENQFMVKGGMCWYQNILVAAVEANRSFELRLYSREASLDSSNVLHTQEMSAPVVLVTPSGEDSLLVYTYDNLLYHFIFAPFGGTVRLVEVGHIAFHGIIRSPARVRGLSWILPESQLLDGDPSQDVAHASVLFLVDGKLVLLRPSYNEGGLKYDMRVIANNLEFYVSMRDQPFVGGVLTPSEKQVFTAAADDSLRNSLWIFDGSEIKTWTDVEPVLRATSGEATRELPPMTSIPIDFYPLSALLSKAIVLGVESDLIQRRDVSFSFFRFSIRCTRKTEVRSWRTLFAYLPPPQELFEESLQRGSLKTAGGYLLILHTFDELATASEQSVRLLSRAMREGDWELCKELARFLAALDETGDTLREAMELAKMRVKQESELEDGHGSVGSGLGTMLGVPQGGGANGASSTTSSLISNTKGIIGSDWDADRRTISDAGSVVSANRYLGSQMVDFADLITYLCVVPWFGPTKGSNAVLDPGTRDFGLVDAKRQPTVVRAHFPPTTTFLPSFYAPSIDVVSPAMDDFVSESESDYASYWRDWFISSRGNEYFCEIDEDYITDRFNLTGLNTEVQYYQYALDLITDVFDLDCDDDMRETIEKSARHLYGLVHARYIVTTRGLQKMFEKYKKADFGKCPRVMCSSHPLLPMGLSDVPNSKPVKLYCARCEDIYNPKSSRHAAIDGAYFGTSFHNIFFQVYPTLVPAKSVERYIPRCYGFKVHAAAALVRWQNSQRDEMRRRLRKLEVESGFKDAEDEAELDDDDEEEEEEEEEEEELAAMDEAEGAQQQHAAAAAADEEYWNSEATIGAADEADDEAELPNEPNEPNHWLTPLMSAAARLRRSLRLGEDYEEQAEVEFDEWMEQARYGIF

SEQ ID NO: 20719 - protein, 314 aa, Neurospora crassa
MTTLTGKTILITGGTRGLGAVTALALARLGPHKIYITGRPSSSATADTLISKIRSEAESNPNANNVCTNITFLPTDNASLASVSATAQKLLETEEKIDILICNAGIAAIPLGKSEDGYEIQFATNVLGHALLIRKLLPLLRKSTSSGARIISLGSYGYRMAKTVDLERVSGDGLAKDKDDFLGYQRWRRYTESKLANTLYTSQLAKQYPEITSVTVTPGFVESDMVKNFGFVDHWMTKLGAKLARGQKGMVTVEEGAENTVWAATVEAKELVNGGLYDPVGKRVPEGELTAAARDEALAKKLWDWTEAELKRWL

SEQ ID NO: 20720 - protein, 452 aa, Neurospora crassa
MSCNSDCHTCPKSSHQEAAEALAAAQSRYVANNPLSKKQHELAVESLPGGNTRTLLHTSPFPLCMKHGKGTFVWDEDGHKYTDFVGELSAGLYGHSHPVIRAAILSTFDEIGLSLGSTTTYEARYASLLCQRFKLERVRMTNTGTEANLHALAAARHYTRKKKVVVFNGGYHGACFSFGGGKAAPNTADKGDFVVVQNYGDDEAAAEARRVIEETAREGDLAAVLVEGMQGAGGCLPGSKEFLLAAQEAAKNTGAIFILDEVMTSRLAPNGLGQELGLSPDLVTLGKYLGGGFSFGAFGGKKEIMDSVYDPRVKGSLAHSGTFNNNTMTMCAGFAGLNQVFTEEVCVELNRVGDVLRGRLNGVAKRTRLRFTGRGSLIGLHFRENGTFESQERADLRDLFWFEMLEEGFWTTRRGFIAMMLDTPKDELDRNMVDVDRDSNADLADLPMEVWN

SEQ ID NO: 20721 - protein, 371 aa, Zea mays
MTVVDAVVSSTDAGAPAAAAAPVPAGNGQTVCVTGAAGYIASWLVKLLLEKGYTVKGTVRNPDDPKNAHLRALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEQAAWEAARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPAAEMQQGGIAIRA

SEQ ID NO: 20722 - protein, 271 aa, Neurospora crassa
MSVVSLLGVNVMNNPAKFTDKYLFEITFECLEHLEKDLEWKLTYVGSATSDNYDQELDSLLVGPIPVGVNKFIFEAEPPDTKRIPIDELLGVTVILLTCAYDGREFVRVGYYVNNEYESEELINDPPPKPVIEKIRRNVLAEKPRVTRFAIKWDSEASAPPEFPPEQPEADEVADEEEYGADELAEQSSIADPAVNGGMEVEGQPNGAIVIEEDEMSEDGSVDLENESEDELDGEGDAEGELEQGQDEDIEMGDEMEIDDHPKQQGMAMAQ

SEQ ID NO: 20723 - protein, 501 aa, Neurospora crassa
MSRTTQQQQQTKRPIKRVAVIGAGPAGAITIDALAQERTFDLIRVFERREGPGGCWIGDNNNNNNNRPQPLTDFTSLSNRTADPPLPIPQGALPAFTPKLDQQRFTESSVYPYLETNVDALPMEFSQEPFPSQKSELSIALHGPDTPFRHWKSVRGYIAGLVNRNGYQDLVSYSTTVEKVEKVGDEWKVTLRKEGEQQEDYWWAEWFDAVVVASGHYWVPWIPAVEGLEAFERQRPGSVLHSKQFRGRDLYLDKKVVIVGASVSAADIAYDLAHSRTAQVPVHAITVGHTFNGYFGDEAFKHPRIENHPSISRVCPKTRTVYLVDGTCIPNVDHIIFGTGYTWTLPFLSQVLPVRNNRVPDLYQHVVWQKDPSLLFVGAVGAGLTFKVFEWQAVYAARILAGRAQMVPTLKEMQEWEEERIKEKGDGPKFSLIYPEFEEYFETLRRLAGEGETARGLGRKLPRFRPEWFRAFMEGHDLRKRMWKRVSKQAREEDKFSRAKL

SEQ ID NO: 20724 - protein, 268 aa, Candidatus Portiera aleyrodidarum
MKLNKRIINCFEQKKRAAFVTFITAGDQDYEKSLTLINSLPKAGADIIELGMPFTDPIADGEIIQKSTQRSLKTGQNQKKTLELVKAFRLFNKKTPIILMGYYNPIYRYGIKKFIKDAKNAQIDGLIIVDLPPEHAQEVSVPANKQGIDFINIITPNTNIKRIPFIVKNSSGYIYYISINGVTGGSVPIFYEVEKAVKLIRKYTNLPIAVGFGVKNRNSVKKLANISDAVVVGSALLKQIEIHCYDQKTAISNVLNLTSRLSRGLVKI

SEQ ID NO: 20725 - protein, 409 aa, Sphingomonas sp. CB3
MIGSVAIVGASAAGVAAATTLRDEGYEGEITLIGGETDLPYERPAVSKDILLTGAAPPIIPEQRYAELNIKLLLGTRAERIDARYGQIELSDGRTMVSDRLLLATGGWPRRLPVPGAELGGLHYVRDARDGQAIRSGLRPGARIAVVGGGLIGAEVAASAVQAGCEVDWIEAEGLCLARALSRPLAEAMMDVHRQRGVRVHANALVVRLIGERSVQAVELADGRRIDADMVVVGIGITPAAELAEEADLTVSDGIVIDPFCRTSAENVYAAGDVARHQTRYMATPSRLEHWRNAQEQGVTAARAMLGHRQPYDELPWFWTDQYDLHIEGCGVMRADDETILRGNLADGNATVFHLRAGSLVGACALNRQGDVRGAMRLITRGLTPSADILSDPTKDLRKIEKELSRASA

SEQ ID NO: 20726 - protein, 507 aa, Solanum tuberosum
MTIHLLYFHANRGQENSMERWWFNSMLFKKEFERRCGLNKSMGSLGPIENTSEDPNLKMKNIHSCSNVDYLFGVKDIWNFISDDTFLVSDRNGDSYSIYFDIENQIFEVDNDHSFLSELESSFSSYRNSSYLNNGFRGEDPYYNSYMSYMYDTQYSWNNHINSCIDNYLQSQICIDTSIISGSESYGDSYIYRAICSGESLNSSENEGSSRRTRTKGSDLTIRESSNDLEVTQKYKHLWVQCENCYGLNYKKFLKSKMNICEQCGYHLKMSSSDRIELLIDPGTWDPMDEDMVSLDPIEFHSEEEPYKDRIDSYQRKTGLTEAVQTGIGQLNGIPVAIGVMDFQFMGGSMGSVVGEKITRLIEHAANQNLPLIIVCASGGARMQEGSLSLMQMAKISSALYDYQLNKKLFYVSILTSPTTGGVTASFGMLGDIIIAEPNAYIAFAGKRVIEQTLNKTVPEGSQAAEYLFQKGLFDLIVPRNLLKSVLSELFKLHAFFPLNQKSSKIK

SEQ ID NO: 20727 - protein, 112 aa, Beta vulgaris subsp. vulgaris
HVIKIKDIILPPEREKFNDVYIVYELMDTDLHQIIRSNQELTEDHCQYFLYQLLRGLKYIHSANVLHRDLKPSNLLLNANCDLKICDFGLARTTAETDFMTEYVVTSWYAPG

SEQ ID NO: 20728 - protein, 457 aa, Iris hollandica
MVGILVYVALFILSLLLFLTAAAKLHNSKSKIKNQAPSPPSLPVVGHLHLLKKPLHRSISLLSARHGPILLLRFGSRPALAVSSLPLAEECLSGKNDLAFANRAHFPHEAAPLQLLTLGSANYGPHWRMLRRISAVELLSSHRINSFSQLRSEEVHSMISTLFRESSDKELNRVELKSKLFELAMNNMMRMIFGKDLASSEGAGRFREMVKESHSLLGASTRLGDFFPFLGWMDWRARRMVLRLVRRRDEFLQSLIDAHARKMEEVEEKTMIRVLVELQKSNRESNNDEGFMLKPLIIGLLQAGTDTSSDTIEWAMSLLLNNRDKLKKARDEIDARVGKERLLRESDLPNLPYLQCVITETLRLYPAAPLLVPHESAEECTVGGYAVPQGTMLLVNAYAIRVVGIVLGTLIQCFEWERVGEEEVDMTEGSGLTLPRANPLEAICRPRQSMISVLAGL

SEQ ID NO: 20729 - protein, 226 aa, Brassica oleracea var. capitata
LDACGSDIIELGVPYSDPLADGPVIQAAATRSLEKGTNLDSILDMLDKVLPELSCPVSLFTYYNPILKRGLGKFMSSIRDVGVQGLVVPDVPLEETEFLRKEALNNSIELVLLTTPTTPTERMKRIVDASEGFIYLVSSIGVTGARASVSGKVQSLLKDIKEATDKPVAVGFGISKPEHVKQIAGWGADGVIVGSAMVRLLGDAKSPTEGLKELESLTKSLKSALL

SEQ ID NO: 20730 - protein, 348 aa, Ipomoea alba
ETLAGSGIERIPKEYIRPEEERRSIGDIFEEEKMGGGPQVPTVDLKGINSDDLEVREKCREELRKAAVDWGVMHLVNHGIPEELTGRVKAAGEGFFAQPIEEKEKYANDQAAGNVQGYGSKLANNASGQLEWEDYFFHCIFPQDKTDLSIWPKTPSDYIAATREYAKQLRALATKVLAVLSLGLGLDEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNKEKVRVSWAVFCEPPKDKILLQPLPETVSEAEPPRFPPRTFAQHIKHKLFRQSDQGADTPKT

SEQ ID NO: 20731 - protein, 351 aa, Ipomoea hederacea
ERLASSGIERIPKEYIRPEEERRSIGDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDN

SEQ ID NO: 20732 - protein, 351 aa, Ipomoea purpurea
ERLAGSGIERIPKEYIRPEEERRSIGDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKTPSDYIDATKEYAKQLRALATKVYAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNKEKVRVSWAVFCEPPKDKILLQPLPETVSWTEPPRFPPRTFAQHIKHKLFRQSDQEAADTPKPDN

SEQ ID NO: 20733 - protein, 350 aa, Ipomoea trifida
ERLAGSGIERIPKRYIRPEKERPSIGDIFAEEKMAGGPQVPTVDLKGINSEDLEVREKCREELRKAAVDWGVMHLVNHGIPEELTARVKAAGEGFFGQPIEEKEKYANDQAAGNVQGYGSKLANNASGQLEWEDYFFHCVFPEDKADLSIWPKTPSDYIAATREYAKQLRALTTTVYAVLSQGLGLEEERLEKKWRDGRASSTNEDNYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVCRADPPRFPPRTFAQHIKHKLFRLTDQEGADTPKPDE

SEQ ID NO: 20734 - protein, 449 aa, Oryza sativa (japonica cultivar-group)
MYRAKRAALSPKVKRRVGKYELGRTIGEGTFAKVRFAKNTENDEPVAIKILDKEKVQKHRLVEQIRREICTMKLVKHPNVVRLFEVMGSKARIFIVLEYVTGGELFEIIATNGRLKEEEARKYFQQLINAVDYCHSRGVYHRDLKLENLLLDASGNLKVSDFGLSALTEQVKADGLLHTTCGTPNYVAPEVIEDRGYDGAAADIWSCGVILYVLLAGFLPFEDDNIIALYKKISEAQFTCPSWFSTGAKKLITRILDPNPTTRITISQILEDPWFKKGYKPPVFDEKYETSFDDVDAAFGDSEDRHVKEETEDQPTSMNAFELISLNQALNLDNLFEAKKEYKRETRFTSQCPPKEIITKIEEAAKPLGFDIQKKNYKMRMENLKAGRKGNLNVATEVFQVAPSLHVVELKKAKGDTLEFQKFYRTLSTQLKDVVWKCDGEVEGNGAAA

SEQ ID NO: 20735 - protein, 231 aa, Streptococcus agalactiae
NSLFWNNHDLPRVLSIWGNDSDNRKQSAKALAILLHLMRGTPYIYQGEEIGMTNYPFECLADVDDIESLNYAKEAMDNGVSEATILDSIRKVGRDNARTPMQWSQEHQAGFTKGTPWLAVNPNYQEINVEAALNDTESIFYTYQKLVALRKEHDWLVDADFKLLETADKVFAYVRQTDKERYLIVANLSDQNQSFEFPEAVKETIISNTEVQEVLSSNTLKPWDAFCIELF

SEQ ID NO: 20736 - protein, 465 aa, Alphonsea kinabaluensis
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVAVEACVQARNEGRDLARQGNEIIREASKWSPELAAACEVWKEIKFEFEAMDTLD

SEQ ID NO: 20737 - protein, 465 aa, Alphonsea sp. Kessler 3112
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFCFCAEALYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLARHGNEIIREASKWSPELAAACEVWKEIKFEFEAVDTLD

SEQ ID NO: 20738 - protein, 465 aa, Polyalthia sp. Ridsdale DV-M1-12314
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGAPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20739 - protein, 464 aa, Meiogyne virgata
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALSKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTL

SEQ ID NO: 20740 - protein, 465 aa, Craibella phuyensis
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20741 - protein, 465 aa, Orophea brandisii
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRVPTSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGAPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20742 - protein, 465 aa, Orophea enneandra
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRVPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGAPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20743 - protein, 465 aa, Polyalthia cauliflora
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPKSYIKTFHGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGAPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20744 - protein, 465 aa, Polyalthia debilis
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGAPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVAVEACVQARNEGRDLARQGNEIIREASKWSPELAAACEVWKEIKFEFEAMDTLD

SEQ ID NO: 20745 - protein, 465 aa, Polyalthia littoralis
GFKAGVKEYKLTYYTPEYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGAPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20746 - protein, 465 aa, Polyalthia longipes
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRSVYECLRGGLDFTKDDENVNSQPFMRWRDRFLFCAEALYKAQAETGEIKGHYLNATAGTCEEMMKRAIFARELGAPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20747 - protein, 464 aa, Polyalthia sumatrana
FKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPKSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGTPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20748 - protein, 465 aa, Orophea cf. malayana Hoffmann 11
  misc_feature (251)..(251): Xaa can be any naturally occurring amino acid
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGXPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20749 - protein, 465 aa, Pseuduvaria coriacea
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYFNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20750 - protein, 465 aa, Pseuduvaria pamattonis
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20751 - protein, 465 aa, Sageraea lanceolata
GFKAGVKEYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIFFTQDWVSLPGVLPVASGGIHVWHMPALTEIFGDDAVLQFGGGTLGHPWGNAPGAVANRVALEACVQARNEGRDLARQGNEIIREASKWSPELAAACEVWKEIKFEFEAVDTLD

SEQ ID NO: 20752 - protein, 465 aa, Stelechocarpus burahol
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFLFCTEALFKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLARQGNEIIREASKWSPELAAACEIWKEIKFEFEAMDTLD

SEQ ID NO: 20753 - protein, 465 aa, Tridimeris hahniana
GFKAGVKEYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAIFARELGAPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLARQGNEIIREASKWSPELAAACEIWKEIKFEFEAMDTLD

SEQ ID NO: 20754 - protein, 465 aa, Cremastosperma microcarpum
FFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPKSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGTPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20755 - protein, 465 aa, Desmopsis microcarpa
GFKAGVKEYKLTYYTPEYETKDTDILAAFRVTPQPGVPPEEAGAAVAAESSTGTWTTVWTDGLTSLDRYKGRCYHIEPVVGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAIFARELGAPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLARQGNEIIREASKWSPELAAACEIWKEIKFEFEAMDTLD

SEQ ID NO: 20756 - protein, 465 aa, Desmopsis schippii
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAIFARELGTPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLARQGNEIIREASKWSPELAAACEIWKEIKFEFEAMDTLD

SEQ ID NO: 20757 - protein, 465 aa, Mosannona vasquezii
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAIFARELGAPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAVDTLD

SEQ ID NO: 20758 - protein, 465 aa, Oxandra espintana
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCTEALYKAQAETGEIKGHYLNATAGTCEEMMKRAACARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAMDTLD

SEQ ID NO: 20759 - protein, 465 aa, Stenanona panamensis
GFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPISYIKTFQGPPHGIQVERDKLNKYGRPLLGCTIKPKLGLSAKNYGRAVYECLRGGLDFTKDDENVNSQPFMRWRDRFCFCAEALFKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLARQGNEIIREASKWSPELAAACEIWKEIKFEFEAMDTLD

SEQ ID NO: 20760 - protein, 465 aa, Pseudoxandra lucida
GFKAGVKEYKLTYYTPEYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPISYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAIFARELGAPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAVDTLD

SEQ ID NO: 20761 - protein, 347 aa, Pirellula sp. 1
MRWHRRQREVTLAASCRPGIRHHHLTPRTAKMLPRRRLGQTDMELTTLSFGASSIGQEFRSVDLGESLQAVRVALDSGMNFIDTAAFYGRGMSEMMLGRVLPDIPRDQYYLGTKLGRYTGEHFDFSAKRVTESIDTSLERMKVDHLDIVLCHDLEFVEMSQIVEETIPAIRREIAKGKVRYVGVSGYPMKMFKYVMANTDIDCLLTYNHYTLQNDMALELVPLAKEKGVGLMNGAPFSARLLTNAELPPWHKATPQVREVAAAAAKHCADRGSDIAKIALQFSIANEDFATCIPGSANPNRVAQWVEWAQEPIDETLVAEVKEILKPIHNWFYIEGLPENNDEPVAS

SEQ ID NO: 20762 - protein, 190 aa, Pirellula sp. 1
MQDRSEKVEMKTWLPVCLIGMLLIVPACRSTAPSTPPIVSEPTLPDFPDAQPAKPNFVSFVDRPELQAGTGPMDSDASLEFIETSSGLKYRILRKSDGKKPTAFDTVSVHYRGWLNNGKVFDNSYDRGEATTFPLDGVIAGWTEGMQLIGEGGMIELWVPSYLGYGERGSPGSIPAHAILHFIVELESVK

SEQ ID NO: 20763 - protein, 475 aa, Pirellula sp. 1
MHAPVVVLGGGPGGYAAAFLAADEGMEVTIVEAEPRLGGTCLIRGCIPSKALLHVAKVISEVEELKSEWGIEYSGEPKIDVDVVRARKDKVIDNLTGGLGGLAKRRNVTVIQARGSFVSSNELKLEGDHESIPEGGKLTFDKCIVATGSIPAMPPAFDIGSDRVMDSTGALALKDIPETLLVVGGGYIGLEMGTVYAHLGSKVSVVELGEGLLPGADRDLVKPLAKKIDKMCDGRVFLNTKVGSLAEDGDKVVVSFEGPSKFGTESYDRVLISIGRRPVTRGLGLENTKVEVNERGFIVCDEQQRTADPNILAIGDVAGDPMLAHKATHEGRVAAEVLAGKNVAFDKAAIPAVVFTDPEIAWAGLTEGEAKAAGRKVDVEVYPWAASGRAQAIGVTNGLTKWLVDPETHRVLGCGIVGTGAGELIAEAVLAIEMGCEVTDITESVHPHPTLSETLMNAGEVHFGTATEIYKPKRK

SEQ ID NO: 20764 - protein, 471 aa, Pirellula sp. 1
MFTSPFSIRLLLIPALALLMSLPAAAQPPGRGGFGGGGFGGGEGGDRGGRGGDRGGGGGGDRGGRGGGERGGGDRGGGGGDRGGRGGPGGGFDPASMLQRLDRNGNGTLDPDEQEGPAGFLIRRLEATDSSIKAGTPIPLSKFSSAFEKMRQEREGGGDSRGDSDRRSSRDTDDMELEMLVPGFGLEAEPVLVPGFGPAAEMMSTPTTEEDRKSAREVLSRYDRDKDGQLGKDEISSRFWGNPMDFDRNGDGKLSEMELATRQAVRRGNEEERRDDRRDDRRRGDDDDREIVEVDFGGRKSYRVQGPSMAEGMPSFFAQRDLNRDGQVSMNEYTSDWTPARVEEYYRWDQNQDGVITQTEVRQGVNDGAVATDAPTGRAAPGSSATARSASSGSSSGRSSSSPAADGPPPTEKELKYAATIIGRYDGNKDGALTATEWKSMLLSPAGADFNGDGRVTIQEYAQHMANRSKR

SEQ ID NO: 20765 - protein, 235 aa, Pirellula sp. 1
MSRAKLDSIRAAGPAILPSLLQCDFGDLRTEIEKLTVAGTRVLHLDVMDGHFVPNLTYGMPIVEGLRRHTDMPLDVHLMISDPIAYAQPMVDAGADLLTFHVEAVDDCVEVAGKIRDMGVGVGVAINPDTDFAKLDCCLDSVDMVLVMSVNAGFGGQQFNPVALDRLRSLKERKPDLLLEIDGGIKAETIGDARAAGCDLFVVGSAIFGQHDYETAINELTQAMHGSPPATGDQS

SEQ ID NO: 20766 - protein, 199 aa, Pirellula sp. 1
MLLRNGPEKICQAAVARSAHLHGRHLTPISGSPLTVRSTFNPIDTMNPPSKFSKASLVLVLAFAILPMGCNPSARSSSPGPEDPDAPTEFTTTDSGLKYRILRKGSGDNPGPESFVTVDYVGWLDSGREFDSSYNRREATKFNLSSVIPAWTEGVQLVSEGGMIELEVPSELGYGVMGSPPEIPPNATLHFKVELHDVR

SEQ ID NO: 20767 - protein, 427 aa, Pirellula sp. 1
MMNSVWRPYCQMKTAPPPMKIVATEGCHLIGQNGECWIDGMASWWSACHGYNHPQVRDAVTEQLHRMPHVMFGGITHEPAERLANRLAELAPDDLNHVFFSDSGSVAVEVAMKMAIGHWRRHDRPGRTRFLAFDNAYHGDTTGAMSLCDPQRSMHARYSGAITQQYHVALPRDATTEAVLERTLAAHSDSIAGVFVEPLVQGAGGMRFHDVITLRRIRDACKRHDVLLIADEIATGFQRTGKMFAVDHTADLQSPVVPDILCLGKALTAGTMSMAVTIARSHVFDSFYSDDPGAALMHGPTFMANPLACSAANASLDLFEGNPYDVEKIETILRERLSVLRDIDNVADVRCFGAIGVVQFRDPPKMQMVQDELVRRGVWLRPFGDCLYTTPPLCINEDALHRICDAMIEATRATMPRSDSPMCNQLR

SEQ ID NO: 20768 - protein, 327 aa, Pirellula sp. 1
MKAIVLHSFGGLESFELCDVPKPVPRAGQVLVRVHATSINPLDYQVRRGDYHDLVQLPAITGHDVSGVVEEVGAGVTTFSPGDEVWYTPQIFDGPGSYAEYHVAAESIIGKKPASLSHLEAASLTLVGGTVWEALIVRAVLRVGESILVHGGAGGVGHVAIQLAKAIGAKVFTTVRDANARFARSMGADVIIDYQKEDYVDCIMRETDGRGVDVVFDTIGGDTLSRSPDALAQLGRVVTIVDTALPQNVIQAWGKNASYHFVFTRQNRGKLDELSALVERGQLKPHVGAVYSLADIPLAQARLESSNNGVQGKIAIAIDDRIRESME

SEQ ID NO: 20769 - protein, 157 aa, Pirellula sp. 1
MTQVSDNELLFQSLCIGAIELPHRIVMAPLTRARSTDRVPNELMEEYYYQRSSAALIISGATAISEQGYGWHGAPGIYTAEQVEGWKRISDAVHASGGRIFLQLWHMGRVSHPDYQSGQLTVGPSPIAATGEAHTPHWQEAACRSSGHEYIGNCKRH

SEQ ID NO: 20770 - protein, 303 aa, Pirellula sp. 1
MADDKSLPKIGWVGTGVMGASMCGHLLDAGYEVTLTTRTLAKAESLLTRGATWVKTPRAVAESSDLIFTIVGYPHDVREVILDPGTGVLAGCKPGDVIVDMTTSQPSLAVEIAEAAARREVDSLDAPVSGGDTGAKGGTLSIMVGGSGRALTKVQPCLESMGKTIVHQGGPGAGQHTKMVNQILIATNMIGVCEALVYGHKAGLDLPTVLQSVGSGAAGSWSLNNLGPRIIDNQFDPGFYVEHFIKDMGIALAECRAMSLSMPGLALAEQLYQAVAAQGHGRDGTHALALAIANLSGIDWLKR

SEQ ID NO: 20771 - protein, 455 aa, Pirellula sp. 1
MTRPFLNVIAIVGILFIAADASAQKPLAFPTAEGYGKYTTGGRGGQVFEVTNLNDSGKGSLRAAVEAKGPRTVVFRVSGTIKLNSDLRIKNPNITIAGQTAPGDGICLRGYPLMISADEVIIRYIRVRFGDESGKDADAISARYVKNLILDHVSASWSVDETMSIYHCENVTVQWCMITESLFDSNHSKSNHGFGGIWGSNHSTYHHNLIAHHSSRNPRFASGCGNTDYRNNVVYNWGYRSCYGGEKRQNDKFNFTNINMVANYYKPGPATDPARAAELAEPSSRGADDKGHWYVAENVIEGSPTVSADNWSGVRGANYIQLDQPWEAMPINQQTAEEAFEDVLQHAGASWPKRDPIDTRIIQEVRDGTATYEGVYKTKKRVSSDTQITGIIDSQQDVGGWPELKNAAAAPDTDHDGIPDAWEAEHGMDPNDASDGNRTGNDGYTMLEQYINSIP

SEQ ID NO: 20772 - protein, 353 aa, Pirellula sp. 1
MATARLKLPSASNSYHSMANLSMNDQPSNPLFAGLLSIFFVAFVWTPLASAEESDAPIGWASVSGRGVETTTGGRNGDVVTARTAEELAEYASSPEPLTILIEGTITGDGQIKISSNKTLLGLGASTSLKNIELNMSGVSNIIIRNLHISDARDAIALRRTHHVWVDHCDLSECGDGLLDITHQSDFVTVSWTRFSKHHKTMLINSGTSQPEDSGYLNTTIHHCRFDGSDTRNPRVGYGKVHVFNCLYTKSDYGIGLHSQCLVLAERNHFDQVKHPIKQMYRPDPTDIHHGFCESVENVFQDCRGAQDDEGKSFPAKEFYEYESKMDDVARVPEIVQSNAGPQEHIGRTASRQ

SEQ ID NO: 20773 - protein, 1038 aa, Pirellula sp. 1
MPVRIYALAKELNLDSKELVDVVKKAGITGKGSALASLSDEEAQQVRGHLAGSAAKSEPKPKAAPPTKDTPTAPVAPVRDLSGATGRKPSAINVGRPSKPAEAADNPNAPAQPIRDGGRPVGKPAPIVRTPKLAPAPEAKAPEAPAADGSPKPEIRLPKTGGVGTGMASPSGRGIGMGAKTDGQSTKPESAASAPSVPGPKSDSGGRKAPESPKRESAPVASSDDDGSSNKGGGLASRIAGRMGNNSSGRVVPNTPGTPLSAVRRDSASAGGKMRSLDRSRNRPEEAAKAGDAGKSKKREPRIKVNLAQLPSAPAKPAAPTGSSGPAAQKPDIKLTRDVIEGHKQGMKAPLARLEQDEADKKQRSKKTAEGTVGLAGRGKRVIDEDEKPKKKGLAGMASARAERQRGGGGRRIVGSDGGDRHHYRRSRPRIRRKGVNTAAPRKEKVQIELPCTVRNFCEGSGLSVADVMRTLMGMGMMVNINADIDFETAELLATEHDLDIELKAAESLEQELITEIEETADDPDTLVARPPVVTFLGHVDHGKTSLLDHLVGINVVKGEAGGITQHIRAYKIDKDGRAVTFVDTPGHEAFTEMRARGANVTDIAVLVVAADDGIMPQTEEAISHAKAAEVPIVVALNKIDLEGVDANRVMTQLTEHQLTPSEWGGDVEIVRTSATQGTGMDELLDTLLTIAELNEYSANPNRSALGVCLESEQQGDRGVVAKLIVQNGTLRVGDILVCGPAHGRVRAMQDTLTGKPITEAGPSTPVSLMGLDTPPGAGDRFHVLKDISQAREIASAREGESSRQSLSGITTKVSFDSFQEMLEDGKLGESADTVKLNLIIRADARGSLEAIDKELSKFDHPEVEIRVLQRSVGGISLADATLASASDAVILGFNVIPDDKARSLAEERGVEIRRYDVIYKLTDDIRALIEGRLKPEERVVELGRALVKQVFSISRVGTIAGCYVAQGSIQRNCRIRVNRDGRTIGDYQLDTLRRIKEDVKEVPRGMECGIRLQGFNDIKQDDVLEAYKIEEVARKLD

SEQ ID NO: 20774 - protein, 293 aa, Pirellula sp. 1
MRPVPSAHPDADPPSMTPLQSLFESLRGQNRKALMPFLTTGDPNIDTTEAVIAAARQAGADLCEVGVPYSDPIADGPVIQASYQRALDAGFKLQHVWDLGQRLTENPKVKAMPRVTMVSYSIIYRIGMAKYVDQAMQAGYCGAIVPDLLVEEAEDLSKICREKGFDLIQLVTPTTTRDRQCRIAELSSGFLYYVSVTGITGERTALPTNLVDNVGWLREQTELPICIGFGISGPETAAQLAPVSDGLIVGSAIVRRVADAVEKAKSSGADPVKTAAEEAGDFCHSLRQAIDAA

SEQ ID NO: 20775 - protein, 500 aa, Pirellula sp. 1
MGKPTGFKEFDREKVAWRLPVIRINDYDEIYTEPKTEHLQRQGARCMDCGVPFCQSATGCPIDNLIPEWNDLVYNNRWKEAIERLHKTNNFPEFTGRVCPAPCEGSCVLGITNPPVTIKNIENAIVDRAWEEGWIVAEPPEQRTGKKVAVIGSGPAGLTAADQLNKAGHLVTVYERADRIGGLLQYGIPNMKLSKKAVQRRVDKMTEEGVTFKTGVNVGVDVSPKELQSEFDAVLLACGATKPRDLPIPGREAKGVHFAMDFLTSNTKQRVHSDNLGAEFISAEGKDVIVIGGGDTGTDCIGTSLRHGCRSMVNFELLPQPPAERADDNPWPEWPRIFRVDYGHEEAEAKFGKDPREYQILSKEYLVDDEGKLKGIKTVNVEWTKNDEGGWQMAEVEGSEKEWPAQLILLAMGFLGPEQTVAESLGLETDARSNFQAEHGKYATNIDGVFAAGDCRRGQSLVVWAINEGRGAARAIDIFLEGSSNLPAPGQTMGTSMAAV

SEQ ID NO: 20776 - protein, 497 aa, Pirellula sp. 1
MSSATESSSSNGAASPDETPDINLPAPEAKPAAKPAPDKFDFDLFVIGTGPGGEGAAMQAAKGGLRVGVAERYRQIGGGCTHWGTIPSKALRYAVTSTMKSLKNPVMREMGFAASPSMEQLNRGTQAIIGRQVTMRQSFYDRNSVPISRGQARFVDEHTITIDNGELITAAAFVISTGSRPYRPKGVDFSHPRIFDSDTILEMKDKPTSITVYGAGVIGTEYASMFRNLGIKVNLINTRDKLLEFLDDEIIDALSYHLRDQGVIIRHNETMESIEGLDDGVILRLKSGKVLKTDVFLWANGRQGNTDDLGLKNLPIEANSRGQIVVDEHFQTCLPHIYAVGDVIGIPSLASAAYTQGRAAGMHLLGRVDGNLRLNDIPTGIYTSPEISSVGSTERELTERCVPYEVGQAQFRSLARAQITGETTGMLKLLFHRETKEILGVHCFGANASEIIHIGQAIMNQPGRQNTIDYFIETTFNYPTMAEAYRVAALNGLNRLF

SEQ ID NO: 20777 - protein, 356 aa, Pirellula sp. 1
MLHAIIMAGGSGTRFWPASRKAKPKQLLSLAGDRTMIQATRDRLSSVIPAERTHVLTSVALVEPIAEQLPELRRETIVGEPCRRDTAPCVGLAAALVAHEDPDAVMLVCPSDHVILQHDKFAEGVRRGEAILAEHPDAIVTFGIKPSYPAESFGYIQRGDVIEGHEAYKVKTFREKPDSATAKKYLDEGTFSWNSGIFLWKAQTILDALEQHEPEMYSHIQAISDAIGTDDYDEVLQKEFAAIEGKSIDYAVMERHSPVVVIEAPFDWDDVGSWQAVSRLHPADEFGNAVVGSHVSVDSTGCIIHGTPGHTIATIDVHDLIVVQTADATLVAPKTSEERVREVVAALQASGSEDRI

SEQ ID NO: 20778 - protein, 406 aa, Pirellula sp. 1
MEGVGIRFPESVSAQSVRSTWHTSSGKGAVSVRRSGTLCFADELHRIIFRKREALVAGQRSIMSVSEKAAKGNRVDETSRLGMETMKHSVLVTRQIPGESLKRLREVCEVEVWPEAIPPSREELCRLVKGRHGLLTMLSDRIDGELMDVAGEQLCVVSNYAVGFNNIDVDAAKTRGVVVGNTPDVLTDATADLAVSLLFAASRHVLPAGNQVREGEWKTWEPTGWLGVEPSDKTLGIVGMGRIGKATAKRLVGGWGMNLLYTSRSDQGDVEKELGGRRVELDTLLAESDFVSVHVALTDETRNLIDADAIGKMKSTSVLVNTARGEIVDQDALVDALNRRAIFAAGLDVTTPEPLPADHALVKSPHCVILPHIGSATHTSRNAMSEIAVDNLIAGLAGKPLRCSVT

SEQ ID NO: 20779 - protein, 434 aa, Pirellula sp. 1
MFRDLRPLAASLLKSQHMKPIAIDPVEMTDHASRAAGPSSTGLSTQCVHGNIDPDSPSRQHAEGAITAPIYSASTFTFESTDKLLDFVEGREQREEYGRYGNPNERLVEQKLAALDNAEDAVVYSSGMAAIVGLLMSRLSSGDEIIFFDQCYHRSREFCGKHLAKFGVVTRQVPTGDFAAMEAAITPRTKMLVSESPTNPHLTCVDLEQFVALGKAHEIETLIDATLATPMNVRPLDHGVDYVWHSATKYLGGHNDLLAGVISGRKELLDPIRALRGCLGSVTSPHSMYLLERGLKTFSLRMQRHNENGQAVAEFLHQHPKIDRVYYPGLPSHPTHAIAKEQMLGYGGLITFTVKDADWKTTSRVVDAAKIARIAPSLGGTESLIEQPLVMSYFHYSPEERACFGIADNMIRFSCGIEDSADLIADLDQALAAI

SEQ ID NO: 20780 - protein, 177 aa, Pirellula sp. 1
MRTLIDESQLDDGVSKLAKEIDATYGDRPITVVAVMTGSLVLFADLIRRLSMPQRVGVIHASSYRGGTQAGKLEIDSKMLIDVQNRDVLLVDDIYDTGATLTKLSGAIADMGASSVSTAVLLRKLRPEQIGPKPDFVAFEIPDEFVVGYGLDYLDMYRNLPFIGVLEPDEIEATARQ

SEQ ID NO: 20781 - protein, 323 aa, Pirellula sp. 1
MTLHPQAQTFVALLRELQPPRWEDLGVAKARRGFSALVDNFGAGPAMASVEDQVVEEQNCDGQVSRIPVRIYRPDDVSELAPVVMFFHGGGWVLGDVESHDTTCRRLAAASRAAVVSVEYRRSPESPFPGPVHDCFVATKAVAKNGISWGLDASRLAVMGDSAGGNLAAAVALLAKDDPDVAVKYAVLVYPVVSPAFDSESYREFESGFGLTKRTMQWFWGNYFGRAGEDFFGVDRVSDADPLADLMKADFSDFPPAHVLVAGYDVLRDEGLALADKIEASGGDVTRENASDMLHGFIHFAGQFETGVTAMQSLGNRIANQLS

SEQ ID NO: 20782 - protein, 424 aa, Pirellula sp. 1
MSSAAAASETTQNSDPYIQSLFAERIGGANYGKSTEIYKFEKIKRAKRKALADHPERQLLDFGIGENDSMADASIREVMGREINQVENRGYADNGVAEYKEAAARFMQRQFGVKLDPETQINHCIGSKPAYAMLPACFINPGDITMMTVPGYPVAGTHTRYYGGDVYRLPLLAENKFLPDLDAIPDDVFRRTKLMILNYPNSPTGGTAPKSFFEDVITLAKEKEFVVVNDAAHIMLTFDGKPTSFLEVPGALDVGVEVHSMSKGYDMIGWRMGFVAGHPLVVKAFSDVKDNSDSGQFIATQKAAAAALDDDSIPERIRTKYRRRMEKLVKVLRDCGFEAEMPGGTYFLYTKSPTGTASGETFAAAEDATRFLIEENGIVTVPWDDAGSFLRFSVTYIAEDEAAEDALMAETAARLSGAGFQWKS

SEQ ID NO: 20783 - protein, 439 aa, Pirellula sp. 1
MNSPANSSAARPAAGPKSVAAFQRASALMPGGVNSPARAFGAVGGTPLFIERAEGPYLYDIDGNRYIDYIGSWGPMILGHAHPEVINAITQAAAKGTSYGAPTEAESRLAEQIIEAVPSIEKVRLVNSGTEATMSALRVARGATGRKKVIKFAGNYHGHVDSLLVAAGSAAATLGAPDSPGVTPGAAEDTLVLSYNDVSGLQNAFAQHGDDIAALILEPVVGNMGCVLPTMEFLNAARDLTTKHGSILIFDEVMTGFRVAYGGAQERFGVTPDMTTLGKIVGGGMPLGAYGGRADIMNQVLPAGKVFQAGTLSGNPVAVAAGSATLRLLKENPPYEQLERLADRLADGLDRAATSAGMAHTVAKAGAMLTLFFNPEPVDCWAVADRCDREAFGRYFWGLIDEGIYMPCSQFEALFFSQQHTEAMIDETIAAAEKVLKSL

SEQ ID NO: 20784 - protein, 319 aa, Pirellula sp. 1
MGGYSLMSRGKTFDNIARAIGDTPMVQINRLVPSGDATVFAKCEFFQPLNSVKDRIGVAMIEAGERDGSINPDTHIIEPTSGNTGIALAFVCAAKGYKLTLTMPESMSVERRALLRAMGANLVLTPAGDGMKGAITTAQELVDQTDNSFMPQQFENPSNPAIHEATTGPEIWADTDGKIDAIVAGVGTGGTITGVARYLKKQNPDFKAFAVEPKHSPVISGGSPGKHRIQGIGAGFIPGNLDTSIIDDVVQVDDEDAFEWGRQLAKQEGIVAGISSGANMWAAAQIAARPEMKGKRIVTVMCSLGERYLSTPLFGDLGL

SEQ ID NO: 20785 - protein, 254 aa, Pirellula sp. 1
MSRRILIAGNWKMNMRAESGASLAKGIVDAVGKSPAVEVVLCPPSVYLSGVADAVVGTPVELGAQNLYAAEDGAFTGEVNASMLTDVGCRFVILGHSERRQLMGETDACVAKKLHAALAGNLVPIVCVGETLEQREADDTESVIETQIRGSLEGLDEARAANIVIAYEPVWAIGTGKTASKEQAEAVHAFIRELLGKMFSTEVAEQIRIQYGGSVKPGNAEELLSQPNIDGALVGGSSLKVDDFAGIIKAAPSA

SEQ ID NO: 20786 - protein, 294 aa, Pirellula sp. 1
MSDSNPPIDPFEQDSSEPRAEESAVAVAERPLVEVENLEVTFDGQTVLKDIDCQIERGQTVAVIGESGCGKTVFMKTIVALVQPTVGRVKFDGQDLSGLSPAELAVVRRRFGFVFQHAALFDSMNIFDNVAFPIRQNEEGVDEAEINDRVRQHIGEVGLPEEVIYKRPAELSGGMQKRVGLARALVLRPELVVYDEPTTGLDPIMSDVINELILNTRRMYPVTSIVVTHDMHTARKVADRVMMFYPRRRLEPDQSQVLFDAPPSQLEHAEDRRVRQFVRGEAGDRIREMSQGMG

SEQ ID NO: 20787 - protein, 454 aa, Pirellula sp. 1
MFRLSRSTSISDSATNTVERLESEVRGYCRLFPSVFQTAKGSTLMTAEGRQFIDFFCGAGSLNYGHNPPAVKQALLDYVSHDGIQHSLDMMTEAKAQFLDRFEQTILRPRSMDYKIQFTGPTGTNAVEAAIKLAKQHRKRSHVVAFTNAYHGHSLGSLSLTGNQSYHSEYYGSHNNVSFLPYDGYLGDFDTTILLEKMLTDRSSGMPLPAAVVLETIQGEGGIHVANDAWLQRVQTLCREHDVLLIVDDIQVGNGRTGEFFSFEKAGLSPDLICLSKSIGGGLPLSLVMIRPECDVWQPGQHTGTFRGNNLAFVAANAVLNHWNEGSFVDGIQVRSNTLQAFLSSIVSEHVSENWDLRGRGMIWGLDVRRGDLARKVIDTAFQNGLLLESCGSDDEVLKFIPALNIPEQQLQQGLQLFRQSLQTVFPNPSATTPTLIPSTGSPVTSFGSSMVVS

SEQ ID NO: 20788 - protein, 1047 aa, Pirellula sp. 1
MKKRTARLALFLAILGGPSAMAADFDVSNHNDSGAGSLRAAIEGLNGAGTGTHAINFASGLDPINLLSHLPTIVGTDQTITVNGAGNTVSGQDTARLFFVADGDVTFQNMTLKQGYAEGGDGGNSGGGGGGGAGAGGALFVNTGANVVISGVAFDSNKAEGGDGGDHDSSSDAGGGGGGFSGTGGSTSHDGGGGGGGFDGNGGIAHYYGGGGGGGVSGNGGDTSGDGGGGGGGIGNGASTSDDTGGDGDGGAAGGGDGDPGATGTPGGGGGGHQGAGGDGAVNGGGGGSGFAGSVAGNGGTFGGGGGGGGSTDGGDGGDFGGGGGGGFLGAGGDGGDFGGGAGTGYNGGSTGGSGGFGGGDGGRYSFGGDAGDAMGGAIFVREGGTLSIIDSTFTNNGLIAGTGGAGDTAPEDGANGQAIGSGMYLHTGVTAGYQVNTGTLTLADDIGGSGSLNKTGTGELVLSGTNTYTGTTTVSAGRLVVNGSLAGNTTVDTNSELGGSGTINGDVINNGTFAAGNSIGTMTIGGNASFNSGSTTEVEIQASATPIAGTDNDLITADTATINGGDVSVLGAVGSYTNGAKYTFLQTTHGLSGTFDTITDDLAFFDAQLGYDANSAFFTLMANSTDYASVGGSGNRQTVGFYIDENSIGASGDFGSVLDEFRVLTNAQVQSGLSQLSGEVYGSQSQVVIQGTNQLVGTIGGQLRSGMFGGGSGGSGSSGSGFVNATRSTRPSVTGSSSDIALVSYVNASSTQTPCDALIAPTCHAAYHWKGWMTGYGLGGSAESDGNAAGIHYGLGGTTFGIERYLGDNARLGFFGGYVGSSVSADSMDQTVRANGGNFGSYLTHSAGSHYGIAMGGLQFDGYESDRTIQVGALTRTASGESDGWQGFAYGERGMNLNLSRSRVLQPFAGLQYVYARQNAFTETGAGAMNLAMSGVDTHSLRSNLGTRLQWQSWMSRRGWAITPEIRGSWMHEFLDTTSVVNAQFAGVGGAGYTANGLDLGRDWAILGGGFEARPSDRWELRADYNTQFNENQVLHIGSGTLAYRW

SEQ ID NO: 20789 - protein, 501 aa, Pirellula sp. 1
MVLVSCSSAFSASRNGWFDCSSIENSTQKFDSPYTNVADACENAARVGLERAGGFRLFPGNFHLGVKMSDTFNPDTPNIDAPAIDSPTTDPEPAEFEVKLASRVDRLPPYMFGRINNLLYQKRRAGDDVIDLGMGNPSDPPDPIVVQKLNDAAADIGNHGYSKSNGITNLRREVASKYHRKYGVRLDPEGEIIACLGSKEGFSHMCLALMGPGDTAIIPSPYFPVHMYGVILASGNVVALDVADPDKFLSNVAYTCENLTPRPKVLIVNYPHNPSSAVIEGDFFVEVVRLAKKYGLMVIHDFAYADVAFDGYVPPSFLSAPGAKDVGVEFTTMSKGYNMAGWRVGFCAGNADMVRGLGTIKGYYDYGMFQAIQIAAIVALRETEATVAKQSEVYQSRRDVLVSGLRRLGWNVNPPKAGMFVWAEVPEPWKSQMSTMDFAMMLLEDGNVAVSPGSGFGAAGEGYLRMSLVENEHRLRQAVRQIGKCLAAGKADAGPVASSAS

SEQ ID NO: 20790 - protein, 207 aa, Pirellula sp. 1
MPAAALHPSFDPGSFVRIVFIGPPGAGKGTQCELLSKALKVPHIGTGGMLRALEPESGEQIHLRIDRGHFAPDDFVLQMVAERLSQPDSRTGYLLDGFPRTQVQASAFDKQLVAASLKLDHVLHLQVSADVLIERLRKRGETENRADDSEEFIRERFRIYEDRTAPLLDHYRCQGLVRDIDASDSESLVHASICECLNFTLASPAES

SEQ ID NO: 20791 - protein, 1237 aa, Pirellula sp. 1
MSSIFVSAESLVKDLVLNQPDSTLSSTWKGFDPEQDAAAAIEMAADLLRESRALQTPQERRQQSELDRMIGHDADKATLVEMTDQAFRTHTPARVADQMTHLLDLQGIPRFFSPVEQAMLKGFQSFGEYLPGVAVPLVKEKMRRETANVILPAEPDLLTPHLASRQRHGVAMNVNLLGEALLGDDETRKRMQSFYELLRMPEVRCISVKLTTLYSQVSPLAREHTIRMVADRLERLYRNANHMDDGSKAKDKFVYLDMEEYSDLYLTADVLRETLERGDLDSVQAGIALQAYVPDSCLVMRDLIEWSTKRVAGGGAPLTIRLVKGANLEMERVHASVGGWPLAPYTNKHDTDANFKRMLRELISAAADGNIRVGVASHNLFDVALAMIWTQRSGASDSVQFEMLEGMANHQRRALTERDAAMLLYAPACKKSDFLHAITYLIRRLDENTGAENFLRHAYRLQPDSPDFELLAGRFKDALMDCETVSVQPRRTQNRYQTPVQPPAAEHWTQFVNEPDTDWSLPHNSKWAQETLDRWKPLCDEQATRVTPVLVGLPDVDSLDGDDRVSAEWFTTDDVSRPGVVTCRYKNATSPAVESAVRASSESTWAADLSVDERYSVLRSVAQLARERRGDWIGSMVAGAGKTVAEADPEVSEAIDFLEFYPLTMKAWDECAGIQCEPRGVVAVITPWNFPLAIACGGIAAAIAAGNPVVVKPSMQTLLPAWLMCQAFWDAGVPRDALQFVICDDEVAEEQLVKNPIVDTVILTGGTSTAKRMLDVRPDLHLLAETGGKNVTIVTAMADRDLAIKHVLHSAFGHSGQKCSATSLLLLENEVFDDPEFREILADAVRSLPVGSAWDLHTRVTPLVDPPTDKLRRGLQELEGGESWLVMSEHVDGNPTLYRPGVKWDVQPGSFTHTTELFGPVMGVMRFGRLEEAIEIVRSTGYGLTSGLESLDDREIKLWRESIPAGNLYINRPTTGAIVLRQPFGGVGLSAYGPGIKAGGPNYVLALSKVTHASDWTPPTDEVEASHDQLDRMRDWIERGRYSDEMLGDGQKFRIERAITSQEIANATDFALEHDTYRLTGQDNIRRYRSVDGMTIRIEKDDDIVDAIVAISAAVCVGTQFTLSLSPELDRSKSAMLETTADWLPGLIDPIEESVEQLIERIEGGGVSRMRTLTHAKESIRRACGRRFITVIDEPVVDHGRIECLRYLNEQSISHDYHRYGNLGRRSAKLSQPTDAE

SEQ ID NO: 20792 - protein, 304 aa, Pirellula sp. 1
MPSIETQSTSPPPLRIPHREASAHKGNFGRVLLIGGSRGMAGSIALSSIAALHTGSGLVAAAVPDCILDCVAGFHPALMTIGLGDDGEKFADPAWQSLKDRLSAQAAIGCGPGMTTGSGGATIVEGLLAKKDLPLVLDADALNIIAQNDWLSDGRFERSKADAACVLTPHPGELQRLTGASAKDVDAQVEAAAELACRLGLTIVVKGGPSHVAYQNGDGGKQVWQNTTGNPGMATAGCGDVLTGIVTSLLGQGLSGPDAAKLGVWIHGRCGDEAAARWSHAGMTSLHALDALALVADEMTQPAD

SEQ ID NO: 20793 - protein, 271 aa, Pirellula sp. 1
MATKSAHSSVLAVKRILKKGGTMHPYVAEFVGTMFLILFGNGVVANVVLPKTNGNNGGWIVIAAGWGIAVFIGAFCASEFSGAHLNPAVTFAMYWADTEFGLLDSGGYIGAQMLGAMAGAALVYVFYREHFREASDDPDGMLACFSTAPSIRKLPQAFVCEMIGTFALILPIFLMVAPGFSSGPEPVDTDPVLGLGSIGLLPVGLLVFGIGLSLGGTTGYAINPARDLGPRLIHALLPIKGKQGSDWSYAWVPVLGPLTGAALAVVVNSFL

SEQ ID NO: 20794 - protein, 363 aa, Pirellula sp. 1
MSSVDPRDTIASIDTQILDLLRERCRAMTENTASNSNPDWASTLTSIDAVVDRFKQSGSGNDGTNNEMPESEIQRNILQHVASACWRATRPGTYAFLGPPDSYSHLAALAYFGEAANLLPVSSIGAVFDAVGRSDCAGGIVPIENSTDGRVVDTFGRLSKGEVSITGEVQLAIHHQLLAMCDRDSITEVHSKPQAISQCRVWLANHLPKAKLIECSSTAAAAKLAATQAGVAAIASEAAGRRHGLRVIGANIEDNRDNVTRFAVLGHEQPAPTGQDKTTLLFQVAHQPGALADVMGIFKRHELNLTWIESFPQPGTKNEYFFVVEFPGHCQDIAIAKAIEDLKTATHHTHVLGSYGRAARAES

SEQ ID NO: 20795 - protein, 244 aa, Pirellula sp. 1
MSPEVLSARPGFVRNLMDVMMKPVLQLPPMTCQRIREIDSLAMEQFQMPGIILMENAGRGAAELIEELAPEGNVLILCGKGNNGGDGFTIARHLQLAGREVMILAMAATNELQGDAAIQAKIAEAAGIKIQVVGEAVEAGRLPATDIVVDGLLGTGAKPPLRGRYAEVVEAANASSAIRIALDIPTGMNGDTGETGETTFRADHTLTFAAPKVGFEKLGAARFTGEVHVISIGVPLELLRQFSV

SEQ ID NO: 20796 - protein, 328 aa, Pirellula sp. 1
MKAMLIKNYGENAPFEASEVDQPEVKPGHVLVKIAASSVNTVDTMIRKMGKDLPLSPDAPALLGMDFAGTVEAVGEGVQNYSVGDEVYGCAGGLADLPGTLAEYIVADADLIAHKAKNLSMKEAAALPLVAITAYEGLVRAGIQAGQKVLVHGGSGGVGHVALQLAKHFGADVYSTGGGDKQLALIEKLGATGINYKTESVEQYVAKHTGGAGFDVVFDSVGGANLTNSFEAAALNGQVATTVSMCELDLTPAHFKGLSLHVVFMLIPMLHNHKRSEHGDILRKLTEIAESGALTPILDETNFSLEEAGEAYARLESGKAMGKVVIEN

SEQ ID NO: 20797 - protein, 266 aa, Pirellula sp. 1
MKRILITGATDGIGLETAKALVSRGHHVLIHGRNADKLKQVEQSLNSLSSEASIESHLADLSDINEVESLAGSVAAKHDHLDALINNAGVLSTSDPMTPDGLDVRFVVNTIAPYVLAKRLRSRMDSSGRIVNVSSAAQKPVDMAAFRGELQLDDLEAYSQSKLALTMWSRGLADKLGTDGPAIIAVNPGSLLSSKMVHQAFGVPGKDITIGANILVRAALDEEFADASGQYFNNDAGEFGTPHADALDAEKNAAIIDHLESVLATV

SEQ ID NO: 20798 - protein, 238 aa, Pirellula sp. 1
MPRLSRLIPTLCLATFVMTSPGNAQDDSAAKVDDQLGYFLGFTVGNSFVQQGFEPTDFTVEGMNQGLKDALSEKDPALSDEQLQEIQGKIQAMMQKRQAERMAELKKQGVMNKEKSDLWLKQNAKAKGIKELEGGLQYKVVKEGEGASPTAEDTVAVHYTGKLTNGEVFDSSVERGQPAKFPVGRVIQGWQMALQKMKVGSKWMLYIPPELAYGENGSPPKIGPNEVLVFEVELLEIL

SEQ ID NO: 20799 - protein, 364 aa, Pirellula sp. 1
MMPHLRLTDFELGAVLGVGTVGTVYDGKILDDVEVHPAAEAIRGQDLAVKKLHPAVSQDDLIQARFRREMVILERLQHPNIIGYFGGGSEDGQLFYVMERVDGGTIKDLLETNGALAWPVVVDVARQVCSALQCAHNHGVIHRDLKPGNLFLTRDAHVKLGDFGIARDQHSSDLTSQGLTVGTHAYMAPEQITGDEAISGKADLYALGCVLFEMLANRKVFAGENFAQLFEQHLRTKAPTIASIVPDVPPELSQVIADCLEKSPDDRPFNARSVQGVMIEIGEKYNLSAPPDSPVGPNHSETGNAPKDVSADSVTEKGRRLLEEQIHYRLGGTSREPVSAGKVSLIVVAIIVLIVLAVSLSGGS

SEQ ID NO: 20800 - protein, 323 aa, Pirellula sp. 1
MTNHPASYSYATEAITTPIAPVKLSDDGPVIWCKLEYHNPSGSTKDRIARFILGKAIRSGLLGRGDAVVEASSGSTSISLALMCAQFGLRFTAVMPRGVSSERIKMIRAFGAEVILTPAEEGVGGAMALADEIAGRGEAFASKQFENPDNPAAHRYQTAAEIIAQVPSRSVDAVVSGVGTGGTLVGLYQGFCDFGCITRPVLARPVCSDGLYELECSSFSKKIPGVVESASAIFRDAHLPGLRQVDVKDSVALACCRQLIRRGFPVGPSSGLNFAAALEAARDLPPDSTIVTVFPDRMERYFSTPLFSDSVEELECDPAQTCC

SEQ ID NO: 20801 - protein, 489 aa, Pirellula sp. 1
MSTTLPEIAPPKVRHTQLFIDGQWRDSASGKTFATINPATEEEIVQVAEGDKEDIDAAVKAARKAFESGPWRTMDARDRGRLMMKLADAIENEIDELAQLETLDNGKPLRESRHADLPLVIDALRYYAGYADKIQGETVPIRGNYLCYTRKEPVGVVGQIIPWNFPMLMVAWKWGPALATGCTIVMKPAEQTPLTCLRMAQLAKEVGFPDGVINVVPGFGPTAGGALVDHPGVDKIAFTGEHRTAQLIMKNSAQSLKRLTFELGGKSPNVIFSDADLDAAVQGSFVGLYLNQGQCCCAGSRVFVEESIHEAFVEKLTDLTNKRVVGNPFEHTTEQGPQIDQAQFDKIMSYIDKGNQQGASCVSGGKRSGDRGYFIEPTVFTDVQDDMAIARDEIFGPVMSVLSFKDSDDILKRANDTMFGLAAAVWTQDIKKAHHFAANVRAGTVWVNCYDVFDAAAPFGGFKMSGQGRELGTEGLKAYLESKTVTVAL

SEQ ID NO: 20802 - protein, 330 aa, Pirellula sp. 1
MAEDLYQTLGVSRDADKAELTKAYRKLARKYHPDMNPDNPDAQEKFKRVQEAYEVLNDEQKRAAYDRYGSDFEKIRGGWNPGAGGGGGAAGPSFDGLDLEQIFGAAGRGGGGGGQPGFENGFNDFFEQILGGGARGGGGSPFGGGQRSAPPQRGQNIRHELSVTFRTAVLGDKVEFYLARGGKQEKLSVAIPPGVSSGSKIRLREQGHPGPGGAGDLILIIQVDDHPFYKRNGNHLELKLPITVAEAVLGAKVDVPTPAGTITLSIPAGSSSGKRLRLKGQGVRNPKGTDGDLMVELQIQLPESIDDESKKLIEQFDAANPMQPRESLKF

SEQ ID NO: 20803 - protein, 476 aa, Pirellula sp. 1
MQDYRHTKIIATIGPATESPEKLAALIEAGVDVMRLNMAHGTPEWVGEIVARIRKVSKDISRHVAVMMDVKGPEIRTGAVEDAIELKAGDELVLFTEDCADQSAVESDGTPRVSVNYLGLPGAIDLDSTILVDSGLLHWHVLKKDATTVRCRVITPGVLESRRHINLPGVQVNLPAITDKDRTDLAAGVKAGIDFVALSFVRQAEDVRTLRAFLDEHGSPARIISKIEDQAGVRNMKAIIRQSDAIMVARGDLGVEIDYHRLPLVQTDLIRACQEDGKPVIIATHLLESMIQSPVPTRAEVSDVSNAIREQADAVMLSGETTTGKYPLESVGVLQNIVASIEPTVSRQLNSKIVLREPKSMMLRSACTLAQEMGDSGIVVFTRSGFLAYVLGALRPRGVPIFAFTDVEHTFRHLMLPWGVEPFFMEFSEDHDQTITNALEVLKESGWCKPGVWLGVITNALADEKIIDTLQLRQVQ

SEQ ID NO: 20804 - protein, 484 aa, Pirellula sp. 1
MLDFGTAGTQTLGRREIIGTAVEQRASDEQRSNIGQSKLNQRVFLWSLTSSLAGFLFGFDTVVISGAEKAIQGLWALGDFQHGLALSAALWGTVIGSLVGGWPTDKFGRKKTLLWIGILYLVSAIWSGFATDVFSFMIARFIGGLGVGISTVAAPLYISEISPPKHRGTLTGLFQFNIVFGIMVAFASNYLIGTWGNENAWRWMLAVEAIPALIFTVMCISLPSSPRWLIAVKKDQAAGMSVLKQLRPDASDEEVQRTVDEIVASLRAESDLTPAEPFWSRRLFTPISIAFLVAFFNQLSGINAVLYFSPRIFELAGMGEQAALLQSIGIGITNLIFTFVGLYLIDRLGRRTLLLIGSAGYILSLGTCAYAFQSETFSIVPACIFAFIASHAMGQGAVIWVLISEVFPNEHRAAGQSLGSFTHWIFAALLTLVFPAVVETFHPAAIFGFFCFMMVLQGLWVITMLPETKGISLEQMEAKLGIRV

SEQ ID NO: 20805 - protein, 206 aa, Pirellula sp. 1
MFREFRGRGKKMGLTGVSGWFTLRSQLSTTFGLVGLFWKRFPVKRARMREASCLVGDGLQGIRLVTNIYVGNLSFKATEEELRGAFEQYGEVSAVNIIMDRETGRSRGFAFVEMADAEGAKDAIENLNGHEIDGRSVTVNEARPREPRSGGGGGGGGYGGGGGGRGRGGGGGGYGGGGGNRGGGYGGGGGGYGGGGGGGYGGRGDR

SEQ ID NO: 20806 - protein, 397 aa, Pirellula sp. 1
MAKKTIDQIDVQDKTVLMRVDFNVPLDESLAITDDRRIRMALPSIKSVIDRGGKVILMSHLGRPTGGEGDEKYSLAPAAKRLGELLGSTVHFATDTVGDDASSKASSLAAGEVLVLENLRFNPGEKKGDSEFAGKLAAMADAYCNDAFGTCHRKDASMVAVPEAMAGKPRVVGHLVAKEIQYLTDAISKPERPFVAILGGAKVSDKINVINNLLGICDAVLIGGAMAYTFSLASGGKVGKSLVEKDKVELAKELMAKGGDKLQLPVDTHCGDDFGNIAGCNKKVVAAGEIPDDMEGLDIGPETAKKYAEVIKSAKTIVWNGPMGVFEKPPMDEGTKAVAQAIADGDAVSIIGGGDSAAAVDQLGFADDVSHVSTGGGASLAMLEGQAFAAVDLLDEA

SEQ ID NO: 20807 - protein, 1257 aa, Pirellula sp. 1
MTVDLDAIAQRGRCEVSSLRLALPLIEQGYTPPFLSRYRRDELGDIDEASLWNLAHAVRTQKKLDEYRSDLQEAWKQTPLADPAIGRAIGNAQSKRLLDRLSRRVKLETGESANLAQRLAVRTLNPQKGDGEDLKALAESLAAEPAAVETTAEGEAASPEPASNDVDGALAKLDATIAKRLIGDPRIVGAAVRWLSRNAKIRVMEVHDPHIQADDDSSESSDPQPKAQKSAAPAKDQPEAAAETKVSEAPASAAATETAEATPAADAPAAESAAAEGAAPEANATEAASSPETPTAEAAQTPASEPVAEAAPAEQAAPTEPADAEAPAEQPSAEQPAAAATPTAEALAPAAESAESTEQPASDKPAASVTKQAPAAKAAPAKAKAKKSKKISPRQRRRRWLVSTLKPLAGKSMPANKLSSFQLVMLGRALRSQVAQCAFDYDAAKLVAELQKTAAGFNRPLADRLSGLVLENEAIIRDAAEAAWWDELQEQASARLVSIAADNLHSQINRGGVEAKVVMSIDAVGPRTAATSIVSSDGRLLHSEDIPCQLSAAMRTLAVTKMGELIHAHHVDLIVISNGPARRACMIAVGELIKQSADKSVRWTLADRSGADAYAGGPAGDQEMKSTPRRFRAAAWIAFSAMQPAQALVKVDPLKLRLGSFQRELSDDAVLSALEDVMVSGAARGGVDVNSTATTWMQRLPGITPDISQAIDERRREKLIASREDLATAVEWPSVVNSRQAMPFLRVFASEETLDGTLIHPDDYPLAKKLATALNVELPPDRPPAYELPDYSTPAPAPAPAAVEAPAEATSEAVPAAEETAADGAESENAASASSAELSAETSPESTEAPASDASSEEPVAEASSDETPADDAPAPEAVAESAESAASDSEASEEPAVAGGDAAETKAEADAPAAPAAPEPVRRPMPERAAVDKLIKEWQIGKRRSHQLVRWLCDPFGEGASEGEAPAVMTAMPSLSELKQGDQVIGVVVGVMPFGVFIELSPDCSGLIHVSRISDSYVEDLHEAVQVGDVITAWVTGTDAKRRRVALSAISPEREAAMESRRQNERGGRGPGGRGQRGGQGGAQGTGQGQRSESAPRGRGGQSGGDGRTGQGGQRGGPGRGQGQGRGAQGGRGGKPGGRPGGRDGGRGGRGRGPKKPEVYEVIGKDPEKPKISDAMAKGDEPMRSFGDLMQMFSKEKGQTTPSADKKPAAKPPAAEKPVAEKPAEVKPADTAPADAPKAEAPVAEASKPAASEGDE

SEQ ID NO: 20808 - protein, 457 aa, Pirellula sp. 1
MSITSVNPATNETIREFEPLHKDDAMQAIETAHKAFEEWRATSFDERKKCILKFAELLRADSDEYARMITLDMGKRISESQYEIEYCANIAEFYANGAEEFLADTPMERVDANAYLHYEPIGVLMGVMPWNFPFYQVVRFATPNIMAGNTVMVKHASNVPQCAAAIEELYNDCGLPNGVYQNLFIPSDFVDSIISDSRVQGVSLTGSEPAGRAVAAQAGKNLKRSVLELGGNDPFIVLEDADMELVIEQAAKGRMVNAGQSCVASKRFIVVKEVAEQFMNGFKEKLQALKLGDPMDEETTLSPLSTEDAAVKLQEQVQSSINAGATVVLGGDRPDREGAFFNPTILTDVTPDNPTFDQELFGPVATVYVVDDEAAAIELANHSSYGLGGSVYTTDIQRGRRVAEKVETGMMFLNQPTSSQAELPFGGIKNSGYGRELSHLGILEFVNKKLIHLGEKE

SEQ ID NO: 20809 - protein, 385 aa, Pirellula sp. 1
MASNNMNAPASNSSKSALFQPLEIGGLTLRNRIVMAPLTRARAGVERMANEMMAEYYTQRASAGLIISEATVVSEQGIGWPQSPGIYTDEMAESWKVVVDSVHQAGGRIFLQLWHTGRASHSDFHDGELPVAPSAIAIEGDGVHTPSGKKPYEVPRALETSELPGIVEDYRKAAERAKSAGFDGVEVHSANGYLLDEFLQSKSNHREDQYGGSIENRYRLLGEVVDAVTSVWSSDRVGVRLAPNGSFNDMGSPDYIEQFTYVARQLDQYGLAYLHVMDGTGFGFHELGPAMTLADFRKVFSGTLMGNVGYTRESAEEAIVDGAADLIAFGRPFISNPDLVERFENGWPLAEMADMSVWYSHDAEGYTDFPTYQAESKQPESCGVE

SEQ ID NO: 20810 - protein, 336 aa, Pirellula sp. 1
MKTVHAYAVKESKGTFEEFEYELDHIGANEVDIDVESCGICHSDISMVDNDWEMSQYPLVPGHEVIGKVSSVGDHVTHLSVGDRVGLGWHAGYCMVCDQCMSGDHNLCNDAQATIGGRHGGFADTVRAQSASVVKIPDSLNAKEAGPLLCGGITVFNPFVQLDLSPTSSVGVIGIGGLGHLALKFANAWGCEVTAFTSESKEEEALEMGAHHTINSRDMDAIKNTDLRFDLVISTINVPLDWNAVLGTLKTHGRLHMVGALTEPMEIGLLPHMLFNQLTLGASPVGPPVIIRRMLDFAARHQIAPVTEHYPMSKVNDAFERLRSGDARYRIILDRD

SEQ ID NO: 20811 - protein, 507 aa, Pirellula sp. 1
MNALLPHDEHNQQLEANVHPTDWQNPSPKQPYHLVVIGAGTAGLVTAAGAAGLGARVALIERDLMGGDCLNVGCVPSKGVISAARVAATVKNASDFSVHVPNGVEIDFDGVMSRMRELRAKISQNDSAKRFQDLGVDVYFGQASFTDSQTIDVQGTKLQYKRAVIATGARAAAPPIKGLDQVDYLTNETVFSLTKLPKRIGIIGAGPIGCEMAQTFAQLGSEVFLIESQHGILPKEDREAADIVQKAMLADGVQLLCCGHDLEIKNEGGIRLTLNSHGNQYDQPVDQLLVAVGRAPNVEKLNLDAVGVKFDKNGVEVNDNLQTTNPNIFAAGDVSSKYQFTHVADFLARIVIQNSLFAIGPFGKKKASELIIPWATYTSPEIAHVGMYEQDAKDAGIEIDTYVQHFREVDRAILEGEEEGFVRIHTKKGTDKIVGTTIVAKNAGDMISEITVAMNNNVGLGAIANAIHPYPTQAEAIRKLGDQYNRTRLTPFSKTMLHALMRWNVGR

SEQ ID NO: 20812 - protein, 2471 aa, Pirellula sp. 1
MNSPERDLSERLAKLSPEQRAALRKRLARSSSSTSAPATQRADSGQSKAAVEPIAIVGVSCRFPGAPDLDAYWKVISEGIDATAEIPPERWDVDSLYDPTGQKAGRMSVRRAGMVDNIDQFDPKFFGISPREAARMDPQQRLLLEVSWEAFEIAGIPVTSLAGTPVGAYVGIGGTDYSKVPSTYDGYYQYIDAHVGTGNALSIAANRLSYIMDLRGPSMAIDTACSSSTMAIHLAVQSLRAGECDAALAGGVNAILTPETTIAFSKARMLSPDGQCRPFDADANGYVRGEGCGMLLLKRLSDAERDGDRIWGTILASATNQDGRTSGITAPNGVSQQAVIRTALGEAGLPASRVNYIEAHGTGTPLGDPIEVDALTQVFSGKPGVDPPCYVTSVKANVGHMETVSGVAGIIKLLLMMRHQTIPGQLHLNKLNPRMSLKRSRIVIPAQSPPWPVDDEPLVAGVSSFGFGGANTHLVMQQYLAKQTVEPSASKQSDTKDRTQHVLSLSGKSDAAIAEVASRLIQHLDRTNDHMADVAHTMNVGRVHHTHRTAVVFEDAKQLHRQLTQLSEGKKGPGIRSGQTVTSRATRTAFLFTGQGSQAPGMGRGLFETQPVFRKSMKRCDELLAKVLPKRLLDVLYGEGSDIELVHQTRYTQPALFAIEYSLAQLWLSWGVKPNVVLGHSVGEFAAACVAGVVSLEDALSLIAHRGRLMGELPAGGGMTAMFESAEVITDRLGEFESSVSGSLSIAAENGPQNTVVSGPQSDLDAFAKHCDEAGIASKALQVSHAFHSQLMEPMLDEFRQIAAQCEFKSPRIPLISNLTGEQWTKAWDADYLCDHIRNAVRFEPSMRALAEMDIDVMLEVGPSPILSGMGKRCLPESSATWATSLRSGKDDETTLFEAVGDVHARGGKIDWKAFDQPWKRQRLVLPTYPFDRQRYWLDPSDEIVEDPSRNRTGTGELLHPMLGRFQPSALRSRLYENALSARSPEFLADHAVQGSVNLPGAAFVEVAFAAARDRFGPGKHAVTDANIEQAMFVSEDRWKTFQTIVDESLSLEVYSRDRVDANDSWQRHMSASLVPAEQVGDSVDVEVVPPPPGLATVAQRFVGGKDHDEFYDLMSHRRLEYGPRFRMLHRIDYSIDEALGQVQCDDATCAELDDYILHPVLGDALMQTFSALVPRPDHDTFSEATYMPTKVSRAVVYQRPEGTLRTYGRRSSSGDVLDPEFVEGDVWLVNERDEVVAEWTGVRVTRVGRVGGGKSESLDDSLYQIDWQATESLPAASDLEGKQVWLLGDPGSRRDSLAKQLIGFGAEVVEGDLDEDLKTLAEKSESTLPLAALITLWDPSGKSSNPADDAVAVCQSALKQIRSAITHVPVSKHFRGWWHVTTGTQPVSESESSIDLVHAPLWGMIRVAMMELADLKPSLLETDPSASDQSNGLVIAAEVIAADDEDHVAYRDGTRHLGRLVKRRAPAESGNDTSVTIPSQPHRLRFRQTGSFDSLYFEPMERETPQGSEVELRVNAAGLNFSDVLKVMGLYPGITDKVVPLGIECSGVVTAVGKDAKRFQVGDQVMGVAPFSFGSHAKTPEYTLVKRPAGMDDVEAATIPIAFLTAWYGLVHLADVQPGERVLIHAGAGGVGLAATQIAQYLGAEIIATAGSDEKREFLRECGVKHVFNSRTTEFADDIRRAFSGEGVDVVLNSLPGEAIPKSLGVLNAYGRFLEIGKTDIYQDRKVGLLPFQDNLSYHAIDLDRVLRQRPAKIEKLWAELAERFEAGDLQPIACTEFDQTEMVETFRYMAQRKNIGKVITRMSTIATTDAVPQEEASESTVLITGGTGAIGLKLAKHLIKDGATSIALLSRRQPVGDVAAKIDALKQDADSVQVTVLQGDVGELDSLRSALKQLPGSLPPIRHVYHAAGVLQDGLLMDMTEEQLRVPMGSKIQGGWNLHVATKDLPIETFVLFSSIAACLGSPGQANYAAANGFLDALSEYRREKGLPATSIAWGPWAESGMAATEDRSSQLESRGMRLLPAIACLQTMQQLIDAGDQYVAVMDVDWPAMTKSMRRSRPFFAEFADRSQVDGKASVDQVDHEFRAQLSEVPESERTERLRRYFASELARLMGWEAEQIDVKQKLSELGMDSLIAMELKNNLEQRLAITIPMSALVESPSINSLVGHVVSQFADEDGEMKKASEKSEEPGGDRTALIVPLKADGARSPWLCIHPLGGSTACYSEFSQQVDDDQPVYALVGGGSDGVSEPPTSLDAMMEEYVELVQAQFGDDELRLIGWSAGGVFALELARRLENEGRSNVAVTLLDTPLPSIYRNVDPNDDVQFVADLVQFSNAFSGTDMYLSAEELEDARGTDQIWQRVLEEAQRAGVLSQSASPDMVRKLIDTSRQHVLFIKSYEIDPTSPSVQLILPVKTTALEGSSGERWTDHLDWASHLDSEVIVEQTDGDHFTMLLGEQAKELAKRMEQHAAAK

SEQ ID NO: 20813 - protein, 126 aa, Pirellula sp. 1
MSSHVPNFDAGVPCPKTGQPLLPAIAQDATTGRVLMLAWMNREAWDETISGNRAVYFSRSRGKLWRKGDTSGHAQVVREIRVDCDADTILLSVEQTGAACHENYESCFFRRVDPDGTTHITEERIA

SEQ ID NO: 20814 - protein, 335 aa, Pirellula sp. 1
MHPMKAAFITETGPADALQVGELPDPTPGPGQVVIRVYASAINPIDTYIRNGTIAMELPLPFVPGCDAAGVVESVGPGVKRLSIGDRVWCTNQGLLGRQGTLSELIAVDEHWTFKLPEPVPYEDAAACALVGVTAHLGLFREAQLEPGETILVIGGSGGVGSMVVQMAAATGARVITTAGSEAKAQVCRDLGAEEVILYKDESIADRTKAFAPDGVNVLWETRREPDFDMAIDLMAGRGRMVLMAGRDAKPAFPVGPFYVKECSLHGFVMFKATPMEMKNAAEDISQWLASGKLSANISARFSLDEAAQAHALQESATLEDSSQLAGKIIVTLNT

SEQ ID NO: 20815 - protein, 351 aa, Pirellula sp. 1
MVQANSRARTSLFLSLWLNLMTHDVYAVGNALVDIQTMVADDLLSELKLDKGIMTLVDDEKQATVLSRFDLPSLSRCAGGSAANTIAAVADFGGKAAFVGKIGDDETGQFFLKDLRALGVTIDVDPQPGTPSGTCAVLITEDAQRTMLTNLAASTALSEADIDEAVIAASKYVYIEGYLFTGEQTKAAAYKAIELAKKNDVKVAFTASDPFLVNMMKDEMWDLIRGPVDLFFCNEEEAKSLTGLEDPIACANKIHESAENVAMTLGPNGSILMHGGEAIPVEGVKVKAIDTTGAGDMYAGGILYGITNGLDWRQSGHLASHAAARVVAQMGARLQKPFTEDEVKQLTDLTV

SEQ ID NO: 20816 - protein, 428 aa, Pirellula sp. 1
MTLIESIHARQILDSRGNPTVECEVTLMDGAAGRAAVPSGASTGMHEAWELRDGDKSVFMGKGVTTAVKNVNTKIADALEGMDATDQAAVDQAMIELDGTPNKKELGANAILGVSLAVAHAAAASTNQPLFRYLGGAGARMLPAPMMNIINGGEHADNGVDIQEFMVMPLGFERFSDALRCGTEIFHNLKKVLSDKGYSTAVGDEGGFAPDLKSNQEALDVIMTAIDKAGYKAGEQVWIALDAASTEFYDKSSGKYSLDNNQMSGDEMVDFLAGWCDKYPICSIEDGCDEDDWETWKKLTTKIGDKVQLVGDDLFVTNVERLQRGIDEGIANSILIKVNQIGTMTETIDAIQLAHRNGYTSISSHRSGETEDSTIADLAVAMSTGQIKTGSASRSDRMAKYNQLLRIEELLGDAAQYGGPLFAKRITG

SEQ ID NO: 20817 - protein, 369 aa, Pirellula sp. 1
MKRHFLPRLSAWRVAFQSIWQRFFHRVRTSGLAMCLSAAFGCVPVVAQEPAVAETQVAETPAQAETETPPLQPTAETKTPDTPATDTPATETPKTATESADEAKIAEEPAYVRVHEVDGKPNALQTATVQFVGQPGTRYDGAIVDLVGVVHIGQDEYYTELKEQLSKYDSVLYELVAPDGTRIRPEDLEERRSILASVQTGMKDMLNLEYQLEKIDYMAENFRHADMSPDEFVEDLEKRGDSVWKMIARMLGAGIASQAKTGGDAGLLMAMFSGEDRPKNMKRAMARQLVDIELVTAGMDDANGENTLIKGRNRKAFEILKEELDAGKENIAVFYGAGHLPDMAERLENDFGMKAVQTTWSDAWDLTRN

SEQ ID NO: 20818 - protein, 312 aa, Pirellula sp. 1
MEMDTAVENPAVEKNGQPTPSSTSTATDAAPTPNAPNRPAPNTAGNRKRGVPEGVWRKCDSCGASLFYKEVQQRLNVCPQCDHHFYVSAWERVAQVLDDGTFEPMNEHLRPTDPLEFRDRRSYAERLVGEQKRTGLTDAVLTGTGMIRARRVAFAVTDSAFIMGSMGSVVGERLTRLIERATEQNLALIIISASGGGARMHEGILSLMQMAKVSAALSRYHAAGGLFISVLTNPTMGGVAASFASLGDLVFAEPKALIGFAGPRTIKATIGIELPEGFQTSEFLLEHGYIDRIVHRKSLKTEIATAIDYCGK

SEQ ID NO: 20819 - protein, 381 aa, Pseudomonas fluorescens
MNVSTEILHIRVDDREAHPSVTPIYQCSAFSADSAFFYSRKANPNVTELEQVVAALEGSEYALAYSTGMSAIYMVLELLKPGGSLVINKYIYGCSYKLFQRYAARIGAKLTILDLTTESGLKELPSDVDMVIFETPTNPFLKDIDIHAVSKAVKQNNPHALVVVDNTWATPIFQKPLNFGADISLYSATKYFSGHSDVMGGLVLVNNEMIYTRLLEGRFYSGSILAPNSAWLLRRSMQTFNLRMEKHSNTTSSMLNYLRELPFIEHVYYPRVDGKQLTGYGGIVFVDIRPDLVPFYKTFTSSLKWFGTGTGMACVTSMVAQPFSGSHASMTEQEKADMGIEKGLVRLCFGLEALEDLKEDLLQAFVAMENMANQKSALKPA

SEQ ID NO: 20820 - protein, 369 aa, Claviceps purpurea
MYSLLMLLLPVWTGSFVSAAPAVSRAAALSGADCTFSDVAQAIQKKASCSTITLRNLKVPAGKTLDLSNLSDGTRVIFTGRTTFGYQEWEGPLIAMSGKNLKVSGSPGNIIDCDGRRWWDGKGTNGGKKKPQFFNAHDMINSEIRNLNVLNTPAHAFSISHAENLGIFNVNIDDSAGDSLGGHNTDGFDIGNSNGVTISGCSVRNQDDCMAINSGTNITFVNGFCSGGHGLSIGSVGGRSSNIVKGVHIANSKVTKSMNGIRIKTIAGAKGAVSDVVYDNISLSDISGVGIVVQQDYKNGKPTGKPTTGVPITNITVNKVTGNVKPGGTNVQVLCGSSSSCNGWTWTDNKVVDGAKSRANSAVPAGVVL

SEQ ID NO: 20821 - protein, 370 aa, Claviceps purpurea
MYSLLMLLLPVWTGSFVSAAPAVSRAAALSGADCTFSDVAQAIQKKTSCSTITLRNLKVPAGKTLDLSDLNDGTRVIFTGRTTFEYQEWEGPLIAVSGTNIKVSGSPGNIIDCEGQRWWDGKGTNGQGKKKPDFFNAHDLINSEIRNLNVLNTPAHAFSISHAENLGIFNVNIDDSAGDTQGGHNTDGFDIGNSNGVTISGCSVRNQDDCMAINSGTNITFVNGFCSGGHGLSIGSVGFRSSNTVKGVHIANSKVTKSMYGVRIKTIAGAEGAVSDVVYDNISMSEISDIGIVIQQDYKNGKPTGNPTTGVPITNLTVNKVTGNVKPGGANVHILCGSSSSCKGWTWTDNKIVDGATPKANSAVPAGVVL

SEQ ID NO: 20822 - protein, 308 aa, Propionibacterium freudenreichii subsp. shermanii
MIYHDVTEVVGRTPLVRLNHVNDTDAVVLAKLEFYNPANSVKDRIGVSIVDAAEKSGALGAGGTIVEATSGNTGIALAMVGAARGYHVVITMPASMSRERRAVLHALGAELVLTPAVEGMRGAVTAAERIAAERGGVLASQFANAANPAAHHATTGPEIWNDTDGEVAALVSGVGTGGTVSGAGRYLKEQDPRVDVYAVEPDESPLLSRGRAAAHGIQGIGANFVPDTYDAAVVDEVLSVTTDQALAMARRLAAEEGILAGISSGAAVAAALEVGARPQYRGRTIVAIIPDFGERYLSTPLFAGLMDS

SEQ ID NO: 20823 - protein, 322 aa, Propionibacterium freudenreichii subsp. shermanii
MSAIHDSITELIFNTPLVRAPHYLKAAGAPDADIVLKLEYFNPAGSVKDRIALAMITDAEKRGVLKPGGTIIEPSSGNTGIGLAAVGTARGYKVKVVLPASLSVERRALIQAYGGEVILTPGPLAIKGSIAYAKQLHDADPSSVILGQFDNPANPEIHYKTTGPEIWKDTDGTVDVFIAGIGTGGTLSGAGKYLEEQKPDLKVIGIEPAKSPILEGGKPGPHGIQGIGTGFVPNTLDRSVYDEVVGITDEDSIAQARLLGTAEGIFVGISSGAALTAALQIAARDEYKGKRIVALLPDSGDRYLSTALGQFPELTVHEDVEL

SEQ ID NO: 20824 - protein, 156 aa, Haemophilus influenzae
NRANTPVLVDGKDVMPEVNTVLAKMKDFCQRIISGKWKGYTGKAITDVVNIGIGGSDLGPYMVTEALRPYKNHLNMHFISNVDGTHIAETLKKINPETTLFLVASKTFTTQETMRNAQSARDWLLKAAKDESAVAKHFAALSTNAKDVEKFGIDTN

SEQ ID NO: 20825 - protein, 156 aa, Haemophilus influenzae
NRTNTPVLVDGKDVMPEVNTVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 20826 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTN

SEQ ID NO: 20827 - protein, 159 aa, Haemophilus influenzae
MFRAAIKAGTELGKQAKALMDEGKLVPDELTVALVKDRIAQADCANGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQAEAKAGNTQ

SEQ ID NO: 20828 - protein, 159 aa, Haemophilus influenzae
MFRAAIKAGTELGKQAKALMDEGKLVPDELTVALVKDRIAQADCTNGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQAEAKAGNTQ

SEQ ID NO: 20829 - protein, 404 aa, Mycoplasma hyopneumoniae
MQPTYKNKKFIDDIDFLNKTVILRVDFNVPIKNGEISSIKRIIASLKTIKKIVNNGGKLVILSHLGRIKSKEDLPKKSLRIVAEKLAEILGQEIKFIPENRGPKVENAISQLEKGEILVLENTRFQDLNNKAESKNDAELGRYWASLGDVFINDAFGTLHRAHGSNVGIATYIKESAIGYLVKEELDALSKLIFSPQRPFYAIIGGAKISDKIGIISTLLEKADKVLIGGGMAYTFKKALGYKIGLSIYEDDKLELAASLVKKYPDKLILALDAALAPEFADLEPLYNQENPLEIPDHLEGMDIGPLTIELFKDHLKDGKTILWNGTLGVAEFKNFARGTKEVAKIIANLKECYSIIGGGDSIAAIEAEGLSNSFSHISTGGGASISFIENGDLIGLGPIQEKD

SEQ ID NO: 20830 - protein, 270 aa, Sclerotinia sclerotiorum
SLGRPILFVMNGVNGASMSDLKMKSPPNWFNFITGSQDVLISGMDLKAVTSNSHPVKNSDGWDTYLSSHITIQNSTILNTDDCVSFKPNSSSILIQNLACTGSHGISVGSLGQYVGVNDIVEDIYVYNNTLSNASDAARIKVWAGAVPNKDGSLPYGAGGGGGVVKNITYDGMTVVNDDYSIELTSCYMQTTANCNAYPTKMIIQDVVFKNFVGVASSKHDPKVGTLVCSSASSCINISAQNINITTPSKKKATWTCTNVDKSLLGINCV

SEQ ID NO: 20831 - protein, 337 aa, Phaseolus coccineus
MATVKKIGKKACVIGGSGFMASCLVKQLLHKGYAVNTTVRDPDNAKKISHLLALQSLGDLNIFGADLTGERDFDAPIAGCELVFQLATPVNFASEDPENDMIKPAISGVLNVLKACARVKGVKRVILTSSAAAVTINPVKDTGLVMDESNWTDVEFLNTAKPPTWGYPVSKALAEKAAWKFAEENHIDLITVIPALTTGPSLTPDIPSSVGLATSLITGNDFLINALKGMQFLSGSISITHVEDICRAHIYVAENESSSGRYIVSAHSTSVPELAKFLSKRYPQYKVPTEFDDCPSKAKLTISSEKLVKEGFSFKYGIEEIYDQTVEYLKNKGTLKN

SEQ ID NO: 20832 - protein, 336 aa, Gossypium arboreum
MASQLVGTKRACVVGGSGFVASLLVKLLLEKGFAVNTTVRDPDNQKKISHLVTLQELGDLKIFQADLTDEGSFDAPIAGCDLVFHVATPVNFASEDPENDMIKPATQGVVNVLKACAKAKTVKRVVLTSSAAAVSINTLDGTDLVMTEKDWTDIEFLSSAKPPTWGYPASKTLAEKAAWKFAEENNIDLITVIPSLMTGPSLTPIVPSSIGLATSLISGNEFLINALKGMQMLSGSISITHVEDVCRAHVFLAEKESASGRYICSAVNTSVPELAKFLNKRYPDFKVPTDFGDFPSKPKLIISSEKLISEGFSFKYGIEEIYDQTVEYLKSKGLLK

SEQ ID NO: 20833 - protein, 338 aa, Vitis vinifera
MATQHPIGKKTACVVGGTGFVASLLVKLLLQKGYAVNTTVRDPDNQKKVSHLLELQELGDLKIFRADLTDELSFEAPIAGCDFVFHVATPVHFASEDPENDMIKPAIQGVVNVMKACTRAKSVKRVILTSSAAAVTINQLDGTGLVVDEKNWTDIEFLTSAKPPTWGYPASKTLAEKAAWKFAEENNIDLITVIPTLMAGSSLTSDVPSSIGLAMSLITGNEFLINGMKGMQMLSGSVSIAHVEDVCQAHIFVAEKESASGRYICCAANTSVPELAKFLSKRYPQYKVPTDFGDFPPKSKLIISSEKLVKEGFSFKYGIEEIYDESVEYFKAKGLLQN

SEQ ID NO: 20834 - protein, 341 aa, Streptomyces sp. AM-7161
MLSVVMEEFGGPEVLRARQVEDPEPGPGQVLVDVAYASVTFVETQVRSGNGPFGRPALPRVPGNGVGGRVVALGPGADPALLGTVVVTTTGGEGGYAERALARADEVVPVPPGLALKDAVALLADGRTALLLFRQAEVKPGEKVLVEAAAGGVGSLLVQLAVHAGARVVGAARGDRKAELVVSLGASYVDYSREAWLRQVRETAGGGDLDVVFDGVGGAIGTAAAGALRPGGRISLYGMASGADATLDEDDLAARGIRTLGLFAAPGPAETHPLIGEALRLAADGVLAPVVGQVFPLAAAAEAHAAIEARATVGKTLLAVGAQEGDTYGTGAAGGATNGDR

SEQ ID NO: 20835 - protein, 339 aa, Streptomyces sp. AM-7161
MPCALSESMSTAARMVRTEEVPIPEPGPGQVLIEAEAISVFAQTQMRRNVFPAPMWRPEFPITLGGDVVGEVVAVGPGVTGNAPATGSAPSPWHGAYAEYVVVDADTVLPVPAALDAAQATALPAPGPIAMGTMGTASLAPGESVLVQRPSGGIGHLAVQLARLAGAGTVIATAGTPEKCAYARSLGADVAVDYSRADWPDAVREATGGRGVDVILDSVGGDVLRQGVGLLAPFGRLVFYGSAGGGLGIPAVSPMELIGMRFLTGFALSAWRNARPERYRADHDALTAHLLAGTVRQTVHATLPLEDVGKAHEIVESRAQLGRIVLLTGRGTRTAGGGA

SEQ ID NO: 20836 - protein, 354 aa, Pseudomonas putida
MTKLFSPVQLGPLNLPNRVVMAPMTRSRALGNVPNDLMAQYYSLRAEAGLLITEGTSPSPNGLGYAHIPGIYSDAQVAGWRQVAEAVNAAGGRVFVQLMHTGRVGHPANLPLGAHLLAPSAVAAPGEMWTDTEGMQPHPVPGTMTEQDIAAAIEEYAAACKNTVAAGFDGVELHGANGYLIDQFLNTASNHRSDRWGGSIDNRIRFAVEVARAAAAAIGAERVGIRISPYGVFNGMASDADMDALYLRLIEALNDVGLVYLHVVDHSSMGAPPVSETLKVQLRTAFRGKYILSGGYDAARTNADLAANKGDLVAFGRPFIANPDLAQKLKSGGELKPADPATFYTPDAKGYTEF

SEQ ID NO: 20837 - protein, 486 aa, Pseudomonas putida
MKEIKHFINGAFVGSASGRTFEDINPVNGQVIGRVHEAGRAEVDAAVKAARAALKGPWGKMTVAERADILHRVADGITARFDEFLEAECLDTGKPKSLASHIDIPRGAANFKVFADLLKNVANEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHSDVDAYTFTGETGTGETIMRAAAKGVRQVSLELGGKNAGIVFADCDMDKAIEGTLRSAFANCGQVCLGTERLYIERPIFDAFVARLKAGAESLVIGPPDDASSNFGPLVSLKHREKVLSYYQQAVDDGATVVTGGGVPEMPAHLAGGAWVQPTIWTGLSDNSAVVTEEIFGPCCHIRPFDTEEEAIELANSLPYGLASAIWTESSSRAHRVAGQIEAGIVWVNSWFLRDLRTAFGGSKQSGIGREGGVHSLEFYTELKNICVKL

SEQ ID NO: 20838 - protein, 501 aa, Oryza sativa (japonica cultivar-group)
MEINSEATVTLVSVVTLPILLALLTRKSSSKKRRPPGPWNLPLVGGLLHLLRSQPQVALRDLAGKYGPVMFLRTGQVDTVVISSPAAAQEVLRDKDVTFASRPSLLVSEIFCYGNLDIGFAPYGAYWRMLRKLCTVELLSTKMVRQLAPIRDGETLALVRNIEAAAGGKKPFTLATLLISCTNTFTAKAAFGQACGGELQEQFLTALDEALKFSNGFCFGDLFPSLRFIDAMTGLRSRLERLRLQLDTVFDKIVAQCESNPGDSLVNVLLRIKDQGELDFPFSSTHVKAIILDMFTGGTETTSSTTEWLMSELMRNPEVMAKVQAEVRGVFDNKSPQDHEGLLENLSYMKLVIKETLRLNPVLPLLLPHLCRETCEIGGYEIVEGTRVLINSWAMARSPEYWDDAEKFIPERFEDGTADFKGSRFEYLPFGTGRRRCPGDIFAMATLELIVARLLYYFDWSLPDGMQPGDIDMELVVGATARRKNHLQLVASPYKPISMQS

SEQ ID NO: 20839 - protein, 216 aa, Coxiella burnetii
MDGRVKTLHPKIHAGLLARRGIDEKTLDQHAIKPIDLLVVNLYPFVQTVSASNCSLEKAVEQIDIGGPSMLRAAAKNFAAVTVVVDPEDYSRILEEIKTHHGSTTLSTRKRLAQKTFEHLSYYDAHIATYLAEKEGATTLPARLPSIFKKKIDLRYGENPHQTAALYSIDPPLSHSLAEAQLLQGKPLSFNNLLDSDCAYRAFYEGSFVLNPPVSL

SEQ ID NO: 20840 - protein, 360 aa, Oryza sativa (japonica cultivar-group)
MSAVERKTACVTGGNGYIASALIKMLLEKGYAVNTTVRNPDDMAKNSHLKDLQALGPLKVFRADMDEEGSFDDAIAGCDYAFLVAAPMNFNSENPEKDLVEAAVNGTLNAMRSCAKVGTVKRVIITSSDAAISRRPLQGDGYVLDEESWSDVDYLRTEKPPAWYKIKGGKIVFPYYWMRAYSVSKVLLEKAACKFAEENNMSLVTVFPVFTLGAAPAPVARTSVPGILSLLSGDETHLEVLKPLQWVTGSVSIVHVDDLCRAEIFLAEKESSSLSSAESSARYICCSFNTTVLALARFMAGRYPQYNVKTDRFDGMPEKPRVCCSSEKLIREGFEFKYTNMGDILDDLVEYGRALGILPH

SEQ ID NO: 20841 - protein, 228 aa, Oryza sativa (japonica cultivar-group)
MGALQDQPPPFEDQSSSSRSFTGTGRLLSGETAPAAPPPPGNVLHNIQFWNNGFTVDDGPLRDYDDPANADFIESIKKSQCPQELEPADRRTPVHVNVIKRLEDYQAPLRPPSPFQGVGRTLGGGSSAEESQAPAPATQEPRRSVGIVVDDSLPFTSIQLRLADGTRMVARFNMHHTVGDIRSFIDASRPGATRPYQLQTGFPPKQLADPAQTVEQAGLANSVIIQKM

SEQ ID NO: 20842 - protein, 479 aa, Pseudomonas aeruginosa
MLIPVVLSGGAGTRLWPVSREGQPKPFMRLPDGQTLLGKTYRRAAGLLAGHGEIVTVTNREHYFQSKDQFHAARLGRHRGHFILEPTGRNTAPAIAVAALGLQAEHGDAAVLVVMPADHLIRNEEAFREAVGHAARLAVAGHLVTFGVVPDAAETGFGYIELGDRLDEQGAAKVRRFVEKPDEETRRRYVESGGFLWNSGMFCFTASTLVDELAQHAPALLEQARACLAASAAVKMADGIQHELAGEGFAALPDISIDYALMERSARVAVVPAAFDWSDIGSWGAMSALLDADAEGNRGSGDTLFVDTRNTFVQSDGRLVATVGVDDLVVVDTSDALLIARADRVQEVRRVVQRLKDERHEAYRLHRTVNRPWGSYTVLEEGPRFKIKRIVVRPGERLSLQMHHHRSEHWIVVQGMARVTNGDGARLVNSNESTYIPAGHRHRLENPGVIDLVMIEVQSGEYLGEDDIVRFEDQYGRVV

SEQ ID NO: 20843 - protein, 248 aa, Vernicia fordii
MARIAFGRFDDSFSLGSFKAYLAEFISTLLYVFAGVGSAIAYNKLTANAALDPAGLVAIAICHGFALFVAVAVGANISGGHVNPAVAFGLALGGQITILTGIFYWIAQLLGSIVACFLLKLVTGGLAIPTHSVAGRVGAIEGVVMEIIITFALVYTVYATAADPKKGSLGTIAPIAIGFIVGANILAAGPFSGGSMYPARSFGPAVVSGDFHDNWIYWVGPLIGGGLAGLIYGNLYISGDHTPLSNDF

SEQ ID NO: 20844 - protein, 467 aa, Pennantia corymbosa
ASVGFKAGVKDYKLTYYTPDYETKDTDILAAFRVTPQPGVPPEEAGAAVAAESSTGTWTTVWTDGLTNLDRYKGRCYHIEPVAGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFEAMDTI

SEQ ID NO: 20845 - protein, 467 aa, Pennantia cunninghamii
ASVGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEDMMKRAVFARELGAPIVMHDYLTGGFTANTTLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFEAMDTI

SEQ ID NO: 20846 - protein, 341 aa, Cupriavidus necator
MAQTMRAMIFEGAGLPLRLQDVPVPDPGPGEVCIAAAACEVCHTDLHIADGDLSHPKPALIPGHEAVGQVESCGTGVTAFSPGERVGVPWLGNTCGDCRYCMHLHGNLCDAPQLTGYTRDGGYAEYVVADSSYYFRIPPAYDDEHAEPLLCAGLIDYRTLRMAGEAQRIGIYGFGAAAHLVTQIAAAQGREVYGFTRAGDTGAQQLAYETGACWAGSSDLQSPVALDAALIFAPVGALVPCALRAVDKGERCRLRRHPHERHPAHALPAAMGRASPVFGRQPHARRRNCVDADRRPDAAADAHDRLPARAGQCGTGRSARGASVRCRRPENPSLRLRQISP

SEQ ID NO: 20847 - protein, 427 aa, Cupriavidus necator
MLTWYKTGTPQQKKTFWACYSGWALDSFDMQMFSFLLPALTLAWGLNKAEVGVLGTVALIVTAIGGWGAGILSDRYGRARILVFAIVWFTFFGVLAGFAQTYHQLLMARTLQGLGFGGEWAVGAALMAEVIDPKHRGKAMGYVQSGFALGWALAAVVATLLLAWLPQDMAWRAAFWIGIIPASIVLFIRRHIKDAPMFERARQSSAPRASLASVFNRRYARSLILSSVLVIGLQAGCYAILVWLPSLLSQREVAATSRIVTVFIMAFGSFCGFAVAADLCDRIGRRPTLIMLSICAWIVTVSYMLLPLNPTLTAILGFLVGFSAIGMFAALGPFLSELFPTNVRTTCMGFAYNVGKSVGAGSVVGVGVLSTHIGLANAMGAFCLAAYAFAVFGMLLLPETRGIVIENIGTEDDGDTVTIANPARAPS

SEQ ID NO: 20848 - protein, 232 aa, Cupriavidus necator
MIDKLYRTAREAMDDVPDGATIAIGGFGGAGMPDELIDALIEQGAKDLTVVSNNAGNGDTGLAALLKARRVRKLVCSFPRQRDAYVFEELYRAGQIELEVVPQGTLAERLRAAGSGIGAFYTPTGYGTLLAEGKETRQIDGRGYVLEYPLPVDVALINAAAADRWGNLIYNKTARNFAPVMAMAASQTIAAVARVCELGELDPEDVVTPGIFVSRVVLRDGAVAQAEVMQAG

SEQ ID NO: 20849 - protein, 511 aa, Cupriavidus necator
MVASLQYGEARFDGAEIERRAAQVAGGLAALGVGEDDVVAIVLRNAPALFEITLACNRVGAYHCPVDWRFTVDELGYILQDSGACVLFIEADLLATLRAAIPEGVRVLAVTPEPLALQAYPTSRVTGEVPADVLRYEAWRSAQAAYSGPSHRPRGRFAYTSGTTGRPKGVRRLAQGLHPEQPRLLRDTVKAVFDFSADARVYLSAPLYHGAPNLYGMQAMLATGLVVLDPRFDAEATLRAIERHRITHLYLVPTMCVRLLALPQHVRNRYDLSSVRFVACTGAPFAVAIKQAMINWWGPVINESYACSEMGMITVISSADAIRKPGSVGRPVSEAEVRIYSDAGCRLGTGGVGNIHVRQPAYADFTYHNRPEARAAMDCEGLACVGDMGYVDADGFLFICDRKADMVISGGVNIYPAEIEDALSGMPGVADCAAFGVPHEEFGEMVVAVVQPSDGTGLDPEEMRAWLKDRLAAYKVPKVIELRTELPRQESGKIHKRKLRDGYWQHAGRRI

SEQ ID NO: 20850 - protein, 412 aa, Cupriavidus necator
MMSLSHASVPHTNPTAPHTLAALLAAGGLAGKRVFIRADLNVPQDAAGDITDDTRIRASVPAIAACLQAGAAVMVTSHLGRPQEGAPDPRHSLAPVGRRLSELLGRQVPLLSGWTEGGFQVPPGQVVLLENCRMNTGEKKNSDELAQKMAALCDVYVNDAFGTAHRAEATTHGIARYAPVACAGPLLAAEIDALGKALGQPARPLVAIVAGSKVSTKLTILKSLADKVDNLVVGGGIANTFMLAAGLKIGKSLAEPDLLADARAIIDIMAARGASVPIPVDVVCAKEFSATAAAAVKDVRDVADDDMILDIGPKTAAMLADQLKAAGTIVWNGPVGVFEFDQFGNGTRVLAQAIAESKAFSIAGGGDTLAAIAKYGIADRVGYISTGGGAFLEFLEGKKLPALDVLEQRAAS

SEQ ID NO: 20851 - protein, 241 aa, Cupriavidus necator
MHATEPNTGHGSQRAIRLAPSILSADFARLGEEVCAIEAGGADLVHFDVMDNHYVSNLTIGPLVCEAIRPLVSIPIDVHLMVEPVDALIPMFAKAGANLISFHPEASRHVDRTIGLIRDHGCKAGLVLNPATPLSWLDHTLDKLDLVLLMSVNPGFGGQAFIPGVLDKVRQARARIDRQVAAGGRPVWLEIDGGVKADNITEIARAGADTFVAGSAVFGAPDADGGYRGILHRLREAATIT

SEQ ID NO: 20852 - protein, 266 aa, Vitis vinifera
EKEQPAITTFHGYIPQVPTIDLSDPDEEKLTRLIVEASSEWGMFQIVNHGIPSDVISNLQKVGKEFFELPQEEKELYAKSPDSKSIQGYGSKLQKEVEGKKAWVDHLFHNIWPPPAIDYQFWPKKPPTYRAANEEYAKWLQGVADKLFGRLSLGLGLGEGTLKESVGGDELLYLLKINYYPPCPRPDLALGVVAHTDMSAITILIPNEVQGLQVFRDDHWFDVKYISNALVIHVGDQLEILSNGKYKAVLHRTTVNKEKTRMSWPV

SEQ ID NO: 20853 - protein, 461 aa, Sorghum bicolor
MDERRTILMDRYEIGRQLGQGNFAKVYFARNLTDGQSVAIKMIDKDKITRVGLIVQIKREISIMRLVKHPNVLQLFEVMASKSKIYFVLEYAKGGELFNKISKGKFSEDVARRYFHQLISAVDYCHSRGVYHRDLKPENLLLDENENLKVSDFGLSALAESKRHDGLLHTTCGTPAYVAPEVLSRRGYDGTKADIWSCGVILFVLVAGYLPFHDPNLIEMYRKISKAEYRCPRSFSGELKDLLFRMLDPDPSTRISISRIKRSTWYRKPIEVNSAKIKHDTTRDKVCNGEATTSNSIECSNSEETRGSSSLPNLNAFDIISLSTGFDLSNLFEEKYGRREERFTTRQPAGTVFAKLNELAERLKLKIKKKENGVLKLASPKEGIKGFLELDAEIFELAPSFLLVELKKTNGDTIEYQRLVKEEIRPALKDMVWAWQSDRHQQRNESVQGEQQLSSPLPPQQ

SEQ ID NO: 20854 - protein, 273 aa, Pyrococcus horikoshii OT3
MRDVKLIGSDEVTAIGMGTWGIGGYEVPDYSRDRESIEVLRYGLELGINLIDTAEFYGAGHSEELVGKAIEGFNREEIFIISKVWPSHFGYEKAKKAAKASAKRLGTYIDLYLLHWPGDSWGKIEETLHALEDLVDEGLIRYIGVSNFDLELLKRSQEAMRRYEIVANEVKYSIRDRWPETSGLLDYMKREKIALIAYTPLEKGTLARDPCLTEIGRAYGKTAAQVALNYLIWEDNVIAIPKAGRKDHVDENFGAMGWRLSREDREKARRCFS

SEQ ID NO: 20855 - protein, 227 aa, Pyrococcus horikoshii OT3
MVEVKKHKFPGVYTVIDDDGSERIATKNLVPGQRVYGERVIKWEGEEYRIWNPNRSKLGAAIMNGLKNFPIKPGKSVLYLGIASGTTASHVSDIVGWEGKIFGIEFSPRVLRELVPIVEERRNIVPILGDATKPEEYRALVPKVDVIFEDVAQPTQAKILIDNAEVYLKRGGYGMIAVKSRSIDVTKEPEQVFREVERELSEYFEVIERLNLEPYEKDHALFVVRKT

SEQ ID NO: 20856 - protein, 404 aa, Pyrococcus horikoshii OT3
MMMMRAFIAENVRGIYAFDEDGKLVGKRYFTDKPEKILDGLLKGELVKDLEEFLNELREKGYDEFIFEHPELSRKAKELGFNATTEFPNLAGERLRSNPEEFLGENWFDDYYNVGVALTRMRIQEQSGARDKMVIQAIEALDDVDKVINLLVSRLREWYSLHFPELDEILPRHPQYVAFVKAIGHRDNVDEEKLRELGLSDEKIKKIIEAKEKTMGAWMDETDIAIVQHFAEEIDRLYKLRKELEDYIDKAMDDVAPNLKALVGAKLGARLISLAGGLKELAMLPSSTIQVLGAEKALFRHLRTGAKPPKHGVIYQYPAINRSPWWQRGKIARALAGKLAIAARVDYFSGEYIAEELKKELEARIKEIKEKYPRPPKRRKEERKGRKPWKEKKKKKKKKKGGRR

SEQ ID NO: 20857 - protein, 328 aa, Pyrococcus horikoshii OT3
MVNMHPKIFALLAKFPRVELIPWETPIQYLPNISREIGADVYIKRDDLTGLGIGGNKIRKLEYLLGDALSKGADVVITVGAVHSNHAFVTGLAAKKLGLDAILVLRGKEELKGNYLLDKIMGIETRVYDAKDSFELMKYAEEIAEELKREGRKPYVIPPGGASPIGTLGYVRAVGEIATQSEVKFDSIVVAAGSGGTLAGLSLGLSILNEDIRPVGIAVGRFGEVMTSKLDNLIKEAAELLGVKVEVRPELYDYSFGEYGKITGEVAQIIRKVGTREGIILDPVYTGKAFYGLVDLARKGELGEKILFIHTGGISGTFHYGDKLLSLL

SEQ ID NO: 20858 - protein, 283 aa, Pyrococcus horikoshii OT3
MLLYTYRSFDMELPTVDIKDADYIILGLPFDGTTSYKPGARFGPVLIRQATLNLESYILDYDIDIAELKIADAGDVALPVSIEDAIKVAVETIKEVRSINPRALPIFLGGEHSMTYPPVKVLEPKSYVVFDAHLDLRDSYQGSRFNHACVARRIHEMGVKVAIFGVRSGTREEVMFASQSGIEWVHARDYNFDAFVDLVSSLPEPVYVSIDVDVFDLPLVPETGTPEPGGLGFWEVIEALEWLTKRKKVAGFDIMEVSGDRLGNSTSITAAKLLFYVIGMSAR

SEQ ID NO: 20859 - protein, 466 aa, Pyrococcus horikoshii OT3
MVSMTKWDEIRKYTSKKIEKNLEIVKLDEKYIPRASGFKYYPMVIERSSGSRIWDKDGNEYIDFLTSAAVFNVGHTHPGVVKAVEEQIKKFFNYTMGYLYVEPPVRLAELLVEITPGNFEKKVTYGFSGSDAVDSSIKAARAYTKRVNIISFLHSYHGMTYGALSATGILDPKLKKLLHPMGNFHHVEFPDPYRNSWGIDGYEDPSELANRALDEIERKIKELNEDVAGIIIEPIQGDAGVVIPPEEFVRDLKKLTEEYGIVFIDEEVQTGMGRTGRWWGIEHFGVTPDLIVSAKALGGGMPISAVVGKAEIMDSVPVPFFVFTHIGHAVNASAAIATINVIKEEKLVERSEKLGEYMLKRLRELQETYPIIGDVRGKGLLIGVDIVKEGTREPDRSLAQKISWRAWEKGLIMITFGKHGNVLRIAPPLNIPQEDLDKGVEIIEESIKDAVEGKIPDEVLKFLRAW

SEQ ID NO: 20860 - protein, 280 aa, Pyrococcus horikoshii OT3
MRDMEFIEWYPRGYGVAFKVKRKILEEQSEYQKIEVYETEGFGKLLAIDGTVQLVTEGEKSYHEPLVHPAMLAHPNPRRVLIIGGGDGGAIREVLKHEEVEEVIMVEIDKKVIEISAKYIGIDGGILEKMLSDKHEKGKLIIGDGVKFIEENSGFDVIIVDSTDPVGPAEMLFSEEFYKNAYRALNDPGIYVTQAGSVYLFTDEFLTAYRKMRKVFDKVYYYSFPVIGYASPWAFLVGVKGSIDFMKVDAEKGKKLGLEYYDPDKHETLFQMPRYIVQML

SEQ ID NO: 20861 - protein, 443 aa, Pyrococcus horikoshii OT3
MVRKVNIIKGNEGQGKRIKFVQLIFVDINGMPKGMEVPITRLEEAIEEGIAFDGSSVPGFQGIEDSDLVFKADPSTYVEVPWDNVARVYGYIYKDGKPYEADPRGVLRRTLERLEKLGIKVYIGPEPEFYLFKKNGSWELEIPDVGGYFDILTLDKAKDIKREIAEYMPYFGLTPEVLHHEVGKAQHEIDFRHDEALKTADNIVSFKYIVKAVAEMHGLYATFMPKPIYGMPGNGMHLHISLWKDGENIFKGEEGLSETALYFIGGLLKHAKALAAVTNPTVNSYKRLVPGYEAPVYISWGYKNRSALIRVPAFWGNGARIEYRCPDPSANSYLAFAAILMAGLDGIKHKIEPFAYVEENVYEMDEKRREEIGIDMLPENLGEALDELERDKVVKEALGGAYRNFVGYKRKEWEEYLDYLEAKNLPKDTKNVTEWELERYFFI

SEQ ID NO: 20862 - protein, 423 aa, Pyrococcus horikoshii OT3
MPLKFPEMFLFGTATSSHQIEGNNRWNDWWYYEQIGKLPYRSGKACNHWELYRDDIQLMTSLGYNAYRFSIEWSRLFPEENKFNEDAFMKYREIIDLLLTRGITPLVTLHHFTSPLWFMKKGGFLREENLKHWEKYIEKVAELLEKVKLVATFNEPMVYVMMGYLTAYWPPFIRSPFKAFKVAANLLKAHAIAYELLHGKFKVGIVKNIPIILPASDKERDRKAAEKADNLFNWHFLDAIWSGKYRGVFKTYRIPQSDADFIGVNYYTASEVRHTWNPLKFFFEVKLADISERKTQMGWSVYPKGIYMALKKASRYGRPLYITENGIATLDDEWRVEFIIQHLQYVHKAIEDGLDVRGYFYWSFMDNYEWKEGFGPRFGLVEVDYQTFERRPRKSAYVYGEIARSKEIKDELLKRYGLPELQL

SEQ ID NO: 20863 - protein, 457 aa, Pyrococcus horikoshii OT3
MHSKQSTNIGGMKMGNFRRKISIILLVLMATFLMADQNLLPPNYQQIMKEFGIGETQMGFVSSIFVATSALITIIWGMLADIKQRKKLLVIGVLLGEIPCFLTAYVHSYWQLLTMRFLTGIGIGSIIPIGYSLIADMFEEEKRGRGYSYIETAFGFGTLFGMIIAGVITSWRTPFIIAAVPNFILAPLFYIIAEEPRRGEGEREIRVLIEKGYEYAYKLSLEAVKKSLKTRTNILIFLQGIIGTVPWGILMYWLISFLQVTRGMDKQTATFMLLIIGIASVLGSLFGGFVGDYFETRKRGGRAVITGIAIFLGMIAAIGLILYPLPSKLNTIHWLGLTVYSILFIQFVSYAGPNVRAIVSQVNLPEDRGTVFGLFNILDNVGKAIGPVLGGFLIETLVQMGYTKPLAYQYTLLIGTLFWVPCALVWIWIRRSYPEDRDKVKEILKMRAEEILKLKFW

SEQ ID NO: 20864 - protein, 325 aa, Pyrococcus horikoshii OT3
MKTLIEIKQTPDGIIKADKVFNKVKDKISLPNRILYLGCGSSHFLSKLLAMVTNMHGGLGIALPCSEFLYSKETYPIGEVELAVGISRSGETTEILLALEKINVKKLGITTRESSLTRMCDYSLVVPAIEESVVMTHSFTSFYFAYLQLLRYSYGLPPLNAGEISKATEKSLEYERYIREIVESFDFQNIIFLGSGLLYPVALEASLKMKEMSIFWSEAYPTFEVRHGFKAIADEKTLVVLMVEEPFEWHEKLVKEFKNQGAKVLVISNSPQDLGQDYSIELPRLSKDANPIPYLPIVQLLSYYKAVSRGLNPDNPRFLDKVVRW

SEQ ID NO: 20865 - protein, 478 aa, Pyrococcus horikoshii OT3
MRRMKLPSHKTKIVATIGPATNSKKMIKKLIEAGMNVARINFSHGTFEEHAKIIEMVREQSQKLDRRVAILADLPGLKIRVGEIKGGYVELERGEKVTLTTKDIEGDETTIPVEYKDFPKLVSKGDVIYLSDGYIVLRVEDVKENEVEAVVISGGKLFSRKGINIPKAYLPVEAITPRDIEIMKFAIEHGVDAIGLSFVGNVYDVLKAKSFLERNGAGDTFVIAKIERPDAVRNFNEILNAADGIMIARGDLGVEMPIEQLPILQKRLIRKANMEGKPVITATQMLVSMTMEKVPTRAEVTDVANAILDGTDAVMLSEETAVGKFPIEAVEMMARIAKVTEEYRESFGITRMREFLEGTKRGTIKEAITRSIIDAICTIGIKFILTPTKTGRTARLISRFKPKQWILAFSTREKVCNNLMFSYGVYPFCMEEGFNENDIVRLIKGLGLVGSDDIVLMTEGKPIEKTVGTNSIKIFQIA

SEQ ID NO: 20866 - protein, 474 aa, Pyrococcus horikoshii OT3
MPFLPFSYYPFSLEVILMEYPKIVVKPPGPRAKELIEREKKVLSTGIGVKLFPLVPKRGFGPFIEDVDGNVFIDFLAGAAAASTGYAHPKLVKAVKEQVELIQHSMIGYTHSERAIRVAEKLVEISPIENSKVIFGLSGSDAVDMAIKVSKFSTRRPWILAFIGAYHGQTLGATSVASFQVSQKRGYSPLMPNVFWIPYPNPFRNIWGINGYEEPDELINRVLDYLEYYVFSHVVPPDEVAALFAEPIQGDAGIVVPPENFFKELKKLLEEYGILLVMDEVQTGIGRTGKWFASEWFNVKPDMIIFGKGVASGMGLSGVIGRKEIMDITSGSALLTPAANPVISAAAEATLEIIEEENLLKNALEVGEFIMGRLKEIKERFEIIGDVRGKGLMIGVEIVKENGRPDPEMTGKICWRAFELGLILPSYGMFGNVIRITPPLVLTKEVAEKALEIIERAIKDTLTGKVERKVVTWH

SEQ ID NO: 20867 - protein, 472 aa, Pyrococcus horikoshii OT3
MPKLIKERVPTPERPVEERIKDFKEVNLGYTFELAKKEAERCLQCPPEYAPCIKGCPVHINIPAFIAKIKEGDIKGALRIIWNDNTLPAITGRVCPQEDQCEGACVVGKVGDPVNIGKLERFVADYAREHGIEEELLREFTEKCDGSKGKVAVVGAGPAGLTCAGELAKMGYKVTIFEALHKPGGVLAYGIPEFRLPKEILDHELKKLKMLGVEIRTDHVVGKTVTLDELLQEYDAVFIGTGAGTPKLLNIPGILLDRIYSANEFLTRINLMKAYEFPEYDTPIAVGKKVIVIGAGNTAMDAARSALRLGAEVTIAYRRGREDMTAREEEIKHAEEEGVKFEFFLQPVEFIGDENGRVKAVKFERTKPLEERDSKGKRKIVGTGEYVTLEADTVIIAIGLEPNKIITEDGRLKTNPDGTIVVDENLMTSIPGVFAGGDAIRGEATVILAMGDGKRAAKAIDEYIRRKRGQNS

SEQ ID NO: 20868 - protein, 397 aa, Pyrococcus horikoshii OT3
MRHVIIGAGGAGTAAAETIRANSEDEIIVINREKTLPYSPAALPYYIEGSVRREKLFIWDWHFIRSNSIDYIMGREVKRVDTERKKVILDNGEEIEYDKLLISSGAKPRIVPQFDRENVIGVRTLEDAERLRKVKGRVIIIGAGPVAVETAIALKKIGADPIIICRSRILRRLFDEDISNIIRDVMILNGVKVLFEKSIEIIGDPAEGIKAPCGVIYGDLIVAALGVTPNLNFLDGKIKLGEHGGILTNEKMETNVKDVYAAGDCAETKDVISGRYGIFAIWPLAREQGRVAGYNMLGHEKHYRGSINMNIITIFDKVFASIGTFMGARKEIWHGSHIAKLFIENGRLNGAQLVGKYALQYAGTIEYLVRTRRPIRIDSISDTKTFIKEVWKAMKGS

SEQ ID NO: 20869 - protein, 455 aa, Pyrococcus horikoshii OT3
MGKLFGTFGVRGIANEKITPEFAMKIGMAFGTLLKREGRKKPLVVVGRDTRVSGEMLKEALISGLLSVGCDVIDVGIAPTPAVQWATKHFNADGGAVITASHNPPEYNGIKLLEPNGMGLKKEREAIVEELFFKEDFDRAKWYEIGEVRREDIIKPYIEAIKSKVDVEAIKKRKPFVVVDTSNGAGSLTLPYLLRELGCKVITVNAQPDGYFPARNPEPNEENLKEFMEIVKALGADFGVAQDGDADRAVFIDENGRFIQGDKTFALVADAVLKEKGGGLLVTTVATSNLLDDIAKKHGAKVMRTKVGDLIVARALYENNGTIGGEENGGVIFPEHVLGRDGAMTVAKVVEIFAKSGKKFSELIDELPKYYQIKTKRHVEGDRHAIVNKVAEMARERGYTVDTTDGAKIIFEDGWVLVRASGTEPIIRIFSEAKSKEKAQEYLNLGIELLEKALS

SEQ ID NO: 20870 - protein, 464 aa, Pyrococcus horikoshii OT3
MKALILAGGKGTRLWPLSREAMPKQFIKVFSDRSLFQKTVERALIFSKPKEIFVVTNKEYRFRVLDDLNELGLKVPEENILLEPVGKNTLPAIYWGLKVINDNYGDSVVAVLPSDHAIEVNESYMEAFKKAEKLAEKYLVTFGIKPTKPHTGYGYIKPGEKIEVEGKVLGYLVDEFKEKPDLETARKYVENGYYWNSGMFMFKVSVFMEEARKHSPDVVKAFEEGKSIEEIYELAPEISVDYGIMEKTNKAAVVPLNTYWNDLGSFDAVYEALEKDENGNAVHVTGFKAKYINVDSRNNLVLTERLTATVGVEDLVIIDTGDALLVAKRGETQKVKEVYKKLKEENDERAIVHRTAYRPWGSYTVLEEGERYKIKRLTVLPGKRLSLQIHYHRSEHWVVVRGTAKVKVGDKEFILRPGESTFIPAGVPHRLENPGKVILEVIETQIGEYLGEDDIVRLQDDYGR

SEQ ID NO: 20871 - protein, 371 aa, Pyrococcus horikoshii OT3
MARLKPLHEPLYLTAVFRQVGEAYLTPRNTELKYSREENPTVLNLENKLAKLEGADNALAFNSGIAAIATLYFSFLEAGDEAVLSMEGYGTTIELARLIGRRFGVKIRLAYPRAEDIVEEINERTKLVLIETMTNPTLKVIDVREVAKRCREVETILVVDNTFVTPLLYKPLKDGANFVVHSLTKYIAGHNDVLGGAILWNGEFIHDLWNWRRRLGGIIQPFDAWMIERGMRTLEVRFERQSKNAQAIAEFLSEHPKVKEVHYPGLEDDPYHEIAKKLFERDLYGGVVSFDVGNESNAIVFLRSIKKIFPSPSLGGVESIVTYPVKSAARYINEEQREALGITEGLIRLSVGLEPLDELLEDLDKALEVVK

SEQ ID NO: 20872 - protein, 220 aa, Pyrococcus horikoshii OT3
MNILIFGPPGSGKSTQARRITERYGLTYISSGDIIRAEISSRTPLGLEMEKYLSRGDLIPDTIVNTLIISKLRRVRENFIMDGYPRTPEQVIALENYLYDHGIKIDVAIDIFITKEESVRRISGRRICSKCGAVYHIEFNPPKIPGKCDICGGDLIQRPDDRPEIVEKRYDIYMRNMEPIIKFYQKQGIYVKIDGHGSINEVWERIRPLLDYIYNTRSRR

SEQ ID NO: 20873 - protein, 443 aa, Pyrococcus horikoshii OT3
MGWAERYFELDKYGTDVKTEVLAGLTTFMTMAYILLVNPIILSSAMGKEAFDSLVAATALSAGLTTILMGLYAKKPFALAPGMGLNAYFAYTVAPKYGWKVALAAVFVEGIIFIILSVTKVRSAIIHAIPLSQKYAVGAGIGLFLTFIGLNDVGLLTGVTSKEGILQFTGLNAKFLATAQGLLFVFGLLLAGILIGLRIKGALLISILTTSIIGWIFNVAPRPEGVVSLPTLSYTFLKLDLHGLLNAGALGVIFAFFMVDFFDTLGTVTGLSAKAGFLTKEGKIPDAEKVLLTDAIGTTLGALLGTSTVTTYIESAAGIEEGGRTGLTALTTGLLLLAVGLFIAPIAKAIPSFATAPALVIVGYYMISAIREVDFSDPTEAIPAFLVLITIPFTYSIADGIGVGFISYTLIKVFTGRWKEVHPLMYILALIFVGYFAYLAGVF

SEQ ID NO: 20874 - protein, 410 aa, Pyrococcus horikoshii OT3
MFRLEDFNFHNKTVFLRVDLNSPMKDGKIISDARFKAVLPTIRYLIESGAKVVIGTHQGKPYSEDYTTTEEHARVLSELLDQHVEYIEDIFGRYAREKIKELKSGEVAILENLRFSAEEVKNKPIEECEKTFLVKKLSKVIDYVVNDAFATAHRSQPSLVGFARIKPMIMGFLMEKEIEALMRAYYSKDSPKIYVLGGAKVEDSLKVVENVLRRERADLVLTGGLVANVFTLAKGFDLGRKNVEFMKKKGLLDYVKHAEEILDEFYPYIRTPVDFAVDYKGERVEIDLLSENRGLLHQYQIMDIGKRTAEKYREILMKARIIVANGPMGVFEREEFAIGTVEVFKAIADSPAFSVLGGGHSIASIQKYGITGITHISTGGGAMLSFFAGEELPVLRALQISYEKFKEVVK

SEQ ID NO: 20875 - protein, 335 aa, Pyrococcus horikoshii OT3
MIGEIYYSRKFLLHKPKNYHPENPGRLWIILTAIRELGLENQIVEPLPIDEAQIYKIHDPEYVKRIRGLSLNGGGYLDADTYVNQRTWEVAMLALGASRLATLSALEYGGLNMALVRPPGHHAGRRGRALGAPTLGFCIFNNSAMAALTCKEETGEALIIDFDAHHGNGTQEIFWNDPEVVHVDLHERDIYPGSGDVNEIGGYNARGSKINIPMPHYSDDGDYIYAWNEIVLPIVERVKPKVIIVSAGFDGFKGDGLTTLKLTEIFYSYAGVTLRKYPLVLILEGGYSSGLKRGFPAFIMGYEEDKIKRDEGQPSYETLKVVEEVKDILSPWWPL

SEQ ID NO: 20876 - protein, 330 aa, Pyrococcus horikoshii OT3
MVSIELRDIIKRFGEFELKVSLSVKDGELLTLLGPSGCGKTTTLRIIAGLEKPDKGRVYFDGRDITDLPPYERNIGLVFQDYALFPHMTVFKNVAFGLEVRRVPRMEIEKRVREVLDLVGLRGFENRLPEELSGGQQQRVALARALVIEPDVLLLDEPLSNLDAKVREKLRGEIKRIVKELGITTIYVTHDQEEAMVLSDRIAVMNFGRIEQVGEPYDLYYNPKNEFVANFLGISNIVELEAKEGRACLGDLCFEVGREGKGKIFFRPENVAVGEGIEAEVIGYELLPGRVRLRLSIEGREIIAEELLSRIGKKIPKKVRIRVREFKILP

SEQ ID NO: 20877 - protein, 454 aa, Pyrococcus horikoshii OT3
MELKPNVKEIPGPKARKVIEEHHKYMATTTNDPNEYFLVIERAEGVYWIDVDGNVLLDFSSGIGVMNVGLRNPKVIEAIKKQLDLVLHAAGTDYYNPYQVELAKKLVEIAPGDIERKVFLSNSGTEANEAALKIAKWSTNRKMFIAFIGAFHGRTHGTMSLTASKPVQRSRMFPTMPGVVHVPYPNPYRNPWGIDGYENPDELINRVIDYIEEYLFEHYVPAEEVAGIFFEPIQGEGGYVVPPKNFFKELKKLADKHGILLIDDEVQMGMGRTGRMWAIEHFDIVPDIVTVAKALGGGIPIGATIFRADLDFGVSGVHSNTFGGNTVAAAAALAVIEELQNGLIENAQKLEPLFRERLEEMKEKYEIIGDVRGLGLAWGVEFVKDRKTKEYATKERGEIVVEALKRGLALLGCGKSAIRLIPPLIISEEEAKMGLDIFEEAIKVVSERHGYKIH

SEQ ID NO: 20878 - protein, 310 aa, Pyrococcus horikoshii OT3
MNLVFGMIASIGELLIDLISVEEGDLKDVRLFEKHPGGAPANVAVGVSRLGVKSSLISKVGNDPFGEYLIEELSKENVDTRGIVKDEKKHTGIVFVQLKGASPSFLLYDDVAYFNMTLNDINWDIVEEAKIVNFGSVILARNPSRETVMKVIKKIKGSSLIAFDVNLRLDLWRGQEEEMIKVLEESIKLADIVKASEEEVLYLENQGVEVKGSMLTAITLGPKGCRLIKNETVVDVPSYNVNPLDTTGAGDAFMAALLVGILKLKGLDLLKLGKFANLVAALSTQKRGAWSTPRKDELLKYKEAREVLAP

SEQ ID NO: 20879 - protein, 438 aa, Pyrococcus horikoshii OT3
MLILNNMKANDIIKRYSKVIAQANKMHYFPLVPVKAENAKVWDINGKEYIDFLSDAAVQNVGHNNPRVVKAVKEQVDKLMHASYIYAYPIEPLLLAEKLAEIAPIDNPKVSFGLTGGDANDAAIKFARAYTKRQTILSYMKSFYGSTYGAMSLTGLDFRVRAIVGELSGVHYLPYPYCYRCPFGKEPGSCKMECVEYIKEKFEGEVYAEGVAALFAEPIQGDSGIVVPPKNYFKKVTKILREHGILLVVDEIQSGMGRTGKWFAIEHFGVKPDIITVGKALGGGLPISATIGKAEIMDSLPPLSHAFTLSGNPTTSRAALAVIEEIEEKNLLRRAEKLGNYAMKRLREMMDKHELIGDVRGIGLMIGVELVKDRETKERAIEETSKVIERAFDLGLIVTHFSGNVLRIEPPLTIERETLDEGLDVLEKAIEDVEEGRV

SEQ ID NO: 20880 - protein, 440 aa, Pyrococcus horikoshii OT3
MKIVVIGSGTAGSNFALFMRKLDRKAEIIVIGKEPTMQYSPCALPHVISGTIEKPEDVIVFPNEFYEKQRIKMMLGVEAKKIDRERKVIITDKGEVPYDKLVLATGSRAFIPPIKGVENEGVFTLKSLDDVRRIKEYISKRKPKKVVVIGAGLIGLEGAEAFAKIGMDVLVVELLEHLLPTMLDKDMAKIVQEEMEKHGVKFKFGVGVSEIIGNPVKEVKIGEESVEADLVLVATGVRANVDLAKDAGLEVSRGIVVNEYLQTSDPDIYAIGDCAEVFDAVTGKRTLSQLGTSAVRMAKVAAENIAGKKVKFRPVFNTAITELFDLEIGTFGITEERAKKEGIEVVIGKFKGSTKPEYYPGGKPITVKLIFRKEDKRLIGAQIVGGERVWGRIMTLSALAQKGATVEDVAYLETSYAPPISPTIDPITVAAEMAMRKFKS

SEQ ID NO: 20881 - protein, 341 aa, Pyrococcus horikoshii OT3
MSVIQNIIGRIAVLRGGKYSVEVDVATDEGFGRFTSPIDDNPMLHIAEARRAVSEVDEIIGPELIGFDASEQELIDSYLWEIDGTEDFSHIGANTALAVSTAIAKAAANSRDMPLYSYIGGTFATELPVPVLSFAQDDMFDYYLVVKDLLEVTDIIDATNKIREIVKEINLENLSKASEDVGVELGLEVALGIGMKKEMDIEKVLNLVEDYNVAYIKPIGPPELFLELIAGTHGVFIDGEYLFRTNSVLDRRYYNALSIKPINLGTLTDLYNFVNDVKAEKITPILAEAKYEPADETFPHIALGLRCPAMLISWSSIEKINELNRIAEELGERGRIITFEE

SEQ ID NO: 20882 - protein, 366 aa, Pyrococcus horikoshii OT3
MSLYRKRLKIIKGEGIYVWDDQGRRYVDLIAGIGVAILGHNHPEWVEGIREQLNKLVIAGPMFNHEEKEEMLEELSKFVNFEYLYMGNSGTEAVEAALKFARLYTGRKEIIAMVNAFHGRTMGALSATWKPKYKKDFEPLVPGFKHIPFNDVEAAKEAISKETAAVIVEPIQGESGVIPAKKEFMKALRDLTEDVGALLIVDEVQTGLRTGKFLAVEHYKIEPDIVTMGKGIGNGIPVGLTLTNFDVERGKHGSTFGGNPLACKAVAITLRILRKERLIEKAKNKFIQIDADEVVTTRGKGLMIGIVFKTTIGKYVEELQNRGYLVHTAGQRVMRLLPPLIISKETMQDVKLAIEGVINDLRGGEN

SEQ ID NO: 20883 - protein, 392 aa, Pyrococcus horikoshii OT3
MRKMKRFYIASEEEIKTGKTTDIYFLRTRKILETKNIRKKVLADVTTTSLPENWKWGVLVGVEEVAKLLEGIPVNVYAMPEGTIFHPYEPVLQIEGDYADFGIYETALLGMLSQASGIATAALRIKIAAKFKPVYSFGIRHMHPAIAPMIDRAAFIGGCDGVSGVLGAEMMGEKAVGTMPHALIITVGDQVKAWKYFDEVIEKEVPRIALVDTFYDEKIEAVMAAEALGKKLSAVRLDTPSSRRGNFRRIIEEVKWELKIRGYDWVKILISGGLDEEKIKEIVDVADAFGVGSAIASAKPIDFALDIVEVEGKPIAKRGKLSGRKQVYRCENGHYHVVPADKKLERCPVCNAKVEPLLKPIIENGEIVVEFPKARDIREYVLEQAKKFNLEI

SEQ ID NO: 20884 - protein, 476 aa, Pyrococcus horikoshii OT3
MPKLIKERVPTPERPVEERIKDFDEVNLGYTWELALKEAERCLQCPVEYAPCIKGCPVNINIPGFIKALRENKDNPRKAVKEALRVIWACNSLPAITGRVCPQEDQCEGACVVGKVGDPVNIGKLERFVADYARQHGIDDELLMEEIKNIKKNGKKVAVIGAGPAGLTCAAELAKMGYDVTIYEALHEPGGVLAYGIPEFRLPKEILRKELKKLSILGVKIKTDHIVGRTVTIPELLKEYDAIFIGTGAGTPKLLKIPGINLNGIYSANEFLTRINLMKAYKFPEYDTPIIVGKRVIVIGAGNTAMDAARSALRLGAEVIIAYRRGEEDMTARIEEVQHAKEEGVKFMFFVNPVEFIGDENGRVKAVKFEKMKPLEERDSRGKRKIIGTGEYVTVETDTVVIAIGQTPNRIIWKTTPGLKVRENGTIVVDENLMTSIPGVFAGGDAIRGEATVILAMGDGRKAAKAIHEYLSKKSA

SEQ ID NO: 20885 - protein, 428 aa, Pyrococcus horikoshii OT3
MENPYEITAIVAREILDSRGNPTVEVDVHTPIAMGRAAVPSGASTGTHEAVELRDGGKRYHGKGVRRAVENVNKIIAPELIGMDVRWQREIDKLLIELDGTENKSNLGANAILAVSLAVAKAAANSLELPLYQYLGGVNAYVLPVPLSNVINGGVHAGNELDFQEFMIMPIGASSFREAIRWVSETYHVLKRVIMGKYGKNAVNVGDEGGFAPPMKEVTEPLDALIKAIEEAGYKPGDEIALAIDAASSEFFKDGKYIVGGKEYTREELLDLYKELVSTYPIVSIEDPFHEEDWEGFVMITNELGKKIQIVGDDLFVTNPRRLKKGIELGAANALLLKVNQIGTLTEAMDAAYTAFRAGYSVIVSHRSGETEDTTIADLAVALNAGQIKTGAPARSDRNAKYNQLIRIEEELEGIAVYAGKNFRKVFF

SEQ ID NO: 20886 - protein, 483 aa, Pyrococcus horikoshii OT3
MITMKIEDVYIWDINARWLGVTPYQLMENAGASVARVIEEKFGKNLKIAVFCGTGNNGGDGFVAARHLSYENDVTVFLIGEEVKIRSEEAKLNWNILKNLDFVKIKVLKDSSQIRELDLSEFDIIVDALLGAGTRGKPREPIKSAIEKINEYSGKVKIVSIDLPSGYPSEIRVKADFAVTFQWDKEEFKDFKRIIAKIGYPKELKYLVGPAHVKFAYKRKGEHKGQNGKLLIIGGSENYYGAPVLAASAAKHLVDLVFLLLPQNAARRVNDPDLIVREVDGLNFTPEHIKSALELVEKVDAIVIGPGIGVREETKEFVKGIIERVEKPIVVDADGLKIIAEFKDILKGKEIVLTPHAGEFKLLFGEKVPEDLVEKGKVVMRRAKEIGATILLKGKYDVISDGKVWLYNKTGNRGMTTGGTGDVLAGTVGAFLALGNKALKAAAAGAFLVGFAGDLVMEEKGEAFTARDVAEKIPIALKKIIEF

SEQ ID NO: 20887 - protein, 359 aa, Prunus armeniaca
ETTFPRLAEPLGYVPKEDILYAIKAIVVTQRENGRRDDRKYSRMKYLISSWGIEKFRSVVEQYYGKKFEQFRELPEWEFKSHLGWNKQGDGSYYCGLHVDNGRIGGVMKKALREVIEKYNLSIRLTPNQNIILCDIRTAWKRPITTILAKAGLLHPRFVDPLNLTAMACPAFPLCPLAITEAERGIPDILKRVRSVFEKVGLKYNESVVIRVTGCANGCARPYMAELGLVGDGPNSYQIWLGGTPNQTSIARSFMNKVKIQDLEKVLEPLFYYWRRKRQSKESFGGYTNRMGFEKLHELVDKWEGPKVAPARYNLKLFADKETYEAVDELAKQQDKTAHQLAMEVIRNFVGSQRNGKSE

SEQ ID NO: 20888 - protein, 262 aa, Prunus armeniaca
DVTAIHIPSINLEKAEIVVDVLIKNPNPVPIPLIDINYLIESDGRKLVSGLIPDAGTIHAHGEETVKVPVHLVYDDIKNTYDDIKPGSIIPYRFKVDLIVDVPVLGRLTLPLEKTGEIPIPYKPDVDVEKIKFQAFSFEETVAVLHVKLENMNDFDLGLNALDYEIWLSEVNIGGAQLSQSANLAKKGVTFIELPITFRPKDFGSALWDMIRGKGTGYTIKGNINVDTPFGAMKLPIVKEGGTTRLRKNKEDGGDDDDEDED

SEQ ID NO: 20889 - protein, 285 aa, Spinacia oleracea
MSAASLCQSTLQSQINGFCGGLNIRKLQPSTSSPNSLTFTRRKVQTLVKATSRVDKFSKSDIIVSPSILSANFAKLGEQVKAVELAGCDWIHVDVMDGRFVPNITIGPLVVDALRPVTDLPLDVHLMIVEPEQRVPDFIKAGADIVSVHCELASTIHLHRTVNQIKSLGAKAGVVLNPGTPLSTIEYVLDVVDLVLIMSVNPGFGGQSFIESQVKKISDLRKMCVEKGVNPWIEVDGGVTPANAYKVIEAGANALVAGSAVFGAKDYAEAIKGIKASKRPEPVAV

SEQ ID NO: 20890 - protein, 353 aa, Candida sp. HA167
MSTPENLSFVLQKPFDVKFEDRPIPKLSDPYSVKIQVKKTGICGSDVHYFTHGAIGDFVVKAPMVLGHESSGVVLEVGSEVKSLKVGDRVAMEPGVPSRHSDEYKSGRYNLCPHMAFAATPPYDGTLCKYYILPEDFCVKLPEHVSLEEGALVEPLSVAVHSSKLGNIKPGSHVAIYGAGPVGLLVAAVASAFGAESVTIIDLVESRLNLAKELGATATVQVDFKDTPKESAAKVVAANNGIAPDVVIDASGAEASINSAINAIRPGGTYVQVGMGKPDVSFPIATLIGKELTVKGSFRYGYGDYPLAVSLLASGKVNVKKLITHEVKFEDAAEAFQLVRDGKAIKCIINGPE

SEQ ID NO: 20891 - protein, 355 aa, Cryphonectria parasitica
MSRSQAPNPAGSRKISFNVSEQYDIKDVVGEGAYCVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASQEDKSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTLFPKTSELALDLLEKLLAFNPVKRITVEEALKHPYLEPYHDPDDEPTAPPIPEEFFDFDKHKENLSKEQLKQLIYQEIMR

SEQ ID NO: 20892 - protein, 328 aa, Lycopersicon hirsutum
MAVNGASSSGLIVSFGEMLIDFVPTVSGVSLAEAPGFLKAPGGAPANVAIAVTRLGGRSAFVGKLGDDEFGHMLAGILKTNGVQADGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILADEARLKEVLRFSCACGAITTTKKGAIPALPTASEALTLLKGGA

SEQ ID NO: 20893 - protein, 391 aa, Rhizopus niveus
MKFTLISSCVTLALMTLSIEAAPSGKKVNIPLTKNKDYKPNAKNAIQKAIAKYHRHRSVSSSNSTSTDGIGYVPVTDYYNDIEYYGEVTVGTPGVTLKLDFDTGSSDLWFASSLCTNCGSSQTKYNPNESSTYARDGRTWSISYGDGSSASGILGTDTVILGGLTIRHQTIELARREASQFQSGPSDGLLGLGFDSITTVRGVKTPVDNLISQGLISNPVFGVYLGKESNGGGGEYIFGGYDSSKFKGSLTTIPVDNSNGWYGITVRGTSIGGSRVSSSFDAILDTGTSLLVLPNDVASSVAEAYGASDNYDGTFSISCDTSSFEPLVFTIGSSTFEVPADSLVYEQDGYSCIAGFGYGDYDFAIFGDVFLKNNYVVFNPEVPHVQIAPIA

SEQ ID NO: 20894 - protein, 398 aa, Rhizopus niveus
MKFTLISSCVALACMALAVEAAPSGKKINVPLSKNANYKPNAKRAIEKANAKYARFRSSSSSSSSSSCGSAGTESSGSVPVTDDGNDIEYYGEVTVGTPGIKLKLDFDTGSSDLWFASTLCTNCGSSQTKYDPSQSSTYAKDGRTWSISYGDGSSASGILGKDTVNLGGLKIKNQIIELAKREASSFSSGPSDGLLGLGFDSITTVSGVQTPMDNLISQGLISNPVFGVYLGKESNGGGGEYIFGGYDSSKFSGDLTTIAVDNSNGWYGITIDGASISGSQVSDSFSAILDTGTTLLILPSNVASSVAQAYNANDNGDGTYNINCDTSELQPLVFTIGGSTFEVPTDSLIFEQDGNTCVAGFGYGQDDFAIFGDVFLKNNYVVFNPQVPQVQIAPISN

SEQ ID NO: 20895 - protein, 465 aa, Cycas circinalis
VGFKAGVKDYRLTYYTPEYQTKDTDILAAFRVTPQPGVPPEEAGAAVAAESSTGTWTTVWTDGLTSLDRYKGRCYDIEPVPGEKNQFIAYVAYPLDLFEEGSVTNMFTSIVGNVFGFKALRALRLEDLRVPPAYSKTFQGPPHGIQVERDKLNKYGRPLLGCTIKPKLGLSAKNYGRAVYECLRGGLDFTKDDENVNSQPFMRWRDRFCFCAEAIYKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHGGTVVGKLEGERDVTLGFVDLLRDDFIERDRSRGIYFTQDWVSMPGVLPVASGGIHVWHMPALTEIFGDDSVLQFGGGTLGHPWGNAPGAVANRVALEACVQARNEGRDLAREGNEVIREASKWSPELAAACEVWKEIKFEFEAMDVL

SEQ ID NO: 20896 - protein, 466 aa, Cycas revoluta
SVGFKAGVKDYRLTYYTPEYQTKDTDILAAFRVTPQPGVPPEEAGAAVAAESSTGTWTTVWTDGLTSLDRYKGRCYDIEPVPGEKNQFIAYVAYPLDLFEEGSVTNMFTSIVGNVFGFKALRALRLEDLRVPPAYSKTFQGPPHGIQVERDKLNKYGRPLLGCTIKPKLGLSAKNYGRAVYECLRGGLDFTKDDENVNSQPFMRWRDRFCFCAEAIYKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIERDRSRGIYFTQDWVSMPGVLPVASGGIHVWHMPALTEIFGDDSVLQFGGGTLGHPWGNAPGAVANRVALEACVQARNEGRDLAREGNEVIREASKWSPELAAACEVWKEIKFEFEAMDVL

SEQ ID NO: 20897 - protein, 475 aa, Begonia olbia
MSPQTETKASVGFKAGVKDYKLTYYTPDYQTKDTDILAAFRVSPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMNKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 20898 - protein, 475 aa, Begonia isoptera
MSPQTETKASVGFKAGVKDYKLTYYTPDYQTKDTDILAAFRVSPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPIAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMNKRAIFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 20899 - protein, 475 aa, Begonia diadema
MSPQTETKASVGFKAGVKDYKLTYYTPDYQTKDTDILAAFRVSPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPIAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMNKRAVFARELGVPIVMHDYLTGGFTANTSLAHYCRDNGLLLHIHRAMHAVIDRQNNHGIHFRVLAKALRMSGGDHIHAGTVVGKLEGEREITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 20900 - protein, 475 aa, Begonia nigritarum
MSPQTETKASVGFKAGVKDYKLTYYTPDYQTKDTDILAAFRVSPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPIAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMNKRAIFARELGVPIVMHDYLTGGFTANTSLAHYCRDNGLLLHIHRAMHAVIDRQNNHGIHFRVLAKALRMSGGDHIHAGTVVGKLEGEREITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 20901 - protein, 475 aa, Begonia iucunda
MSPQTETKASVGFKAGVKDYKLTYYTPDYQTKDTDILAAFRVTPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMNKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRDRGIYFTQDWVSLPGVLPVASGGIHVGHMPALTEIFGDDSVLQFGGGTLGHPWGNAPGAVANRVALEACVQARNEGRDLAREGNEIIREACKWSPELAAAREVWKEIKFEFPAMDTL

SEQ ID NO: 20902 - protein, 475 aa, Begonia rubella
MSPQTETKASVGFKAGVKDYKLTYYTPDYQTKDTDILAAFRVSPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMNKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 20903 - protein, 475 aa, Begonia fuchsioides
MSPQTETKASVGFKAGVKDYKLTYYTPEYQTKDTDILAAFRVSPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMNKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 20904 - protein, 475 aa, Begonia incarnata
MSPQTETKASVGFKAGVKDYKLTYYTPEYQTKDTDILAAFRVSPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALFKAQVETGEIKGHYLNATAGTCEEMNKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 20905 - protein, 475 aa, Begonia meyeri-johannis
MSPQTETKASVGFKAGVKDYKLTYYTPDYQTKDTDILAAFRVSPQPGVPPEEAGAAVAAESSTGTWTTVWTDGLTSLDRYKGRCYYIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMNKRAVFARELAVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRDRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 20906 - protein, 475 aa, Cucumis anguria
MSPQTETKASVGFKAGVKDYKLTYYTPEYETKDTDILAAFRVTPQPGVPPEEAGAAVAAESSTGTWTTVWTDGLTSLDRYKGRCYGIEPVAGEENQYIAYIAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGMPFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 20907 - protein, 475 aa, Cephalopentandra ecirrhosa
MSPQTETKASVGFKAGVKDYKLTCYTPEYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAVCARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNDIIRAASKWSPELAAACEVWKEIKFEFEAMDTL

SEQ ID NO: 20908 - protein, 475 aa, Coccinia adoensis
MSPQTETKASVGFKAGVKDYKLTYYTPEYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAIFARELGAPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 20909 - protein, 475 aa, Ecballium elaterium
MSPQTETKASVGFKAGVKDYKLTYYTPEYETKDTDILAAFRVTPQPGVPPEEAGAAVAAESSTGTWTTVWTDGLTSLDRYKGRCYGIEPVPGEESQFIAYVAYPLDLFEEGSVTNMFTSIVGNVFGFKALRALRLEDLRIPTAYIKTFQGPPHGIQVERDKLNQYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREATKWSPELAAACEVWKAIKFEFEAVDTI

SEQ ID NO: 20910 - protein, 468 aa, Trochomeria macrocarpa
  misc_feature (98)..(98): Xaa can be any naturally occurring amino acid
KASVGFKAGVKDYKLTYYTPEYETKDTDILAAFRVTPQPGVPPEEAGAAVAAESSTGTWTTVWTDGLTSLDRYKGRCYGIEPVPGEENQYIAYVAYPXDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 20911 - protein, 173 aa, Marchantia polymorpha
AHATFYGGDSGAATMGGACGYGNLWWRGYGLATAALSDTLLNNGLTCGACFEIKCNITGGESGKWCIQSNPSIKITATNQCPPNFDRPTDNGGWCNPPRTHFDLSLNMFRRLAQTQAGIIPISYRRTRCIKTGGIRFYLGGNAHFNLVLVYNVGGWGDVMKMQIRGTKTGWIT

SEQ ID NO: 20912 - protein, 253 aa, Physcomitrella patens
MAIPWSSVVLVTLVSLMACAEAKGSSFMGSDWGRAHATFYGGADASGTQGGACGYGNLYSTGYGTNTAALSSSLFNSGLSCGACYELTCDPSGSQYCLPGGSAIITATNFCPTGSNGGWCNPPKQHFDLAQPVFSKIARTVGGVIPINYRRVPCSKSGGMRFTVNGNPYFLLVLVTNVGGAGDVQQLYIKGASTGWLPLKRNWGQMWQFTGNSGMHGQAISFKAVTSDGAEAISPNVAPANWGFGQTFEGSNF

SEQ ID NO: 20913 - protein, 272 aa, Physcomitrella patens
  misc_feature (145)..(145): Xaa can be any naturally occurring amino acid
MPSISSFEKNADFKGSSFSTETTLSTDDQPDEVFARKAGYAPVPRSYGGVWRNARSTFYGGMDAAGTMSGACGYGNLYASGYGVHTTALSSALFKNGMACGACFEVQCGGKGKPCKPGSVVVTATNFCPPNPGQSANNGGWCSPXNEHFDLSYPAFVKIADPKAGAVPLQYRRVPCQKQGGIRFTINGNCNFILVTITNVGGSGVVTAAYLKGDKTEWSPLSRNWGANWQCRRNYCGQGISIKIVTSDNKVSVTKLAKSDWCFGKTFIGKQV

SEQ ID NO: 20914 - protein, 253 aa, Physcomitrella patens
MAIPWSSVVLVTLVSLMACAEAKGSSFMGSDWGRAHATFYGGADASGTQGGACGYGNLYSTGYGTNTAALSSSLFNSGLSCGACYELTCDPSCSQYCLPGGSAIITATNFCPTGSNGGWCNPPKQHFDLAQPVFSKIARTVGGVIPINYRRVPCSKSGGMRFTVNGNPYFLLVLVTNVGGAGDVQQLYIKGASTGWLPLKRNWGQMWQFTGNSGMHGQAISFKAVTSDGAEAISPNVAPANWGFGQTFEGSNF

SEQ ID NO: 20915 - protein, 272 aa, Physcomitrella patens
MPSISSFEKNADFKGSSFSTETTLSTDDQPDEVFARKAGYAPVPRSYGGVWRNARSTFYGGMDAAGTMSGACGYGNLYASGYGVHTTALSSALFKNGMACGACFEVQCGGKGKPCKPGSVVVTATNFCPPNPGQSANNGGWCNPPNEHFDLSYPAFVKIADPKAGAVPLQYRRVPCQKQGGIRFTINGNCNFILVTITNVGGSGVVTAAYLKGDKTEWSPLSRNWGANWQCRRNYCGQGISIKIVTSDNKVSVTKLAKSDWCFGKTFIGKQV

SEQ ID NO: 20916 - protein, 462 aa, Ruta graveolens
FKAGVKDYKLTYYTPEYVTKDTDILAAFRVTPQPGVPPEEAGAAVAAESSTGTWTTVWTDGLTSLDRYKGRCYDIEPVAGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIDKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDT

SEQ ID NO: 20917 - protein, 461 aa, Delftia acidovorans
MQQTGKQVDIHALAGHSRFNRFHGLVLWWCVLILVIDGYDLAVVGAALPSIMKNMGVDATSAGVMAGSALFGTMLGAIFLGTLADRIGRPRMIAVCVALFSVFTALTGLATEPIGFSVARFIAGLGIGGVLPIVTAQMGEFAPAKLRTRLVTMVFAGYSVGGILVALTAKQLIESHGWQWVFYVAGLPVLLIPLILKTMPESLSFLLKKGDQRQLGELAARLAPEQPNAAGTVYVGASTDRLHDAPVRTLFDAGRAFSTVMIWVACMTGLFMAYALNSWLTKLMAMAGYSLGSALNFVIVFNVGAIVGAIGGGLLSDKFNIKHVLVAFYVVGAASLAALAYTKSTELLFVAVFVVGASTLGTQLLAYAYAGDFYPPAVRSTGVGFASGVGRIGGIAAPILIGWLVSLSLPIEQNFMAIALAGVIGAAAVSFVNQSRAASTQAKAARAATGEAGRVDGAESR

SEQ ID NO: 20918 - protein, 352 aa, Cucumis sativus
MGSGNGFYSTSEFNLDAKWLIDPKHLFVGPKIGEGAHAKVYEGKYKNQIVAIKMVGKGDTPERMARREARFAREVAMLSKVRHKNLVKFIGACKEPMMVIVTELLTGGTLRKFLLNLRPRSLELDVAIGFALDIARAMECLHSHGIIHRDLKPENLILTADHKTIKLADFGLAREESVTEMMTAETGTYRWMAPELYSTVTLKHGDKKHYNHKVDAYSFAIVLWELILNRLPFEGMSNLQPAYAAAFKNMRPSAENLPEDLALIVTSCWREDPNTRPNFSQIIQMLLQSLSRISPRSPVIPPRICASENVVMPPESPCTNSLMAVRHGSGEAPHGMIEETPTTSFFCFNKCY

SEQ ID NO: 20919 - protein, 276 aa, Arabidopsis thaliana
MATNIGMMDSAYFVGRNEILTWINDRLHLNLSRVEEAASGAVQCQMLDMTFPGVVPMHKVNFDAKNEYDMIQNYKVLQDVFNKLKITKPLEINRLVKGRPLDNLEFLQWLKRFCDSINGGIMNENYNPVERRSRNGKERSVKGSNKIPKSLQTNNNHPPPNSSSVGLSKASGPKSAKAAEVQALSKELVDLKISTDLLEKERDFYFSKLRDVEILCQTPELDDLPIVVAVKKILYATDANESALEDAQEYLNQSLGVEDDEAEGNGEQLEEEKTQA

SEQ ID NO: 20920 - protein, 339 aa, Arabidopsis thaliana
MVCFNFNEMKTKKTLIGLGLGQIISLLSTLIASIASEIARKGISAPTSQTFLGYVSLAIVYGGIMLYRRSAIKVKWYHYFLLAVVDVEANFLVVKAFQNTSMTSIMLLDCWAIPCVLVLTWVFLKTRYRLMKISGVVICIVGVVMVVFSDVHAGDRAGGSNPVKGDFLVIAGATLYAVSNVTEEFLVKNADVTELMAFLGLFGAIIAAIQISIFERGAVRAIQWSTEAILLYIGGALGLFLFYTLITILIKNNGSTMFNLSLLTSDMWAVLIRTFGYHEKVDWLYFLAFATTATGLIIYSMKEKDEEEQRSGEVVSERRKLFDEEDGDSLHSNLIDAST

SEQ ID NO: 20921 - protein, 382 aa, Botryotinia fuckeliana
MVQLLSMASGLLALSAIVSAAPAPAPTAAPNPAEALAAIEQRGTACTFSGSGGAAAASKSKASCATIVLSALSVPSGTTLDLTGLKSGTQVIFEGTTTFGYEEWSGPLFSVSGTDITVKGASGSKLDGQGAKYWDGKGTNGGKTKPKFFYAHSLKGKSTISGINILNSPVQVFSINGASGLTLSNINIDNSAGDAGSLGHNTDAFDVGSSSDITISGAVVKNQDDCLAINSGTGITFTGGTCSGGHGLSIGSVGGRSDNTVSDIIIESSTVKNSANGVRIKTVSGATGSVSGVTYKDITLSGITSYGVVVQQDYKNGSPTGTPTSGVPITDVTFSNVKGTVASGATNVYVLCAKCSGWSWDVSVSGGKTSSKCAGLPSGVKC

SEQ ID NO: 20922 - protein, 374 aa, Botryotinia fuckeliana
MVHITSLISFLASTALVSAAPGSAPADLDRRAGCTFSTAATAIASKTTCSTITLDSVVVPAGTTLDLTGLKTGTKVIFQGTATFGYSEWEGPLISISGQDIVVTGASGNKIDGGGARWWDGLGSNVSAGKGKVKPKFFSAHKLTGSSSITGLNFLNAPVQCISIGQSVGLSLININIDNSAGDAGSLGHNTDAFDINLSQNIFISGAIVKNQDDCVAVNSGTNITFTGGNCSGGHGLSIGSVGGRSGTGANDVKDVRFLSSTVQKSTNGVRVKTVSGATGSVSGVTFQDITLIGITGVGIDVQQDYQNGSPTGTPTNGVPITGLTMNNVHGNVIGGQNTYILCANCSGWTWNKVAVTGGTVKKACAGIPTGASC

SEQ ID NO: 20923 - protein, 168 aa, Brassica rapa
FRCVQQGDDENGKTGVSLSKDITDVAGRTVKKHIATLGPLILPLSEKLLFFVTFMGKKLFKDKIKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALNNVKASTNS

SEQ ID NO: 20924 - protein, 168 aa, Brassica oleracea
FRCVQQGDDENGKTGVSLSKDITDVAGRTVKKHIATLGPLILPLSEKLLFSVTFMGKKLFKDKIKHYYVPDFKLAIDHFCIHAGGKAVIDVLEKNLGLAPIDVEASRSTLHRFGNTSSSSIWYELAYIEAKGRMKKGNKVWQIALGSGFKCNSAVWVALNNVKASTNS

SEQ ID NO: 20925 - protein, 365 aa, Apium graveolens
MAKSSEIEHPVKAFGWAARDTTGLLSPFKFSRRATGEKDVRLKVLFSGVCHSDHHMIHNNWGFTTYPIVPGHEIVGVVTEVGSKVEKVKVGDNVGIGCLVGSCRSCESCCDNRESHCENIIDTYGSIYFDGTMTHGGYSDTMVADEHFILRWPKNLPLDSGAPLLCAGITTYSPLKYYGLDKPGTKIGVVGLGGLGHVAVKMAKAFGAQVTVIDISESKRKEALEKLGADSFLLNSDQEQMKGARSSLDGIIDTVPVNHPLAPLFDLLKPNGKLVMVGAPEKPFELPVFSLLKGRKLLGGTINGGIKETQEMLDFAAKHNITADVEVIPMDYVNTAMERLVKSDVRYRFVIDIANTMRTEESLGA

SEQ ID NO: 20926 - protein, 448 aa, Methanococcus maripaludis
MNMNAVEQAMEYIKTNNVKFIRFQFVDIHGEPKNIAYPVKAGAAGEEELYDVLEKGVYFDGSSIEGFVSIESSDMMLKPDLKTLSVLPWRPTEKSVARVICDVYTTNGKPFEGDPRGCLKRVLAKFDEELGGEFFVGPEPEFFILKEDACGSWVPADDAGYFDLEPLDGGCDIRRKIVFALENLGFHVEASHHEVAEGQHEVDFKFADAVKTADSVVTFKTTIKTLAAQDGLKATFMPKPFFGINGSGMHCHQSIWLNGEPSFYDESAQYQLSETCMSYVAGILDHAKSIVAVTNPTVNSYKRLVPGYEAPVNIAWANSNRSAIVRVPAPRGKGTRIEFRAPDPACNPYLAFTVMLAAGLDGVKRKLSAIEPVEKNIFAMSEAQKKAEGIESVPANLKAALDELENNSVLKDALGKHIFENFIEIKNAEWDSFRTAVTDWETKQYLKI

SEQ ID NO: 20927 - protein, 353 aa, Zea mays
MKGGASSKGPVVVTGASGFVGSWLVMKLLQAGYTVRATVRDPENVGKTKPLLDLPGATERLSIWKADMADEDSFDEAIRGCTGVFHVATPTDFESKDPENEVIKPTVEGMIRILRACKEAGTVRRIVFTSSAGTVCVEERRRPVYDHDNWSDVDFCRRVKMTGWMYFVSKSLAEKAAMAYAAEHGLDLVSVIPTLVVGPFLSAAMPPSLVTALALVTGNEAHYSILKQVQFVHLDDLCDAEIFLFEHPAAAGRYVCSSHDATIHGLAAMLRDRYPEYDIPQKLRGIEDDLQPVHFSSKKLLDHGFTFRYTVEDMFDAGIRTCREKGLIPLATAGGVGSASLRTPGETDVTNGA

SEQ ID NO: 20928 - protein, 353 aa, Zea mays subsp. parviglumis
MKGGASSKGPVVVTGASGFVGSWLVMKLLQAGYTVRATVRDPENVGKTKPLLDLPGATERLSIWKADLADEDSFDEAIRGCTGVFHVATPTDFESKDPENEVIKPTVEGMIRILRACKEAGTVRRIVFTSSAGTVCVEERQRPVYDHDNWSDVDFCRRVKMTGWMYFVSKSLAEKAAMAYAAEHGLDLVSVIPTLVVGPFLSAAMPPSLVTALALVTGNEAHYSILKQVQFVHLDDLCDAEIFLFEHPAAAGRYVCSSHDATIHGLAAMLRDRYPEYDIPQKLRGIEDGLQPVHFSSKKLLDHGFTFRYTVEDMFDAGIRTCREKGLIPLATAGGVGSASLRTPGETDVTNGA

SEQ ID NO: 20929 - protein, 266 aa, Escherichia coli
MNIAIIGAGPAGIISARNAIKAGHSVVLFEKNTRIGGIWNPWSGGAYRNACMQNSRYTFHYTGFPPGDIDEFPGVEQVFRYLSAVAGEDALRESIRLNTEVVSLRKDAGHRVIRCASEGKDTEDIFDRVIIATGELWQPRRPPLPGEENFSGTLITSRDYQEPEAFKGKNILIIGGGVSGADIASDLVPFARSVSLSVKKMGLYLPRQFPTGPNDMMHSYLGRCLLSQMNYEDFIGYLDTMMPDYMQAYRASSLLPDMANNNAVHV

SEQ ID NO: 20930 - protein, 480 aa, Lactobacillus plantarum
MSEFPEGFLWGGATAANQLEGGYQEGGRGLSIADRLPGGKDRFKIVSQPDFDWTIDTDKYTYPNHEGIDFYHHYKEDIALFAEMGFKCYRFSIAWSRIFPNGDETQPNEAGLKFYDDVIDECLANNIEPVITISHYELPLNLAKRYGGWKNRYLIEFYETFARTILTRYASKVKYWMTFNEINSAVHFPVMGQGLVLSTGANDKKNVFQAWHNQFVASAKAVKIAHELRDDIQVGCMILYATSYAYDSNPVNQLANLQHNQDFNFFCADVQVRGAYPTYTKRLLAEYNLTFDDLETTDGDLALLQQYPVDYIGFSYYMSSAVETTGSVTDTVAGNLMGGVKNPFLKASDWGWQIDPTGLRIALNELHDRYQKPLFVVENGLGAIDKPDKNFYVEDDYRIDYLKQHIEAMAGAIDDGVDLMGYTPWGCIDLVSASTGEMSKRYGFIYVDLDDQGHGTLARYPKKSFYWYQDVIKHNGLTKK

SEQ ID NO: 20931 - protein, 485 aa, Nocardioides sp. KP7
MTTPRKFDEYRWNVLVDGVPLNVESRYPISDPSTGRYLTQVPDCAEADVDRAVQASRQAQAEWGALPPRARAAKLRELITLLREHREEFAMLDAIDGGFPISMMRNDVDAALELMDIFADMALDLGGKTIPVSTNLHFTTHEPFGVVARIGAFNHPFFFAASKVAAPLMAGNSVILKAPDQTPLSSLRLAEVAAEVLPQNLLITISGRGRVAGRAIVRHPQIKRIGFIGSTDTGRSIQRDAAEVAVKHISLELGGKNAQIVFADADLEQAALGAVNGMNFTWTAGQSCGSTSRLLVHESVADQVIARVVELVSAIAVGPPLDENAQMGPLVSQAQYDKSVHAIGEGIREGAKVVAGGGRPEGVGEGGWYLAPTVLADVRPGSFIEQNEIFGPVLSVIIFATDDEAVAIANGVEYGLTASVWTSDITRAHLIARRVEAGYVLVNGGSRHYWGLPFGGVKSSGVGSEESMEELISYTETKTTTVVLG

SEQ ID NO: 20932 - protein, 485 aa, Oryza sativa
MLVLFETPAGFALFKVLDEGKLDKVEDLWKEFTTSDSARKVVELKAFNKFENTSDALSAATLIIDSKPTKGLRKFLQKHCEGETLAVADSKLGNAIKEKLKIDCLHNSAVMELMRRLRNQLTELISGLGAQDLGPMSLGLSHSLSRYKLKFSPEKVDTMIIQAIGLLDDLDKELNTYAMRVREWYGWHFPELTKIVADNIQYAKVVKMMGDRTNAESLDFSEILSDDEVEAQLKEAAVISMGTEVSELDLLNIRELCDQVLALSEYRAQLFDYLRSRMNTIAPNLTALVGELVGARLIAHGGSLVNLAKQPGSTIQILGAEKALFRALKTKHATPKYGLIYHASLIGQAAPKHKGKISRSLAAKTALAIRYDALGDGEDNSIGLESRVKLETRLRVLEGKELGRSAGSTKGKPKIEVYEKDRKKGAGALITPAKTYNPAADLVLGQSTEETPKKPEGASKKRKHQEAEPAGAEETIQEDGDQEGQ

SEQ ID NO: 20933 - protein, 199 aa, Colletotrichum trifolii
MAQPGVQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIDHHAPNIPIILVGTKLDLREDPNTLESLRQKRMEPVSYDQALICAKEIKAHKYLECSALTQRNLKSVFDEAIRAVLNPRPVAQQKKKSKCTIL

SEQ ID NO: 20934 - protein, 486 aa, Ricinus communis
MVENTAAKNHPHQVFDVSINMQTQVVGSKWLDDDGRTKRTGTVWTASAHIITAVIGSGVLSLAWAIAQLGWIAGPAVMFLFSLVTYYTSTLLSACYRSGDPVNGKRNYTYMDAVRTNLGGAKVKLCGFVQYLNLFGVAIGYTIASSISMMAIKRSNCFHKSGGKNPCHINANPYMIAFGIAEIIFSQIPDFDQLWWLSILAAVMSFTYSTIGLGLGIAQVVENGKAMGSVTGISIGANVTPTQKIWRSFQALGDIAFAYSYSIILIEIQDTVRSPPSESKTMKKATLISVAVTTLFYMLCGCFGYAAFGDMSPGNLLTGFGFYNPYWLLDIANVAIVVHLVGAYQVYCQPLFAFVEKAAAQRYPDSGFITKDIKIPVPGFRPFNLNLFRSVWRTLFVVFTTVISMLLPFFNDIVGLLGALGFWPLTVYFPVEMYIAQKKIPKWSTRWLCLQILSAACLVITIAAAAGSIAGVVGDLKSVKPFQTSY

SEQ ID NO: 20935 - protein, 486 aa, Pseudomonas stutzeri
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDTEAEAIELANSLPYGLASAIWTENASRAHRVAGQIEAGIVWVNSWFLRDLRTAFGGSKQSGIGREGGVHSLEFYTELKNICVKL

SEQ ID NO: 20936 - protein, 437 aa, Staphylococcus aureus
KLWLRNFMQAFFVVFFVYMAMYLIRNNFKAAQPFLKEEIGLSTLELGYIGLAFSITYGLGKTLLGYFVDGRNTKRIISFLLILSAITVLIMGFVLSYFGSVMGLLIVLWGLNGVFQSVGGPASYSTISRWAPRTKRGRYLGFWNTSHNIGGAIAGGVALWGANVFFHGNVIGMFIFPSVIALLIGIATLFIGKDDPEELGWNRAEEIWEEPVDKENIDSQGMTKWEIFKKYILGNPVIWILCVSNVFVYIVRIGIDNWAPLYVSEHLHFSKGDAVNTIFYFEIGALVASLLWGYVSDLLKGRRAIVAIGCMFMITFVVLFYTNATSVMMVNISLFALGALIFGPQLLIGVSLTGFVPKNAISVANGMTGSFAYLFGDSMAKVGLAAIADPTRNGLNIFGYTLSGWTDVFIVFYVALFLGMILLGIVAFYEEKKIRSL

SEQ ID NO: 20937 - protein, 486 aa, Pseudomonas sp. KL28
MRQIENFIAGEFVASASGKRFDKHSPLDNRIICSVSEAGRGEVDAAVRAARSALQGEWGGLTTEQRIELLYGVANEITRRFDDFVEAEMSDTGQPEHVMKHVFIPRGAANFKVFADVIKNVASESFQMDTPDGRGALNYSIRRPKGVIGVVCPWNAPFMLMTWKVGPALACGNTVVVKPSEESPQTAALLGEVMNAVGIPKGVYNVVHGFGPDSAGEFVTRHPQVDAITFTGETRTGTAIMKAASEGMRDVSFELGGKNAGIVFADADFEAAVESFSRSVFLNTGQVCLGTERVYVERPIFERFVQALKVKAEAVKYGRPDDHQANYGPLISQEHKQKVLSYYRKAVEEGATLVTGGGVPQMPGELAEGAWVQPTIWTGLPETAAVVQEEIFGPCCHISPFDSEDEVVEKANATDYGLSTTIWTSNLARAHRMAGRIDVGITWINSWFLRDLRTPFGGSKQSGIGREGGVHSLEFYTETRNVCVKL

SEQ ID NO: 20938 - protein, 346 aa, Streptomyces vinaceus
MAAYPVTPVRTVRTEIAGIPRTITLKLEGHSPWRSVKGRTALSLIRSVAGDLTAPDATVVESTSGNLGLALSAICRDLGLRFIAVVDHRQSPVIQQAIEANGGELDWVRTPDDATTHLQDRLARVRELERDLPHAVWPNQYENDANWRIHETWTAPEFDAQVTHRAQALFAGVSTGGTLAGLSRHFRRTRPGLRIVAVDVRGSTVFGGVPRPRTLTGIGAGRRSAFLTRASTDDVLLVDERQAVACCHTLRADTGTAVGGSSGAVLAGCLEYLYRHPEVRHALCLCPDLGDHYGPTVYHPAWLDRMGLPSEAHRLRHRTGAACPGFEPVDDITPAPSAPSEEDASR

SEQ ID NO: 20939 - protein, 390 aa, Streptomyces vinaceus
MRLDRHHELFRTSVRAVLERLFLPELEDWEKAGEMPTHELYRSLGEEGLLGLTLPVDDGGLGLDLGYSHVWARELGRLPAGSPAMSLSVQTDIVLPLLAEEGGTGVRDAYLRSAVRGELVAALAATEPGGGSDLAAVRTTAVRDADGLRLNGDKAFLTNGSVADFAVVLCHLLPSGADEGGNPPDGLDSLTLVLVPTGLPGVRQERHTGKLGNRACDHGRLSFTDVRVPEENLLGKPGSGYEALTRVFTRERTFLAAVCTARAATMLDRATTYARGRAVLGRPLLQHQAIAFRLAELDAELALIEQYTDAVFQRLQEDAAALRQASIAKLRASRLERECADLLLQLHGGAGYLEGGPVERGYRDARAYALAGGADEALLHLIAGHPRTDV

SEQ ID NO: 20940 - protein, 456 aa, Vibrio parahaemolyticus
MHRYKEEASSLIKLATPVLIASVAQTGMGFVDTVMAGGVTQTDMAAVSVASSIWLPSILFGIGLLMALVPVVAQLNGSARREKIPFEIQQGVVLALLISIPIIGVLLQTQFILQLMDVEAVMADKTVGYIHAVIFAVPAFLLFQTLRSFTDGMSLTKPAMVIGFIGLLLNIPLNWIFVYGKFGAPELGGVGCGVATTIVYWVMFALLLAYVMTSSRLKSINVFGEYHKPQWKAQVRLFKLGFPVAAALFFEVTLFAVVALLVSPLGPIIVAAHQVAINFSSLVFMLPMSVGAAVSIRVGHRLGEENVDGARVASRVGIMVGLALATITAIITVLSRELIAELYTNNPEVITLAMQLLLFAAVYQCTDAVQVIAAGALRGYKDMRAIFNRTFIAYWILGLPTGYILGRTDWIVEPMGAQGFWLGFIIGLTAAALMLGVRLRWMHRQEPDVQLNFSLQ

SEQ ID NO: 20941 - protein, 107 aa, Aster tripolium
GGHVNPAVTFGLAVGGNITILTGLFYWIAQLLGSVVACFLLQFVTGGLAVPTHGVADGMNGLQGVVMEIIITFALVYTVYATAADPKKGSLGTIAPIAIGFIVGANI

SEQ ID NO: 20942 - protein, 107 aa, Aster tripolium
GGHVNPAVTFGAFVGGHISFFKSILYWIAQCLGSVVACLLLKFATGGLETSAFALSSGVGEWNAVVFEIVMTFGLVYTVYATAIDPKKGDLGIIAPIAIGFIVGANI

SEQ ID NO: 20943 - protein, 107 aa, Aster tripolium
GGHVNPAVTFGLAIGGNITILTGLFYWIAQLLGAVVASFLLGFVTGGLAVPTHGVADGMNAIQGVVFEIIITFALVYNVYANAADPKKGSFGTIAPVAIGFIVGANI

SEQ ID NO: 20944 - protein, 107 aa, Aster tripolium
GGHVNPAVTFGLAVGGQITIITGVFYWIAQLLGSVAASFLLSFVTGGLAVPIHGCADGVGAIQGMVMEIIITFALVYTVYGTACDPKKGDVGTIAPIAIGFIVGANI

SEQ ID NO: 20945 - protein, 107 aa, Aster tripolium
GGHVNPAVTFGLAVGGQITILTGIIYVVAQLAGSIVACYLLSFVTGGLAVPIHGVADGVGAIQGVVMEIIITFALVYTVYATACDPKKGALGTIAPIAIGFIVGANI

SEQ ID NO: 20946 - protein, 107 aa, Aster tripolium
GGHVNPAVTFGAFVGGNITLLRGIVYIIAQLLGSTVACLLLKFVTNDMAVGVFSLSAGVGVTNALVFEIVMTFGLVYTVYATAIDPKKGSLGTIAPIAIGFIVGANI

SEQ ID NO: 20947 - protein, 285 aa, Pseudomonas tolaasii
MTTALQQPSLSSQCMAEFLGTALLIFFGTGCVAALKVAGASFGLWEISIIWGVGVSMAIYLSAGISGAHLNPAVSIALCIFADFEKRKLPFYILAQVAGAFCSAALVYTLYSNLFFDYEQTHHMVRGSQASLELASVFSTYPHALLSTAQAFLVEVVITAILMGVIMALTDDNNGLPRGPLAPLLIGLLIAVIGSAMGPLTGFAMNPARDFGPKLMTFFAGWGEMAFTGGRDIPYFLVPIFAPIVGACLGAAAYRGLIARHLPSAAPAIDEETPDTAVNGNTRIS

SEQ ID NO: 20948 - protein, 440 aa, Achromobacter denitrificans
MSAAKLPDLSHLWMPFTANRQFKANPRLLASAKGMYYTSFDGRQILDGTAGLWCVNAGHCREEIVSAIASQAGVMDYAPGFQLGHPLAFEAATAVAGLMPQGLDRVFFTNSGSESVDTALKIALAYHRARGEAQRTRLIGRERGYHGVGFGGISVGGISPNRKTFSGALLPAVDHLPHTHSLEHNAFTRGQPEWGAHLADELERIIALHDASTIAAVIVEPMAGSTGVLVPPKGYLEKLREITARHGILLIFDEVITAYGRLGEATAAAYFGVTPDLITMAKGVSNAAVPAGAVAVRREVHDAIVNGPQGGIEFFHGYTYSAHPLAAAAVLATLDIYRREDLFARARKLSAAFEEAAHSLKGAPHVIDVRNIGLVAGIELSPREGAPGARAAEAFQKCFDTGLMVRYTGDILAVSPPLIVDENQIGQIFEGIGKVLKEVA

SEQ ID NO: 20949 - protein, 340 aa, Cordyceps bassiana
MSRANPPNNASASRKISFNVSEQYDIQDVVGEGAYGVVCSAIHKPSGQKVAIKKITPFDHSMFCLRTLREMKLLRYFNHENIISILDIQKPRGFDSFNEVYLIQELMETDMHRVIRTQVLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVLFRTLFADTSDLALDLLEKLLAFNPVKRITVEEALKHPYLEPYHDPEDEPTAPPIPEEFFDFDKHKDN

SEQ ID NO: 20950 - protein, 180 aa, Sulfolobus islandicus
PKGVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 20951 - protein, 180 aa, Sulfolobus islandicus
PKSVVINPYFEWEDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 20952 - protein, 180 aa, Sulfolobus islandicus
PKSVVINPYFEWDDEDFIKRNKVPLKDTVIYEVHVKGFTKLRLDLPENIRGSYEGLTSEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 20953 - protein, 180 aa, Sulfolobus islandicus
PKSVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQQDNKRYYLDF

SEQ ID NO: 20954 - protein, 180 aa, Sulfolobus islandicus
PKSVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPDNKRYYLDF

SEQ ID NO: 20955 - protein, 180 aa, Sulfolobus islandicus
PKSVVINPYFEWDDEDFIKRNKVPLKDTVIYEVHVKGFTKLRLDLPENIRGSYEGLASEQMISYLKDLGITTVELMPVFHFIDQRFLIDKGLTNYWGYDPINFFSPECRYSSSGCLGEQVFSFKKMVNELHNAGIEVIIDVVYNHTAEGNHLGPTLSFRGIDNIAYYMLQPENKRYYLDF

SEQ ID NO: 20956 - protein, 320 aa, Candida dubliniensis
KVNTVAIGTMRLGSNWRGFNGDIDECLKILKFCYDNGFRTFDTADTYSNGKSEELLGLFIKKYNIPRERIVILTKCYFSVKDDAEDSTLEIDPIDFMNGKGLSRKHILAAAEASVKRLGTYIDVLQIHRLDRNVTYEEIMRSLNDVVEQGLTRYIGASSMKTWEFVESQNVAKANGWHQFISMQSHYSLLYREDERELNDYCKKNGIGLIPWSPNGGGVLCRPFDAEKTKQFLDNKQWSSLFGLDNAREADRIIVNRVEELSLKYNASMMQVSLAWCMAKGVIPIAGVSKFAQAEELVGIYNVNLTEEDIKYLEEPYHAK

SEQ ID NO: 20957 - protein, 274 aa, Antirrhinum majus
RNWGFFELVNHTIAPEFMDTVERLTKEHYRKCMEQRFKEMVESKGLEAFESEIEDLDWESTFFLRHLPVSNISEIPDLDDEYRKVMKEFASQLEKLAEQLLDLLCENLGLEKGYLKNAFYGSKGPTFGTKVSNYPPCPKPDLIKGLRAHTDAGGIILLFQDDKVSGLQLLKDGEWVDVPPMRHSIVINIGDQLEVITNGKYKSVVHRVIAQPDGNRMSLASFYNPGSDAVIYPAPALVEKGESKDLYPKFVFEDYMKLYAGVKFQAKEPRFEAM

SEQ ID NO: 20958 - protein, 275 aa, Antirrhinum majus
CENWGFFELVNHGITPEFMDTVEKLTKEHYKKTMEQRFKEMVASKGLEAVQSEINYLDWESTFFLRHLPVSNISEVPDLEDQYRKVMKEFALQLEKLAEELLDLLCENLGLEKGYLKKAFYGSKGPTFGTKVSNYPPCPKPNLIKGLRAHTDAGGIILLFQDDKVSGLQLLKHGEWVDVPPMRHSIVINIGDQLEVITNGKYKSVMHRVIAQTDGNRMSLASFYNPGSDAVIYPAPALVEKEETKDLYPKFVFEDYMKLYTTVKFQAKEPRFEAM

SEQ ID NO: 20959 - protein, 335 aa, Schizosaccharomyces pombe
MQQTYKPNTSALKDGAPKATVDQKQLLPCKYRVGRVLGGGTYATVREAVHIETNKMYAAKIMNKKMMEKKQDFVKNEIAILKRVSYEHPNILHLVDFFETVNNLYLITELATGGALFDRICAKGSFYEADAAALMRTTTSAVKYLHDNGIVHRDLKPENLLYRSKDPNSDLLIADFGLSHFYEDSQYYMLMTACGTPEYMAPEVFRRTGYGKPVDMWAIGVITYFLLSGYTPFARPSQVEVIEAILANEYTFNDPCWSGISETAKDFIKKCLENDPSKRLTAADALKHPFLSENGPATSNLLPNVRENFNARKTFRTAYNAVRAFNTWKKLENKH

SEQ ID NO: 20960 - protein, 500 aa, Glycine max
MAMANLARRKGYAVVLSSRSSLCLTRWRGFASGSDENDVVVIGGGPGGYVAAIKAAQLGLKTTCIEKRGTLGGTCLNVGCIPSKALLHSSHMYHEAKHAFANHGVKFSSVEVDLPAMMAQKDKAVSNLTKGIEGLFKKNKVNYVKGYGKLVSPSEVSVDTTEGGNTVVKGKHIIIATGSDVKSLPGITIDEKKVVSSTGALALTEIPKRLIVIGAGYIGLEMGSVWGRLGSEITVVEFASEIVPTMDAEVRKQFQRSLEKQGMKFKLKTKVVGVDTSGDGVKLTLEPAAGGDQTTLEADVVLVSAGRTPFTAELGLDKIGVETDKIGRILVNERFATNVSGVYAIGDVIPGPMLAHKAEEDGVACVEYIAGKVGHVDYDKVPGVVYTMPEVASVGKTEEQVKELGVEYRVGKFPFLANSRAKAIDNAEGLVKILAEKETDKILGVHIMAPNAGELIHEAAIALQYDASSEDIARVCHAHPTMSEAVKEAAMATYDKPIHI

SEQ ID NO: 20961 - protein, 298 aa, Ustilago maydis
MDKYQRIEKVGEGTYGVVYKAKDLTPGANGRIVALKKIRLETEDEGVPSTAIREISLLKELRDDNIVRLFDIVHQESRLYLVFEFLDLDLRKYMDHVSRNRGGDGMGPEIVRKFTYQLIRGLYYCHAHRILHRDLKPQNLLIDREGNLKLADFGLARAFGIPLRTYTHEVVTLWYRAPEVLLGSRHYSTAIDMWSVGCIFAEMTLGHPLFPGDSEIDQIFKIFRALGTPTDDVWPGVQQLPDYKDSFPKWAGRPLRDAVPGLDEAGLDLLEGMLVYDPAGRTSAKRSLVHPYFRRLLT

SEQ ID NO: 20962 - protein, 1099 aa, Methanocaldococcus jannaschii
MCGIIGYIGNDKAPKILLNGLRRLEYRGYDSCGIGVVDNNKLIIKKNVGKVEEVAKKERFLDIDGNIGIGHCLHPDTYVILPDGRMKKISEIDEDEVLSVNFEDLKLYNKKIKKFKHKAPKILYKIKTAFSELITTGEHKLFVVENGKIVEKCVKDLNGSELIGVVRKLNYSFNDNVEFKDVYVERHYKLDETIRNKLRKVREKLGLTRKDVEKLCGVKEIYIVKIETGKLESIEEERLKKLCSLYGINFEEIIYRDNLHYTNPVKFPKTPTPELMQIIGYIIGDGHFPSNRMLRLKDERKEVLEEYNQLFKTVFNLEGNIKKGDGNYYILEINSKYLIDWFRENIPELFNKTGNERTPEFVFRLNNDLVASYLRGIFDAEGYIRAEAKQIGIGMTSKCFIKEIQFLLLRFGILASYSKIKRKEENWNNTHKLLISDKKSFELFKKYIGFTAKDKMEKLEAILNKMKGLNFRYISIPLTKKEIREFVGVPLKTIKNGDNYCTDYTIEKIIEELNSKGLYDKAEYLKRFLDADIVWTKFKIEEVESDVEYVYDLEVEDYHNFIGNLIINHNSRWATHGNVCKENAHPHTDCKEEIAVVHNGIISNYKELKDELMKKGHKFKSETDTEVVPHLIEEELKKFKEINEENYIKAVKNAIKKLKGTYALVIINKNFPNLLIGARNESPLILGINDDGYFLGSDITAFLDYTNKAIPLEDGDVVVIKKKENGYEVTIENNGNTVEREMMEINWDISSAEKMGYPHFMLKEIMEQPEVLKVSAKISAEEIKELAKCIKDYDRVYFVAMGTSLHAAMVVEYLFAKLGKLVIACDASEFLNKGVVDDKTLVIGITQSGETYDTLKALRFAKKNKAKTGAIVNVLGSTATREADITVMMGAGIEIAVCATKTYTSQLMILYRLFIEYGKLLGRDMSEYEKEIDKIPNYIKEVLDKKETIKEIANNLKVNNYIFISKGINIASALEGALKFKEITYLHAEGMSGGLLKHGTISLIDENMDTVAIVPPRDSAVFNSILSNIEEVKARGGKVIAITPTEIDGAENILVPEVIEEISPIVYAPAFQLLAYYKAVELGRDVDKPRGLAKSVTVE

SEQ ID NO: 20963 - protein, 166 aa, Rickettsia prowazekii
MQNYFQLLELPQEYNIDLKILEKQYFAMQVKYHPDTAKTAQEKAQNLITSTELNKAYSTLKDALKRAEYMLLLQNINLNDEKIRSLLSPLELSIFWDEMERIENTTLFSDLEKLKNKYELMQQQNINSLKQAFVEQNLSDATIYTSKLKYIRTLQSKLQEKIKSCK

SEQ ID NO: 20964 - protein, 446 aa, Oryza sativa (japonica cultivar-group)
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQLLRIEEELGAAAVYAGAKFRAPVEPY

SEQ ID NO: 20965 - protein, 160 aa, Hippophae rhamnoides subsp. sinensis
DEYGNPIHNGSTGINTTGYQQQTAGLYGTGHGSGYGTGGTQFGTTQHTAGHGTGGTLTSTAPAGHGQTKLRRSGSGSSSSSEDDGQGGRRKKGLKEKIKEKLPGGHKDQHQPGQYKSVTTTIITPDSGYYEQSGQQHQQQHDKGIMDKIKDKLPGSFSLI

SEQ ID NO: 20966 - protein, 472 aa, Azorhizobium caulinodans
MAETSYDVIVIGGGPGGYVAAIRAAQLGFKTAVVEKKHLGGICLNWGCIPTKALLRSAEIYHYMEHAKDYGLSAEKIGFDIGAVVKRSRGVSQQLNTGVGFLMKKNKIDVIWGSATLTAPGKIKVEAAPDAPKGALGGGDYLAKHIIVATGARPRALPGIEPDKKLIWTYFEAMVPDRMPKSLLVMGSGAIGIEFASFYKTMGADVTVVEVMPQILPVEDAEIAALARKRFEKQGMKILSGAKVTKLEKKADSLTVHVVNSKGAKQDFQVERMISAVGVVGNVDGLGLENLGVKIERGIIVTDGYGRTNVPGVYAIGDVAGAPMLAHKAEHEGVICVETIKGLHTHPMDKAKIPGCTYCQPQVASVGLTEAKAKEDGRDIRVGRFRFGGNGKAIALGEDQGLVKTIFDKKTGQLLGAHMVGAEVTELIQGFVVAMNLETTEEELMHTVFPHPTLSEMMKEAVLDAYGRVLNA

SEQ ID NO: 20967 - protein, 352 aa, Hordeum vulgare
MAASDEMPMVQDLVSAGVQEPPSRYLVHEQDRHGDLLAAHEMPEPIPLIDLSRLMDADEADKLRAALQTWGFFLATNHGIEDSLMEAMMSASREFFRQPSEEKQKCSNLVDGNGKHYQVEGYGSDKVESEDQVLNWNDRLHLRVEPEDERNFAKWPSHPESFRDVLNEYASKTKKIRDLVLRSIAKLLEIDEDYFVNQISNKASGFARLYYYPPCPRPDLVLGLTPHSDGNLLTILFVDDDVGGLQVQRDGKWYNVPAKPHTLVINLADCLEIMNNGIFRSPVHRVVTNTEKERLSLAVFYAVDEETVLEPAPGLLDEKRPPRYRKMMAKDFVVGLFEHFLQGKRFIDTLKM

SEQ ID NO: 20968 - protein, 165 aa, Haemophilus ducreyi 35000HP
MRIDTSALCDIYSDQVDVVEPIFSSFGGASSFYGKITTVKCFENNGLIAEVLEEEGEGRVLLIDGGGAVRRALIDAELAKLAVDNGWQGIIVYGAVRQLDVLETLDIGIHALAPIPVGAEDADIGEVDTPVNFGGVTFFPEDYVYADLTGIILSPELLDLNELAE

SEQ ID NO: 20969 - protein, 197 aa, Haemophilus ducreyi 35000HP
MIDFDGYRPNVGIVICNKVGQVLWARRFGQNSWQFPQGGINEGENIETAMYRELYEEVGLTKKDVRLLWASKYWLKYKLPKRLVRNDASQPVCIGQKQRWFLLQLVSDESAVNLKTTKSPEFDGWRWVSFWYPVRQVVSFKRDVYRKVMREFAAILLNETRKGETERSVLEASDKREYQRRETRKSARAWNHYPKGK

SEQ ID NO: 20970 - protein, 377 aa, Haemophilus ducreyi 35000HP
MAKKDYYEVLGLQKGATEKDIKRAYKRLAAKYHPDKNQGSKDSEEKFKQITEAYEILTDDQKRAAYDQYGHAAFEQGSSNGGFNGFGGGFGGFEDIFSEMFGGGFGGGSRRQHVVRGQDLRYDIEISLEEAVKGCKKDIRLSTLAECDNCHGTGAEAGTKVENCPHCHGAGRIRRQQGFFVTEAVCPSCHGTGKKIEKPCHSCHGDGRVQKAKNLSVTIPAGVDTGNQLRLSGEGEAGENGAPAGDLYVVIHVREHNIFTRDGANLYCEVPISFSMAALGGEIEVPTLDGKLKLKIPTETQTGKLFRVRGKGVVSPRGGYAGDLICKVVVETPVQLNEEQKELLRQLEISLDGKANHRPQQAGFLDSVKNFFTHLGK

SEQ ID NO: 20971 - protein, 444 aa, Haemophilus ducreyi 35000HP
MAERKYFGTDGVRGKVGQFPITPDFALKLGWAAGKILATQGTKQVLIGKDTRISGYMLESALEAGLAAAGLSAAFVGPMPTPAVAYLTRTFRAEAGIVISASHNPYYDNGIKFFSANGEKLPDEVEEAIEALLDQPMDYVESDQLGKAIRINDAAGRYIEFCKGTFPADASLKGYKIVVDCAHGATYHIAPNVMRELGAEVIEIGTHPNGLNINDKCGATDISALQQAVLTSKADLGVAYDGDGDRIIMVDHLGNKVDGDQILFIIAREALRSGKLKGGVVGTLMSNMGLEIALKHLAIPFTRANVGDRYVLEQLKEKNWKLGGENSGHIIVLDKNTTGDGIIASLEVLAAMEAHKMSLNDLTHAVPLFPQVLLNVRFDGGNNPLENAAVKALAKDIETRLVGKGRILLRKSGTEPLIRVMVECEDAVLAQQYAEEIVSAIQNH

SEQ ID NO: 20972 - protein, 267 aa, Haemophilus ducreyi 35000HP
MRDKRDLVEIKNLTFKRGKRVIYENLNLRVQKGKITAIMGPSGIGKTTLLRLIGGQIMPEIGQILFDGQDICQVSNHTLYKLRKRMGMLFQSGALFTDLNTFDNIAFPIREHTQLPEALVHKLVLMKLEAVGLRGAATLMPAELSGGMARRAALARAIALDPELIMYDEPFTGQDPISMGVIVELIQKLNQALNLTSIVVSHDVTEILSIADYAYIIADKHVIAEGTPHTLLASQDPRVIQFLAGKSDGPVRFHYPAKNYIEELFGA

SEQ ID NO: 20973 - protein, 456 aa, Haemophilus ducreyi 35000HP
MSKHYDYIAIGGGSGGIASINRAASYGKKCAIIEAKQLGGTCVNVGCVPKKVMFYGAHIADAINHYAEDYGFDVSLKQFDFKKLVASRQAYISRIHSSYQQVLSKNNVDVFNGFARFVDPKTIEVHYPDGSTENLTADHILIATGGRPTIPEVIGAEYGIDSNGIFALTELPKRVAIVGAGYIAVELAGVFNSFGVETHLFVRQHALLRTQDPLIVDTLLAVLAQQNIKLHTQAISKQVVKNADGSLTLTLQDGRQTEVDCLVWAIGREPTTDVINLAAAGVETNSRGFIKVDKFQNTNVTGIYAVGDIIEGGIELTPVAVAAGRRLAERLFNNKPNEHLDYSLVPTVVFSHPPIGTVGLTEPQAIEQYGAENVKVYTSSFTAMYTAVTQHRQPCRMKLVCIGEQEKIVGLHGIGFGVDEMIQGFAVAIKMGAVKADFDNTVAIHPTGSEEFVTMR

SEQ ID NO: 20974 - protein, 479 aa, Haemophilus ducreyi 35000HP
MSRKLRRTKIVCTMGPATDRSNNLERIIAAGANMVRMNFSHGVPEDHIERANKVREIAARLGKHVAILGDLQGPKIRVSTFKEGKIFLNIGDKFTLDADLPRGEGDQQVVGLDYKNLPNDVVPGDILLLDDGNVQLKVISVEGAKVHTEVTLGGPLSNNKGINKLGGGLSAPALTEKDKEDIKLAARIGVDYLAVSFPQSSQDLHYARQLAEEAGLDAKIVAKVERAETVATEEAMDDIILGADVVMVARGDLGVEIGDAALVGVQKRLIRRARKLNRVVITATQMMESMIKKPMPTRAEVMDVANAVLDGTDAVMLSGETASGDYPVETVKSMAEVCLGAETMPSINISRHRMQGKFAAIDEAVAMSAMYTANHLESVSAIIALTHSGETAKLMSRISSGLPIYALSRNQQALNRTALYRGVTPVYYNEESRTIEGAKKGIALLKEKGYLMTGDLVLLTQGSESKDGGTNTCRILKVE

SEQ ID NO: 20975 - protein, 433 aa, Haemophilus ducreyi 35000HP
MAKIVKVIGREIIDSRGNPTVEAEVHLEGGFVGLAAAPSGASTGSREALELRDGDKSRFLGKGVLKAVAAVNNEIAQAIVGKEGCAQSEIDQTMIDLDGTENKSKFGANAILAVSLATAKAAAASKGLPLYAYIAELNGTPGVYSMPLPMMNIINGGEHADNNVDIQEFMIQPIGAKTLREALRIGAEVFHNLAKVLKAKGLSTAVGDEGGFAPNLASNADALACIKEAVENAGYVLGKDITLAMDCASSEFYNKENGLYEMKGEGKSFTSQEFTHYLENLCKEYPIVSIEDGQDESDWDGFAYQTKILGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGEMAPFLGLKAIKGQA

SEQ ID NO: 20976 - protein, 454 aa, Haemophilus ducreyi 35000HP
MTITTPIKAVLASNQHFLDRQDKMESNVRSYPRKLPFAYAKAQGCWVTDVEGNEYLDFLAGAGTLALGHNHPILMQSIKDVLDSGLPLHTLDLTTPLKDAFTEELLSFFPKDEYILQFTGPSGADANEAAIKLAKTYTNRGNIIAFSGGFHGMTHGALSLTGNLGAKNAVQNLMPGVQFMPYPHEYRCPFGIGGEAGAKAVERYFENFIEDIESGVVKPAAVILEAIQGEGGMVPAPISFLQKVREVTQKHGILMIVDEVQAGFCRSGKMFAFEHAGIAPDIVVMSKAIGGSLPLAVLAIKKQFDAWQPAGHTGTFRGNQLAMATGYASLKIMRQENLAQNAQARGEYLTNALRELSKTFACIGNVRGKGLMMGIDIVDERQAQDATGAYPQDCELAIAIQKCCFNNKLLLERGGRGGNVVRVLCPVNINQAECEEFIKRFTQSVADAIKAVRG

SEQ ID NO: 20977 - protein, 476 aa, Haemophilus ducreyi 35000HP
MSVNRVLDLIKENDIKFVMLKFTDIKGKEHGVSLPVSLVVDDLEALFEEGKMFDGSSVEGWKAINKADMLLMPISETAVVDPFAQIPTMTIRCSIYEPNTMQPYDRDPRSIATRAENFLKSTGIADSVMFGPEPEFFLFDDVRYATEANNVSYKIDDIEAMWNTNRKYEDGNNAYRPLKKGGYCAVAPLDSAHDIRSEMCLIMEQMGLIIEAHHHEVATAGQNEIATKFNSLTLKADETQIYKYVVQNVAIAHAKTACFMPKPFAGDNGSGMHCNMSLSKAGKNIFMGDKYAGLSETALYYIGGIIKHAKALNAFTNPTTNSYKRLVPGFEAPVLLAYSASNRSASIRIPAVTTPKATRIEARFPDPMANPYLCFAALLMAGLDGIINKIHPGDAMDKNLYDLPPEELQDIPAVASSLAEALDALSTDFTFLTQGNVFSKAFIDAYIAIRRKEVERLNMTPHPVEFEMYYAYSGLK

SEQ ID NO: 20978 - protein, 256 aa, Haemophilus ducreyi 35000HP
MARRPLVMGNWKLNGSKAFTQQLIAELKTELAEITGCDVAIAPPVMYLSEAEIALAGQSTIRLGAQNVDINTQGAFTGDISTAMLQEFCAKYIIIGHSERRTYHAESDQFIAKKFAALKTAGLTPVLCIGETEAENEAGQTQQVCARQIDAIINSLGVEAFNQAVIAYEPIWAIGTGKSATPAQAQAVHAFIRQHIAEKSQAVADQLIIQYGGSVNDTNAAELFSQPDIDGALVGGASLKATAFAEIVKAAEKAKA

SEQ ID NO: 20979 - protein, 215 aa, Haemophilus ducreyi 35000HP
MKVILLGAPGAGKGTQAQFIMHKFGIPQISTGDMFRAAIKEGTELGKQAKALMDQGKLVPDDLTVALVKDRIAQPDCAHGFLLDGFPRTIPQADALKDAGVKIDLVLEFDVADEVIVERMSGRRVHQPSGRTYHIIYNPPKVAGQDDITGEELITRADDKAETVLERLAVYHQQTKPLIAYYIAEAEKGNTRYERLDGTKPVEQVSAELANIFNQ

SEQ ID NO: 20980 - protein, 484 aa, Haemophilus ducreyi 35000HP
MSIKGDIGVIGLAVMGQNLILNMNDNGFKVVAYNRTASKVDEFLAGEAKDTNIIGAYSLEDLAAKLEKPRKIMLMVRAGEVVDQFIDALLPHLEAGDIIIDGGNSNYPDTNRRTITLAEKGIRFIGTGVSGGEEGARHGPSIMPGGNEEAWPFVKPILQAISAKTDKDEPCCDWVGKEGAGHFVKMVHNGIEYGDMQLICEAYQFLKDGLGLNYEEMHAIFADWKNTELDSYLIDITADILAYKDADGEPLVEKILDTAGQKGTGKWTGINALDFGIPLTLITEAVFARCVSAFKDQRVAVSQLFNKTITPISDDKKEWIEAVRKALLASKIISYAQGFMLIREASENFEWNINYGATALLWREGCIIRSAFLGNIRDAYEANPGLVFLGSDPYFQNILQSAMADWRKVVAKSIEIGIPMPCMAAAITFLDGYSSEHLPANLLQAQRDYFGAHTYERTDKPRCSFFHTNWTGRGGNTASTTYDV

SEQ ID NO: 20981 - protein, 391 aa, Haemophilus ducreyi 35000HP
MSVKKMADLDLTGKRLFIRADLNVPVKEGKITSDARIRATIPTLKLALQKGAKVMVTSHLGRPTEGVFEEANSLQPVVDYLNASDLGVPVRLVRDYLDGVEVNQNEIVVLENVRINKGEKKNDAELAKKYAALCDIFVMDAFGTAHRAECSTYGIAEFAPIACAGPLLAAELEALGKALKEPQRPMLAIVGGSKVSTKLTVLDSLSKIADQLIVGGGIANIFIAAEGHNVGKSLYEADLIPEAKRLASTTHIPVPVDVRVGTEFSETATATEKLVSEVTADESIFDIGDKSAEELAHIIKSAKTIFWNGPVGVFEFANFRKGTEIISNAIAEATANGAFSIAGGGDTLAAIDLFGIADKISYISTGGGAFLEFVEGKVLPAVEILEKRANS

SEQ ID NO: 20982 - protein, 387 aa, Haemophilus ducreyi 35000HP
MPLNLSNIRTQITQLDHDLLKLLAERHQLAFDVLRDKQITEIPLRDRTRETELLNALIKYAEAQQYDLDEEYITQIFQCIMKDSILTQQAYFKDNLKQERENNKKISIAFLGMAGSYSSMAAKQFAKKQQNVMIELNCNSFQEVFEKVEGDLAQIGILPLENSTSGSINEVYDLLQHTNLTIIDEIVYPIKHCILANREATLEDIDTIYMHPEHEKQCSQALEKLGKIDIKYCKSSSHAMSLAACLNKPNIAALSSEAGGKLYDLTNIKTNITNQEHNITRFIIVAKKAVPVSPQLQTKILLLMTSKKQAGILVDVLSIFKQHKIRMLKLVSRPIYGEDWEEMFYVELEANIDSAKTQQALAELQKITCYLKVVGCYPSEVVQPVQP

SEQ ID NO: 20983 - protein, 394 aa, Haemophilus ducreyi 35000HP
MMTSDQIKQLDANYIAQTYAKFDLALSHGQGCEVWDFDGNKYLDFTSGIGVNSLGWADPDWLEAVIAQLHKLSHTSNLFYTEPSARLAKHLVQVSGLKRVFFANSGAEANEGAIKVARKYSHDKYGDTRSTIISLVNSFHGRTISTLAATGQKLFHQHFFPFTAGFEHLIANDLNAFKTRIAQNDICAIILEVVQGEGGVCSLDQAYLQAVQGLCQVQDILLIIDEVQTGIGRTGTMFAYQQFELKPDIVTLAKGLAGGLPIGAFLLADKVAETLAKGDHGSTFGANPVSCAAANAVLTKLEPLFLTEVMRKGQKLRKALQSLPHVKSISGLGLMIGVEFDEHINVADVVTNCLKQGVLFLTAKTKLRMLPPLIINDEQLERGVTVLAQVLSEM

SEQ ID NO: 20984 - protein, 316 aa, Haemophilus ducreyi 35000HP
MTIFADNSYTIGNTPIVRLKHFGQNGNLLVKIEARNPSFSVKCRIGANMVWQAEKDGILTKDKEIVDATSGNTGIALAYVAAARGYKITLTMPETMSDERKRLLRGLGANLVLTESTLGMKGAIAKAEEIFASDPNRYIMLKQFENPANPAIHQQTTGPEIWQATEGKIDVIVAGVGTGGTITGVSRYIKQDKGKQIISVAVEPKESPVITQTLNGEEVQPGPHKIQGIGAGFIPKNLDLTLIDRVEQVSSEEALKIAHQLMAKEGILVGISSGAAVAAADRLAKLPEFADKQIVAVLPSASERYLSTLLFEGIEI

SEQ ID NO: 20985 - protein, 463 aa, Haemophilus ducreyi 35000HP
MNLQWQKYPENASKLFKLTVPIFISQLSASGMGLADIVMAGLVSDDDVSAIAVSNSIYFPLFLFVLGVLNAITPTVSYLNGANQRNLIAHQIRQGFWLVWAFVIPLIVVFLNSHWILDYMNTPAVFAQKSQDYLAIMAIGIVPALLTVNLRCMNDGLANPKPAMRITFIGLLCNIPLNYIFIFGKFGVPEMGAVGCGVATAIVNWSMFLMMFHYCYTNKPQKDIGLFNKWFEMPSGKTLLKICKLGLPIGFATFTEVMLFSTSALFLSPLGSQVVASHQTALQTSSMLFMVPLSFGIATTIVLGRVLGQKLVEEAKIISYHALITGVIFAVIAAILIVLFNNIIPLAFTRDPVSIAIASHLLLFAAVYQIPDSLQVVANGILRGYKHTKPVLYVTVFCYWGIGIPFGYVLARTDWIVQPMAAAGFWLIFCVSLSLASGLLIYQIRKIQKIPAATLIAKLERIK

SEQ ID NO: 20986 - protein, 173 aa, Haemophilus ducreyi 35000HP
MRNPFSLFNLPVQFQIDNAQLSERYLALQKQFHPDNFANESADKQLAALQQSADVNEALQILKDPIARATAIIEINTGIVKNLEENSRQDLDFLMQHMEWHEKLDSIENSRSEQQLAGFLKQIKTEQRNVEQQLATLLNQQQWQKADLLTERLRYFKKLIIQIEKVEEKLLEY

SEQ ID NO: 20987 - protein, 169 aa, Haemophilus ducreyi 35000HP
MITLHTNYGDIKIELYYDKAPITAQNFTDYCQQGFYNGTIFHRVIDGFMIQGGGMSAGLIEKPTNAPIQNEASNGLSNKRGTLAMARTADPHSASSQFFINVADNTFLDYRAKEMFGKTVIQEWGYAVFGEVTEGMEVIDKIKAVKTGNKGFHQDVPVEDIVIESVTVA

SEQ ID NO: 20988 - protein, 459 aa, Haemophilus ducreyi 35000HP
MAKAAKTAYVCNDCGAEYSRWMGQCRECKAWNTISEIRLISSKEMNKNDRFSGYAGETSGKIQRLADISLQEVPRFSSGFNELDRVLGGGIVPGSAILIGGHPGAGKSTLLLQVMCGLSKQHSALYVTGEESLQQVAMRANRLGLPTEHLKMLSETSVEHICNIADQEKPKIMVIDSIQVMHLADIQSSPGSVSQVRECASFLTRYAKMQQVAIIMVGHVTKDGTLAGPKVLEHCIDASILLEGEADSRFRTLRSQKNRFGAVNELGVFAMTEQGLREVKNPSAIFLSRSEEQTPGSSVMVLWEGTRPLLVEIQALVDHSMLANPRRVAVGLDHNRLSLLLAVLHRHGGLQMSDQDVFVNVVGGVKVTETSADLALILALISSFRNRALPRDLVVFGEVGLAGEIRPVPSGQERMSEATKHGFRRAIIPYGNMPKKTIQGMEIFAVKTLSQTLDILANL

SEQ ID NO: 20989 - protein, 260 aa, Haemophilus ducreyi 35000HP
MQNTLKGACIAECIGTGLLIFFGVGCVAAAQLAGATLGLWEISIIWGIGVALAVYATAGVSGAHLNPAVTIALWKFACFDGKKVLPYIIAQCLGAFLAAALVYFLYKDLFIVAETAKNIVRGESVGFASVFSTYPNPNISVLQAFFVETVITMVLMGLILALTDDGNGLPKGPIAPFLIGLLIATLGGAFGPLTGFAMNPARDFGPKVFAFLAGWGEVAFTGAREIPYFIVPIFAPIIGALLGAWGYQRFIGKNLPCNCK

SEQ ID NO: 20990 - protein, 478 aa, Haemophilus ducreyi 35000HP
MFGPFKPSPHITELPSNKIDARYKFLRWQVFAGIFFGYAAYYFVRANFDLAQKGLIEAGLYNKAELGIIGTSAGLAYGLSKFVMAGISDRSNPKVFLPFGLLLSDLCMTMMGLMPWVTSGIAVIFIMIFLNGWFQGMGCGRTMVHWWSKSERGTIVSIWNCAHNVGGMVPGAMVLLASAIYFSNTGEHATAKDVWQQALYYPGIAAMIAAIPVYLVMKDTPQSCGLPPIEKWKNDYPDDYDEKTAEQDLTTKEIFVNYVLKNKLLWYIAIANVFVYLIRYGILKWSPVYLGEVKHFNIKGTAWAYTIYELAAIPGTLLCGWISDKVFKGKRGLTGFIFMILTTIAVIALWKNPATPEAELAQYAGRPFYDNPYQLMDFTLMTTVGFLIYGPVMLIGLHALELAPKKAAGTSAGFTGLFGYLGGTVSASAVVGWAAEYYGWDGGFYVMITGGILAVLLMFIVMVEEGKHKAKLEDHYGK

SEQ ID NO: 20991 - protein, 179 aa, Haemophilus ducreyi 35000HP
MKKHHIESLISRKEVQTRIAELAEQINNHYQQTNCQNLVVVGLLRGSFMFMADLVRLIDIPVEVDFMTVSSYGSSTESSRDVKILKDLEGEINGKDVLIVEDIIDTGFTLNKVRDILRLRDPRSVSICTLLDKPSRREVAVPVEWVGFAIPDEFVVGYGIDYAQKYRNLDFIGKVVMDE

SEQ ID NO: 20992 - protein, 487 aa, Haemophilus ducreyi 35000HP
MLRIKQEALTFDDVLLVPAHSTVLPNTADLSTQLTKTIRLNIPMLSAAMDTVTETKLAISLAQEGGIGFIHKNMSIERQADRVRKVKKFESGIVSEPVTVSPELTLAELAQLVKKNGFAGYPVVDNENNLVGIITGRDTRFVQDLTQTVSKVMTHRDRLVTVKENAKREEILALMHEHRVEKVLMVDDAFKLKGMITVKDFQKAEQKPNACKDEFGRLRVGAAVGAGPGNEERIDALVKAGIDVLLIDSSHGHSEGVLQRVRETRAKYPDLPIVAGNVATAEGAIALADAGASAVKVGIGPGSICTTRIVTGVGVPQITAIAEAAEALKDRDIPIIADGGIRYFGDISKAIAAGASCVMVGSMFAGTEEAPGEIELYQGRVFKSYRGMGSLGAMSKGSSDRYFQSDNAADKLVPEGIEGRIPYKGYLKEIIHQQMGDLRSCMGLTGSATIEDLRTKAQFVRISGAGIKESHVHDVTITKEAPNYHMG

SEQ ID NO: 20993 - protein, 474 aa, Haemophilus ducreyi 35000HP
MSKEIKTQVVVLGAGPAGYSAAFRCADLGLETVIVERYSTLGGVCLNVGCIPSKALLHVAKVIEEAKHADKNGITFGEPIIDLDKVRKGKEAVVSKLTGGLAGMAKARKVTVVEGLAAFTDSHTLVARDRDGNPTTIKFDNAIIAGGSRPIELPFIPHEDPRIWNSTDALKLKEIPKKLLIMGGGIIGLEMGTVYQSLGSEIEVVEMFDQVIPAADKDVVSIYSKQVEKKFKLMLETKVTAVKAEDDGIYVSMEGKACNDTKRYDAVLVAIGRVPNGKLIDVGKAGVEVDERGFIHTDKQMRTNVPHIFAIGDVVGQPMLAHKGVHEGHVAAEVIAGKKRYFDPKVIPSIAYTEPEVAWVGKTEKECKQEGLNYEVAKFPWAASGRAIASECSEGMTKLIFDKDTHRLLGGAIVGSNGGELLGEIGLAIEMGCDAEDIALTIHAHPTLHESVGLAAEVFEGSITDLPNAKAKKR

SEQ ID NO: 20994 - protein, 227 aa, Haemophilus ducreyi 35000HP
MELVFIRHGFSEWNAKNLFTGWRDVNLTERGVEEAKAAGQKLLAAGYEFDIAFTSVLTRAIKTCNIVLEESNQLWIPQVKHWRLNERHYGELQGLDKKATAEKYGDEQVHIWRRSYDTLPPLLAPSDPNSAHNDRRYAHLPKEVVPNGENLKVTLERVLPFWEDQIAPALLSGKRVLVTAHGNSLRALAKHIIGISDAEIMDFEIPTGQPLVLKLDSKLNFIEKFYL

SEQ ID NO: 20995 - protein, 462 aa, Haemophilus ducreyi 35000HP
MHPKIHGGILGRRGLDDATMQQHNIQPIDMVVVNLYPFAETVARPDCSLADAIENIDIGGPTMVRSAAKNHKDVAIVVNNHDFEAILTEMDENANELTLATRFNLAIKAFEHTAQYDAMIANYFGQKVPPYQGVEEDLNQVCGQFPRTLNLNFIRKQTMRYGENAHQNAAFYVENNLQEASVATAKQLQGKVLSYNNIADTDAALECVKEFAEPACVIVKHANPCGVALGKDILEAYDRAYQTDPTSAFGGIIAFNRALDAKTAQAVVDRQFVEVIIAPTVLEEAQLILAQKKNVRVLACGEFSVASQRLDFKRVNGGLLVQEADQDIVTLDQLKVVSKRQPTQAELDDLLFCWKVAKYVKSNAIVYAKNGQTIGIGAGQMSRVYSAKIAGIKAEDEGLQVTGCVMASDAFFPFRDGIDAANKVGISCVIQPGGSMRDQEVIDAVNEHGMAMVLTGMRHFRH

SEQ ID NO: 20996 - protein, 433 aa, Haemophilus ducreyi 35000HP
MSLFKFEERGSSARQEIIAGLTTFLAMVYSVIVVPGMLSQAGFPAESVFIATCLVSGLGSIIIGLWANVPMAIGCAISLTAFTAFSLVLGQGISIPVALGAIFLMGLIFTLISITGVRAWILRNLPISIAHGAGIGIGLFLLLIAANSVGLVVSNQAGLPVKMGDFTSFPVMMALLGLTAIIGLERLKVKGSILWVIIAITVIGLIFDPNVNYTGFFKMPSFGDSSQFLNLNISGALNTAILPVVFALVMTAIFDATGTIRAVAGQANLLDKDGQIINGGRALTADSFGSILAGLFGTAPAAVYIESAAGTAVGGKTGLTAVVVGIGFLLMLFFQPLAFLVPGYATAPALMYVGLLMLSNVSKLDFNDFISAMAGLVCAVFIVLTANIVTGIMLGFSTLVIGRIIAGEFKQLNIGTIFIAIALVAFYAFDLAI

SEQ ID NO: 20997 - protein, 244 aa, Haemophilus ducreyi 35000HP
MLKNKLSTLALVVGTLFASQATFAEKADQAFVNDSSYAVGVLMGKNIQGVIESQKEVFSYNQEKILVGVQDTLKKTGKLTDEELQKQLKALDTYLAKQESKIAAEKSKATKEAGDKFRAEYEKKAGVKKTASGLLYKIEKAGTGASPKAEDIVIAHYKGTLPDGTVFDSSYERNEPIELQLKQLIPAWIEAIPMLKKGGKMEIVAPPKLAYGDRPSGKVPANATLKFEIELLDFKPTAAQPKKK

SEQ ID NO: 20998 - protein, 224 aa, Haemophilus ducreyi 35000HP
MAQQPFLIAPSILSADLARLGDDVNQVLTAGADIIHFDVMDNHFVPNLTFGPMICQALRNYGITAEIDVHLMVKPVERIIPDFAKAGANYITFHPEATDHIDRTLQLIHQYGCKAGLVFNPATPLHYLDYVIDKIDMILLMGVNPGFGGQTFIPSTLTKLREVRQRIDASGKSIRLEIDGGVKIDNIAEIAAAGADTFVAGSAIFDQQNYKSVIDQMRAELSKI

SEQ ID NO: 20999 - protein, 240 aa, Dactylis glomerata
IPKVPPGPNITATYGDKWLDAKSTWYGKPTGAGPKDNGGACGYKDVDKAPFNGMTGCGNTPIFKDGRGCGSCFEIKCTKPESCSGEAVTVHITDDNEEPIAPYHFDLSGHAFGSMAKKGEEQKLRSAGELELQFRRVKCKYPEGTKLTFHVEKGSNPNYLALLVKYVDGDGDVVAVDIKEKGKDKWIALKESWGAIWRVDTPDKLTGPFTVRYTTEGGTKSEVEDVIPEGWKADTSYEAK

SEQ ID NO: 21000 - protein, 264 aa, Dactylis glomerata
MASSSSSVLLVVALFAVFLGSAHGIPKVPPGPNITATYGDKWLDAKSTWYGKPTGAGPKDNGGACGYKDVDKAPFNGMTGCGNTPIFKDGRGCGSCFEIKCTKPESCSGEAVTVHITDDNEEPIAPYHFDLSGHAFGSMAKKGEEQKLRSAGELELQFRRVKCKYPEGTKVTFHVEKGSNPNYLALLVKYVDGDGDVVAVDIKEKGKDKWIALKESWGAIWRVDTPDKLTGPFTVRYTTEGGTKSEVEDVIPEGWKADTSYEAK

SEQ ID NO: 21001 - protein, 380 aa, Dianthus caryophyllus
MSSTAGQVIRCKAAVAWEAGKPLVIEEVEVAPPQKMEVRVKILFTSLCHTDVYFWEAKGQTPVFPRILGHEAGGIVESVGEGVTELQPGDHVLPVFTGECKECAHCKSEESNMCDLLRINTDRGVMLADGKSRFSINGKPIYHLVGTSTFSEYTVTHVGCLAKINPKAPLDKVCILSCGISTGFGATVNVAKPKKGQTVAIFGLGAVGLAAAEGARVSGASKIIGVDLIPARFEAAKKFGVTDFVNPKDHDKPVQEVIVEMTNGGVDRSVECTGNIQAMISAFECVHDGWGVAVLVGVPNKDDAFKTHPMNFLNERTLKGTFFGNYKPRTDIPKVVEKYMNKEMELDKFITHEISFKDINKAFEMMARGEGIRCIIRMDA

SEQ ID NO: 21002 - protein, 377 aa, Porphyra purpurea
MAFVSTASPAVVGRSPSPALCGARSTFATGAPVVAPSAPRAVAAGMSAAMMSAAAMNKKAPVADATGLIGNTPLVQLHKIPDAAGCVANIFAKLESMEPCSSVKDRIGRGMIMDAEAAGKITPGKTVLVEPTSGNTGIALAFIAASKGYKLILTMPDSMSIERRMVLRAFGAEVVLTPAAGGMKTAVSKAEAIAAETPDSYILQQFANPSNPKAHYETTGPEIANAIDCDVFVSGVGTGGTITGAGRYLKEKNPETRVVAVEPVESPVLSGGKPGPHKIQGIGAGFVPAILDTTVYDEVVTVTSAESITMARRIALEEGLLSGISTGAALAAALEVGKRPEMQGKNIVFIAPSFGERYLTSALFDEQREEAYAMKAE

SEQ ID NO: 21003 - protein, 208 aa, Oryza sativa (japonica cultivar-group)
MASYHQQQGGSTFMAIPTINFQMYSEIAGDDEWWEYIPCPFCYIEVEVHFLCDHLQEEHCFDMKNAVCPICADNLDKDTDEHFRVQHSHLLKRRKSSSFSCKPSSAAADKGSYEEDSYFEAPSHCMGRPAPDSSPDPLLSQFICCSLAPPVDSPRRSEADAEGHGSSSSDDQKRREQGVMDDASKEELEERLQRIEFVKQMLMTTIAY

SEQ ID NO: 21004 - protein, 464 aa, Mycosphaerella graminicola
MAKLYQNVDSAQLQRDADDCLLTYGTDFHPEIITNAEGQSITTASGHRMLDWTSGQMSTLIGHANPEIVETIHAHARNLDHLFSGMLSPPVISLAKRLTSVTPPGLDKALFLSTGGESNEAAIRLAKFYTGKFEIVGLASSWHGVTSGAIAAQYHAGRAGYGPNMPGNIALPTPNSYRSIFRHPDGSHDWKTELEYGFDLVDKQSCGSLAALILEPILSSGGMLVLPPGYLKAVKQHCERRGMLLIIDEAQTGIGRAGDMFAFQHFAEDDGVVPDILTLSKTLGNGLPLSAVVTSNKIASFAKENNFLFYTTHINDPLPAAVGDKVLEIVIRDHLVERSREMGKVFQERLRALQSRYGCIGDVRGRGLMAGVEIVADRVTKEGDIDLGAAIGKRMTENGLWAQLSTMASFGGVFRLAPPLTTTDEELMAGLDIIEEAFASTPGTKPLYERDVAAAYDSQVDARL

SEQ ID NO: 21005 - protein, 398 aa, Thermotoga maritima
EKMTIRDVDLKGKRVIMRVDFNVPVKDGVVQDDTRIRAALPTIKYALEQGAKVILLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKADRILIGGAMMFTFLKALGKEVGSSRVEEDKIDLAKELVEKAKEKGVEIVLPVDAVIAQKIEPGVEKKVVRIDDGIPEGWMGLDIGPETIELFKQKLSDAKTVVWNGPMGVFEIDDFAEGTKQVALAIAALTEKGAITVVGGGDSAAAVNKFGLEDKFSHVSTGGGASLEFLEGKELPGIASMRIKKA

SEQ ID NO: 21006 - protein, 416 aa, Glomus mosseae
MSLSNKLSIRDLNVKDKRVLIRVDFNVPLDGTTITNNQRIVAALPTIKYALEQKAKTVVLMSHLGRPDGKKVDKYSLAPVAKEVERLLGKKVTFLEDCVGEGVENYVKNACDGEVILLENLRFHAEEEGSSKGPDGKKVKADLEKVKEFRRSLTALGDVYINDAFGTAHRAHSSMVGVELPQKAAGFLVKKELEYFAKALESPERPFLAILGGAKVSDKIQLIDNLIAKVDSLIICGGMAFTFKKTLENVKIGNSLFDADGAKTVGEVMEKAKKHDVEVVLPVDYITADKFAKDAQVGYATDQEGIPDGWMGLDCGEKSVELYKQTIAKAKTILWNGPAGVFEFDNFAKGTKATLDCAVEAAQSGKIVIIGGGDTATVAAKYGVEDKLSHVSTGGGASLELLEGKDLPGVSALSSK

SEQ ID NO: 21007 - protein, 479 aa, Streptomyces coelicolor A3(2)
MSTELRRLRNYIDGEFRDAADGRTTEVVNPATGEAYATAPLSGQADVDAAMAAAAAAFPAWRDLVPAERQKALLKIADAFEERAEELIAAEVENTGKPIGLTRSEEIPPMVDQIRFFAGAARMLEGRGAGEYMEGLTSFVRREPIGVCAQVAPWNYPMMMAVWKFAPALAAGNTVVLKPSDTTPASTALMADIIGSIVPKGVFNVVCGDRDTGRLMVEHETPAMASITGSVRAGMSVAESASKDLKRVHLELGGKAPVVVFEDTDIPKAVEGISEAGYFNAGQDCTAATRVLVHESVHDEFVSALAKAASEIKTGQPDDEDVMYGPLNNPNQLKQVSGFIERLPAHAKVEAGGHRVGDKGYFYAPTVVSGLKQDDEIIQREVFGPVITVQAFRDEDQAVEWANGVEYALASSVWTKDHGRAMRMSKKLDFGCVWINTHIPLVAEMPHGGFKKSGYGKDLSGYGFEDYTRIKHVMTSLDM

SEQ ID NO: 21008 - protein, 457 aa, Streptomyces coelicolor A3(2)
MSTDSPKDLSRTAYDHLWMHFTRMSSYENAPVPTIVRGEGTHIYDDKGRRYLDGLAGLFVVQAGHGRQELAETASKQAQELAFFPVWSYAHPKAVELAERLANEAPGDLNKVFFTTGGGEAVETAWKLAKQYFKLTGKPTKYKVISRAVAYHGTPQGALSITGLPALKAPFEPLVPGAHKVPNTNIYRAPIHGDDPEAYGRWAADQIEQQILFEGPETVAAVFLEPVQNAGGCFPPPPGYFQRVREICDQYDVLLVSDEVICAFGRLGTTFACDKFGYVPDMITCAKGMTSGYSPIGACVISDRLAEPFYKGDNTFLHGYTFGGHPVSAAVGIANLDLFEREGLNQHVLDNEGAFRATLEKLHDLPIVGDVRGNGFFYGIELVKDKATKESFDEEETERVLYGFLSKKLFENGLYCRADDRGDPVIQLAPPLISNQETFDEIEQILRATLTEAWTKL

SEQ ID NO: 21009 - protein, 478 aa, Streptococcus pneumoniae
MDDNGYDIADYQAIAAIFGTMEDMDQLIAEAKKRDIRIIMDLVVNHTSDEHAWFVEACENTDSPERDYYIWRDEPNDLDSIFSGSAWEYDEKSGQYYLHFFSKKQPDLNWENEKLRQKIYEMMNFWIDKGIGGFRMDVIDMIGKIPDEKVVNNGPMLHPYLKEMNQATFGDKDLLTVGETWGATPEIAKLYSDPKGQELSMVFQFEHIGLQYQEGQPKWHYQKELNIAKLKEIFNKWQTELGVEDGWNSLFWNNHDLPRIVSIWGNDQEYREKSAKAFAILLHLMRGTPYIYQGEEIGMTNYPFETLDQVEDIESLNYAHEALEKGVPIEEIMDSIRVIGRDNARTPMQWDESKNAGFSTGQPWLAVNPNYEMINVQEALANPDSIFYTYQKLVQIRKENSWLIRADFELLDTADKVFAYIRKDGDRRFLVVANLSNEEQDLTVEGKVKSVLIENTLAQEVFEKQILVPWDAFCVELL

SEQ ID NO: 21010 - protein, 331 aa, Treponema pallidum subsp. pallidum str. Nichols
MRCVVFNLREEEAPYVEKWKQSHPGVVVDTYEEPLTAKNKELLKGYEGLVVMQFLAMEDEVYDYMGACKLKVLSTRTAGFDMYNATLLKKHGIRLTNVPSYSPNAIGEYALAAALQLTRHAREIETFVRKRDFRWQKPILSKELRCSRVGILGTGRIGQAAARLFKGVGAQVVGFDPYPNDAAKEWLTYVSMDELLSTSDVISLHMPATKDSHHLINAKTIAQMKDGVYLVNTARGAVIDSQALLDSLDKGKIAGAALDAYEFEGPYIPKDNGNNPITDTVYARLVAHERIIYTPHIAFYTETAIENMVFNSLDACTTVLRGEPCAAEIKL

SEQ ID NO: 21011 - protein, 251 aa, Treponema pallidum subsp. pallidum str. Nichols
MKLVLIRHGESEWNRLNLFTGWTDVPLTPRGESEAQEGGRVLQEAGFDFDLCYTSFLKRAIRTLNFVLQALDREWLPVHKSWKLNERHYGDLQGLNKTETAQKYGEQQVRVWRRSFDVAPPPLTVGDARCPHTQASYRGVCASGRTPVLPFTESLKDTVARVVPYFEEEIKPQMISGQRVLIVAHGNSLRALMKHIESLDETQIMEVNLPTGVPLVYEFEADFTLCGKRFLGNEADVAARAQAVADQGKSN

SEQ ID NO: 21012 - protein, 488 aa, Treponema pallidum subsp. pallidum str. Nichols
MGADIGFIGLAVMGENLVLNIERNGFSVAVFNRTTTVVDRFLAGRAHGKRITGAHSIAELVSLLARPRKIMLMVKAGSAVDAVIDQILPLLEKGDLVIDGGNSHYQDTIRRMHALEAAGIHFIGTGVSGGEEGALRGPSLMPGGSAQAWPLVSPIFCAIAAKADDGTPCCDWVGSDGAGHYVKMIHNGIEYGDMQIIAEGYWFMKHALGMSYEHMHHTFTRWNTGRLHSYLIEITAAILAHQDTDGTPLLEKILDAAGQKGTGRWTCVAALEEGSPLTLITESVMARSLSAQKQARCKAHRVFGSPVKVSKAETLSAQQREELVSALEDALYCAKIVSYAQGFELLSHTAKRRGWTLDFSRIASLWRGGCIIRSGFLSKISAAFAQQHDLENLVLAPFFAEELKRACPGWRTIVAESVRQALPVPALSAALAWFDGFTGAALPANLLQAQRDYFGAHTYERTDAPRGEFFHTNWTGTGGDTIAGTYSI

SEQ ID NO: 21013 - protein, 249 aa, Treponema pallidum subsp. pallidum str. Nichols
MRGYFIAGNWKMHKTCAEAVALAQELVRELRGGPHTYMIAPSFTALDAVGKVLRGSNVLLGAQDVSSEEWGAHTGEVSVLQLEDLGVQVVIVGHSERRHGRGENDKLINQKVRRVLESGLRVILCVGERLQEYEAGCTNEVVGTQVRAGMADVCGSLMHNVTVAYEPVWAIGTGKTATPAQANAVHAHIRSVVREMYGAAIAEALCIQYGGSMKAENARALLAEEHIDGGLIGGASLEAASFVPIARSV

SEQ ID NO: 21014 - protein, 419 aa, Treponema pallidum subsp. pallidum str. Nichols
MMLRTCKDVTMRGERVVVRVDFNVPMRDGMVQDDTRVTAAVPTLRYIIEQGPRHVVLISHLGDPTRDADKAEGNAKKDGCPFDRHAFINGKHRLKPVADCLAKKLGVPVHFAPSCVGQREFIEGLPDGSVVLLENVRFHPEETSGDAKVQEQFARELAQYGDIFVNDAFGTAHREHASTVVLPRLMRRRVAGLLIEREVRYLEPMVCNPKVPMVAVVGGAKVSSKIAVLESLLRTSTALIIGGGMAYTFLKAQGVGVGTSLVEDDFIDTARMLLQKAQSGGVSVVLPVDHVCASTFCADAQPVAVDDVHIPMHLMGMDVGPRTLEQYRAHLKGVSSVLWNGPVGVFEFDAFAHGTRVLAQLIAEATDAGATSVVGGGDSIAAVSKFGLASRMSHVSTGGGASLKLFEGKVLPGISCLET

SEQ ID NO: 21015 - protein, 211 aa, Treponema pallidum subsp. pallidum str. Nichols
MRFVFLGPPGAGKGTLAGEISGRCGVVHISTGGILRAAIQKQTALGKKVQKVVEVGGLVDDQTVTELVRERVSHEDVVSGFILDGFPRTVTQARCLEDIVPIDYAVSIVVPDDVLVARLTGRRVCSACGSSYHVLFAQPKREGVCDRCRGVLVVREDDKMSAILQRLTAYRAQAEPIVHFYSERGKLVSLNGAPPISDVVLEFQERFAQSR

SEQ ID NO: 21016 - protein, 493 aa, Treponema pallidum subsp. pallidum str. Nichols
MKTSALFLDFYELTMAQGYFFHKPHECAVFEVFFRKHPFAGGYSIFAGLDPLLTAIEQFRFSGEDIDYLRTLHLFHDDFLSYLASFRFSGDIHALEEGSVIFPHEPIIRVHARLVEALLLEGLILNTINFQSLIATKTARMWRASGEGVLMEFGLRRAQGYDGALSATRAAAIGGATGTSNTLAAKLYGIRPMGTMAHAWVMSFDSEEEAFERYAALYGSASVFLIDTYHTLESGIQNAIAIGTRLKAAGKSFGVRLDSGDMQYLSVQVRAALDAAGLPEARIAVSNELDETIIESLVLSGAPIDAWGVGTHLVTGGADSAFTGVYKMSARATTQPAHTQHGHAASQRLPHWDDAHWLPVMKVSDNPAKTTTPGIKQVWRLYDAAGQYKADVIGLADEVIEPQVAQRYIHPFYNLQSFTFAAHQVEPLLRTVMQAGNRLRAGESVQEIHARMRAQLQRLDKSYVRLLNPHVYKVSLTERLAQLKNTLITALRR

SEQ ID NO: 21017 - protein, 432 aa, Treponema pallidum subsp. pallidum str. Nichols [sequence omitted]

SEQ ID NO: 21018 - protein, 264 aa, Treponema pallidum subsp. pallidum str. Nichols
MILKKEAAGVCSFALLLLAGMSIFSCRKGAEGVSSAGEAADKKALTADQLDPRKVQEQERQKTPLSKKSVGYAFGVLMGVTLQDSKLDVDLGQVWKGLKKTVSADKDKQALADAQDVLQRAFEAYRQKEVEKNSQEAKAFLEENAKKPGVQVTSSGLQYEVVKAADGPKPQGGQRVRTQYKGTLLDGTVFDASRDKPAEFPVDGMVPGVSEGLKLMPVGSTYRFYVPSSLGYGERGIEGVIPPGALLVFEIELQEILPDSASKK

SEQ ID NO: 21019 - protein, 445 aa, Treponema pallidum subsp. pallidum str. Nichols
MKIVIIGANHAGTACVNCLTDLTTTNEVVVFDRNNNISFLGCGMALWIGGQIRGSEGLFYANKEQLEKKGARVSMESDITRIDFASKKVYGTARDGSAIAESYDKLIIATGSLPIIPKIDGMDLENVQRIKLFQDAEAVIKKLEQPSIKNIAVIGAGYIGVELAEAFERHQKKVTLIDAMDSSLSNYYDASFRALMDENLRSHHITLAFGQKVQKLRGSNGKVVAVVTDKGEYPADMVMVCIGFSPNTALGKNEVRTFANGAYAVDLKQETSVKDVYAIGDCATVFDNSLGQTSYIALATNAMRSGIVAAHNAAGFPLEGIGVQGSNGINIYDLKMVSTGVTQERAARMGLEVEVTDFEDSQLPAFMEVDNHPVKIRIVFDKKTRVIVGAQMASRHDMSMGIHLFSLAIQERVTIDKLKLLDMFFLPHFNKPYNYVTMAALRARS

SEQ ID NO: 21020 - protein, 218 aa, Treponema pallidum subsp. pallidum str. Nichols
MERSFTLAPSLLSADFSALDRALVYLEAHGAQWVHLDVMDGHFVPNLTFGAPVLRCLRSKTHLPFDVHLMVSRPADLIEDFVQAGADFLTFHIEAEVHAHRLIHAIRGRGVKVGISLVPSTPVAALSEVLPFVDLVLVMTVNPGFSGQQMIAHCLSKVSALVQMRTERGYSYMISVDGGIDCRTLPQALDAGADVIVSGSAFFSGTLRSLLCKDSSGA

SEQ ID NO: 21021 - protein, 455 aa, Treponema pallidum subsp. pallidum str. Nichols
MAKKTERAFSCVGCGYVHPKWLGRCPECGEWNSFEETPSLSSGDVRAVKKASSSPVQAFPLCAVRAQDAQRISCGIAEFDRVLGGGAVRRSAIMIGGEPGIGKSTLLLQIAAACGKSVLYVSGEESPGQIRGRADRLNIPIQNIELLCATRVEDVERVLNTRCPTFVIVDSIQTVFSPEAGAIPMTINQLKYCANELIAWVKERDSVLFFTAHVTKDGNIAGPKVVEHMVDTVISFERNEEDIRFLRALKNRFGSVDELGIFTMGENGLSAVQDTAGFFISTRQGMFPVGSATVPVCEGSRVFMVEIQALTVPAKSSVTRVFSDRIDSARVSRVAAVIEKRVGLKFSDQDIYVNVAGGIRLYEPAVDVALAMALYSARQNTPVKTNAAFIGEVSLSGEIRPVRRLKTRLKTAYGLGFSTIYVPIGVEHDTPPPYTLRVVGTLAQTIAEIFSKAKA

SEQ ID NO: 21022 - protein, 379 aa, Colwellia maris
MSKRDYYETLEVSQDASEKEIKKAYKKLAMKYHPDRTQGDKSKEETFKEVKEAYEILNDDQKRAAYDQYGHAAFEQGGHGGGGGGHGGGFGQDFGDIFGDIFGGGGGGGRGRQRQQRGSDLRYNVELSLEDAVKGKSLEIKVPTYVSCEPCDGSGAKKGTSAKTCSTCHGHGQVQMRQGLFAVQQTCPTCSGKGKVIADKCTSCRGQGRVEKTKTLSVKIPAGVDTGDRIRLSGEGEAGEHGAPAGDLYVQVNVRDHDIFVRDENHLYCEVPISFVTASLGGEIEVPTLGGKVKLKVPKETQTGKMFRLRGKGVKSVRSTSTGDLMCKVVIETPVNLSGDQADLLRQLEEKMASSSKKHSPKETGFFDGVKKFFDDLKS

SEQ ID NO: 21023 - protein, 392 aa, Chlamydophila pneumoniae TW-183
MDYYSILGISKTASAEEIKKAYRKLAVKYHPDKNPGDAAAEKRFKEVSEAYEVLSDPQKRDSYDRFGKDGPFAGAGGFGGAGGMGNMEDALRTFMGAFGGEFGGGSFFDGLFGGLGEAFGMRSDPAGARQGASKKVHINLTFEEAAHGVEKELVVSGYKSCETCSGQGAVNPQGIKSCERCKGSGQVVQSRGFFSMASTCPECGGEGRIITDPCSSCRGQGRVKDKRSVHVHIPAGVDSGMRLKMEGYGDAGQNGAPSGDLYVFIDVESHPVFERRGDDLILELPIGFVDAALGMKKEIPTLLKTEGSCRLTVPEGIQSGTILKVRNQGFPNVHGKGRGDLLVRISVETPQNLSEEQKELLRTFASTEKAENFPKKRSFLDKIKGFFSDFTV

SEQ ID NO: 21024 - protein, 453 aa, Chlamydophila pneumoniae TW-183
MATKTKTQWTCNQCGATAPKWLGQCPGCHNWNSLVEEYVPQARSGTSSRSSTSAIALSSIELENESRIFIDHAGWDRILGGGVVRGSLTLLGGDPGIGKSTLLLQTAERLASQKYKVLYVCGEESVTQTSLRAKRLNISSPLIYLFPETNLDNIKQQIATLEPDILIIDSIQIIFNPTLNSAPGSVAQVREVTYELMQIAKSAQITTFIIGHVTKSGEIAGPRVLEHLVDTVLYFEGNSHANYRMIRSVKNRFGPTNELLILSMHADGLKEVSNPSGLFLQEKTGPTTGSMIIPIIEGSGALLIELQALVSSSPFANPVRKTAGFDPNRFSLLLAVLEKRAQVKLFTMDVFLSITGGLKIIEPAADLGALLAVASSLYNRLLPNNSIVIGEVGLGGEIRHVAHLERRIKEGKLMGFEGAILPEGQISSLPKEIRENFRLQGVKTIKDAIRLLL

SEQ ID NO: 21025 - protein, 308 aa, Chlamydophila pneumoniae TW-183
MRLFSYDKPKIKVQKIKADGFSGWLKCNHCHEMIHANELGQNYNCCPKCSYHYRITAIERVKLLADKDSWRPLYTDLKSQDPLEFIDTDTYANRLEKARKNTTESEGVIVGICTIGLHPVALAVMDFNFMAGSMGAVVGEKLTRLIEEAIETRLPVIIVSASGGARMQESVFSLMQMVKTSAALAKLHEAGLPYISVLTNPTSGGVTASFAALGDIIIAEPKALICFAGPRVVAQVIGEDLPEGAQKSEFLLEHGMIDKIVERKELKTTLQTLLDYFLAQEYTGGKSKAPRDLSKRLKEIFLLTDDSE

SEQ ID NO: 21026 - protein, 484 aa, Chlamydophila pneumoniae TW-183
MITRTKIICTIGPATNSPEMLAKLLDAGMNVARLNFSHGSHETHGQAIGFLKELREQKRVPLAIMLDTKGPEIRLGNIPQPISVSQGQKLRLVSSDIDGSAEGGVSLYPKGIFPFVPEGADVLIDDGYIHAVVVSSEADSLELEFMNSGLLKSHKSLSIRGVDVALPFMTEKDIADLKFGVEQNMDVVAASFVRYGEDIETMRKCLADLGNPKMPIIAKIENRLGVENFSKIAKLADGIMIARGDLGIELSVVEVPNLQKMMAKVSRETGHFCVTATQMLESMIRNVLPTRAEVSDIANAIYDGSSAVMLSGETASGAHPVAAVKIMRSVILETEKNLSHDSFLKLDDSNSALQVSPYLSAIGLAGIQIAERADAKALIVYTESGSSPMFLSKYRPKFPIIAVTPSTSVYYRLALEWGVYPMLTQESDRAVWRHQACIYGIEQGILSNYDRILVLSRGACMEETNNLTLTIVNDILTGSEFPET

SEQ ID NO: 21027 - protein, 440 aa, Chlamydophila pneumoniae TW-183
MLNCSNQKHTVTFEEACQVFPGGVNSPVRACRSVGVTPPIVSSAQGDIFLDTHGREFIDFCGGWGALIHGHSHPKIVKAIQKTALKGTSYGLTSEEEILFATMLLSSLKLKEHKIRFVSSGTEATMTAVRLARGITNRSIIIKFIGGYHGHADTLLGGISTTEETIDNLTSLIHTPSPHSLLISLPYNNSQILHHVMEALGPQVAGIIFEPICANMGIVLPKAEFLDDIIELCKRFGSLSIMDEVVTGFRVAFQGAQDIFNLSPDITIYGKILGGGLPAAALVGHRSILDHLMPEGTIFQAGTMSGNFLAMATGHAAIQLCQSEGFYDHLSQLEALFYSPIEEEIRSQGFPVSLVHQGTMFSLFFTESAPTNFDEAKNSDVEKFQTFYSEVFDNGVYLSPSPLEANFISSAHTEENLTYAQNIIIDSLIKIFDSSAQRFF

SEQ ID NO: 21028 - protein, 246 aa, Chlamydophila pneumoniae TW-183
MEAGANVLVIDTAHAHSKGVFQTVLEIKSQFPQISLVVGNLVTAEAAVSLAEIGVDAVKVGIGPGSICTTRIVSGVGYPQITAITNVAKALKNSAVTVIADGRIRYSGDVVKALAAGADCVMLGSLLAGTDEAPGDIVSIDEKLFKRYRGMGSLGAMKQGSADRYFQTQGQKKLVPGGVEGLVAYKGSVHDVLYQILGGIRSGMGYVGAETLKDLKTKASFVRITESGRAESHIHNIYKVQPTLNY

SEQ ID NO: 21029 - protein, 229 aa, Chlamydophila pneumoniae TW-183
MKKQESVLVGPSIMGADLTCLGVEAKKLEQAGSDFIHIDIMDGHFVPNLTFGPGIIAAINRSTDLFLEVHAMIYNPFEFIESFVRSGADRIIVHFEASEDIKELLSYIKKCGVQAGLAFSPDTSIEFLPSFLPFCDVVVLMSVYPGFTGQSFLPNTIEKIAFARHAIKTLGLKDSCLIEVDGGIDQQSAPLCRDAGADILVTASYLFEADSLAMEDKILLLRGENYGVK

SEQ ID NO: 21030 - protein, 213 aa, Chlamydophila pneumoniae TW-183
MTKGSVFIIMGPPGSGKGTQSQYLANRIGLPHISTGDLLRAIIREGTPNGLKAKAYLDKGAFVPSDFVWEILKEKLQSQACSKGCIIDGFPRTLDQAHLLDSFLMDVHSNYTVIFLEISEDEILKRVCSRFLCPSCSRIYNTSQGHTECPDCHVPLIRRSDDTPEIIKERLTKYQERTAPVIAYYDSLGKLCRVSSENKEDLVFEDILKCIYK

SEQ ID NO: 21031 - protein, 479 aa, Chlamydophila pneumoniae TW-183
MQTNIGLIGLAVMGKNLVLNMIDHGFSVSVYNRTPEKTRDFLKEYPNHRELVGFESLEDFVNSLERPRKIMLMIQAGKPVDQSIHALLPFLEPGDVIIDGGNSYFKDSERRCKELQEKGILFLGVGISGGEEGARHGPSIMPGGNPEAWPLVAPIFQSIAAKVQGRPCCSWVGTGGAGHYVKAVHNGIEYGDIQLICEAYGILRDFLKLSATAVATILKEWNTLELESYLIRIASEVLALKDPEGIPVIDTILDVVGQKGTGKWTAIDALNSGVPLSLIIGAVLARFLSSWKEIREQAARNYPGTPLIFEMPHDPSVFIQDVFHALYASKIISYAQGFMLLGEASKEYNWGLDLGEIALMWRGGCIIQSAFLDVIHKGFAANPENTSLIFQEYFRGALRHAEMGWRRTVVTAIGAGLPIPCLAAAITFYDGYRTASSSMSLAQGLRDYFGAHTYERNDRPRGEFYHTDWVHTKTTERVK

SEQ ID NO: 21032 - protein, 421 aa, Chlamydophila pneumoniae TW-183
MAIQKAGAFLRCLPSESRPYLEHAMRRNPHFSLLKPQYLFSEISKKLAQFRKENPEISVIDLSIGDTTQPLCRSITQAIKEFCVSQEKQETYRGYGPETGLEKLRTKIASEVYENRISPEEIFISDGAKPDIFRLFSFFGSEKTLGLQDPVYPAYRDIAHITGIRDIIPLACRKETGFIPELPNQQSLDILCLCYPNNPTGTVLTFQQLQALVNYANQHGTVLIFDAAYSAFVSDPSLPKSIFEIPEAKYCAIEINSFSKSLGFTGMRLAWNVIPKELTYDNNEPMINDWKRLFATTFNGASLLMQEAGYYGLDLFPTPPAISLYLTNAQKLKKSLETAGFSVHGGDHAPYLWVELPEGISDEEAFDFFLHQYHIAVTPGHGFGSCGQGFVRFSALTQPQNIALACDRLCTASLKETMVLA

SEQ ID NO: 21033 - protein, 347 aa, Chlamydophila pneumoniae TW-183
MYLQEKFKAQQVPLVLRELLSCSDSINDSDPIYRMVFDSNDTTISYKVGDALGVLPENSKEVSEHVLQLLGYSPTTLVNVKKTSEKVSAQKFIQGYVDLDKIPAKLNSFFPDKDPKITLYDAIQEYRPQIPIELFAESVFPLLPRFYSIASSPDLHPKSIELLVKHVSYPGKYQKRFGVCSSFLCSELQVNDSAYIFVQPTKHFTLSTQTEGKPLVMIGAGTGIAPYKAFLEERLFNKDPGNNLLFFGERKEKVNFYYREFWNHAEEEGKLKLFLAFSRERDQKVYVQDLLRIQKDEVRKAYEEGGFFFVCGRKVLGIEVKHALEEILGKDTLASLRKEHRYVVDVY

SEQ ID NO: 21034 - protein, 455 aa, Chlamydophila pneumoniae TW-183
MNVWTKFFQPPKHIKEIEDQEVVKKKYKYWRIRIFYSMFIGYIFYYFTRKSFTFAMPTLIADLGFDKAQLGIIGSTLYFSYGISKFVSGVMSDQSNPRYFMAIGLMITGLTNIFFGMSSSIVLFALWWGLNGWFQGWGWPPCARLLTHWYAKSERGTWWSVWSTSHNIGGALIPILTGFIIDYSGWRGAMYVPGILCIGMGLVLINRLRDTPQSLGLPPIEKYKRDPHHAHHEGKSASEGTEEIERELSTREILFTYVLTNQWLWFLAAASFFIYIVRMAVNDWSALFLIETKHYAAVKANFCVSLFEIGGLFGMLVAGWLSDKISKGNRGPMNVLFSLGLLFAILGMWFSRSHNQWWVDGTLLFVIGFFLYGPQMMIGLAAAELSHKKAAGTASGFTGWFAYFGATFAGYPLGKVTDVWGWKGFFIALLACASIALLLFLPTWNATEKNTRSKA

SEQ ID NO: 21035 - protein, 402 aa, Chlamydophila pneumoniae TW-183
MDKLTVQDLSPEEKKVLVRVDFNVPMQDGKILDDIRIRSAMPTINYLLKKHAAVILMSHLGRPKGQGFQEEYSLQPVVDVLEGYLGHHVPLAPDCVGEVARQAVAQLSPGRVLLLENLRFHIGEEHPEKDPTFAAELSSYGDFYVNDAFGTSHRKHASVYVVPQAFPGRAAAGLLMEKELEFLGRHLLTSPKRPFTAILGGAKISSKIGVIEALLNQVDYLLLAGGMGFTFLQALGKSLGNSLVEKSALDLARNVLKIAKSRNVTIVLPSDVKAAENLQSKEYSVISIDQGIPPHLQGFDIGPRTTEEFIRIINQSATVFWNGPVGVYEVPPFDSGSIAIANALGNHPSAVTVVGGGDAAAVVALAGCSTKVSHVSTGGGASLEFLEQGFLPGTEVLSPSKS

SEQ ID NO: 21036 - protein, 428 aa, Chlamydophila pneumoniae TW-183
MFEAVIADIQAREILDSRGYPTLHVKVTTSTGSVGEARVPSGASTGKKEALEFRDTDSPRYQGKGVLQAVKNVKEILFPLVKGCSVYEQSLIDSLMMDSDGSPNKETLGANAILGVSLATAHAAAATLRRPLYRYLGGCFACSLPCPMMNLINGGMHADNGLEFQEFMIRPIGASSIKEAVNMGADVFHTLKKLLHERGLSTGVGDEGGFAPNLASNEEALELLLLAIEKAGFTPGKDISLALDCAASSFYNVKTGTYDGRHYEEQIAILSNLCDRYPIDSIEDGLAEEDYDGWALLTEVLGEKVQIVGDDLFVTNPELILEGISNGLANSVLIKPNQIGTLTETVYAIKLAQMAGYTTIISHRSGETTDTTIADLAVAFNAGQIKTGSLSRSERVAKYNRLMEIEEELGSEAIFTDSNVFAYEDSEE

SEQ ID NO: 21037 - protein, 461 aa, Chlamydophila pneumoniae TW-183
MTQEFDCVVIGAGPSGYVAAITAAQSKLRTALIEEDQAGGTCLNRGCIPSKALIAGANVVSHITHAEQFGIHVDGYTIDYPAMAKRKNTVVQGIRQGLEGLIRSNKITVLKGTGSLVSSTEVKVIGQDTTIIKANHIILATGSEPRPFPGVPFSSRILSSTGILELEVLPKKLAIIGGGVIGCEFASLFHTLGVEITVIEALDHILAVNNKEVSQTVTNKFTKQGIRILTKASISAIEESQNQVRITVNDQVEEFDYVLVAIGRQFNTASIGLDNAGVIRDDRGVIPVDETMRTNVPNIYAIGDITGKWLLAHVASHQGVIAAKNISGHHEVMDYSAIPSVIFTHPEIAMVGLSLQEAEQQNLPAKLTKFPFKAIGKAVALGASDGFAAIVSHEITQQILGAYVIGPHASSLIGEMTLAIRNELTLPCIYETVHAHPTLSEVWAEGALLATNHPLHFPPKS

SEQ ID NO: 21038 - protein, 228 aa, Chlamydophila pneumoniae TW-183
MALLILLRHGQSVWNEKNLFSGWVDIPLSQQGIEEAFSAGRAIQNLPIDCIFTSTLVRSLMTALLAMTNHHSKKIPYIVHEDPKAKEMSRIYSAEEENNMIPLYQSSALNERMYGELQGKNKKQTAEQFGEERVKLWRRSYKTAPPQGESLYDTKQRTLPYFEKNILPQLQNGKNVFVSAHGNSLRSLIMDLEKLSEEEVLSLELPTGKPVVYQWKNHKIEKHPEFFG

SEQ ID NO: 21039 - protein, 423 aa, Chlamydophila pneumoniae TW-183
MDKQSSGNSGCIWHPFTQSALDSTPIKIVRGEGAYLYAESGTRYLDAISSWWCNLHGHGHPYITKKLCEQAQKLEHVIFANFTHEPALELVSKLAPLLPEGLERFFFSDNGSTSIEIAMKIAVQYYYNQNKAKSHFVGLSNAYHGDTFGAMSIAGTSPTTVPFHDLFLPSSTIAAPYYGKEELAIAQAKTVFSESNIAAFIYEPLLQGAGGMLMYNPEGLKEILKLAKHYGVLCIADEILTGFGRTGPLFASEFTDIPPDIICLSKGLTGGYLPLALTVTTKEIHDAFVSQDRMKALLHGHTFTGNPLGCSAALASLDLTLSPECLQQRQMIERCHQEFQEAHGSLWQRCEVLGTVLALDYPAEATGYFSQYRDHLNRFFLERGVLLRPLGNTLYVLPPYCIQEEDLRIIYSHLQDALCLQPQ

SEQ ID NO: 21040 - protein, 254 aa, Chlamydophila pneumoniae TW-183
MTRQSYVLGNWKMHKTIQEAKEYVQTLASLLQGEPLSCTIGIASPFTSLRAIHEMINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 21041 - protein, 106 aa, Prochlorococcus marinus subsp. marinus str. CCMP1375
MTPNLIKILPIIHFSTSFLLGAWSLAFLMRIILTWYPQINLKNGFWLLFYLPTEIFLTITKKIVGPIGGVDITPVIWFGLISLSRELLVGPQGIISQMLLKQAMQG

SEQ ID NO: 21042 - protein, 322 aa, Prochlorococcus marinus subsp. marinus str. CCMP1375
MPIANDITSLVGQTPLVRLNRLPKAFGCKAEVLAKLESFNPTASVKDRIAGAMVVEAEKQGTIKPGETVLIEPTSGNTGIALAMVAAAKGYRLILTMPDTMSTERRSMLRAYGAELQLTPGKDGIQGAINLAKELVASISHSYLLQQFDNPANPQIHEATTAEEIWSDCEGKLDGLIAGIGTGGTITGCARVLKARNPALKIYAIEPSSSAVLSGKEPGPHSIQGIGAGFIPKVLDISLIDEVIEINDQEAMEAGRKLAKEEGLLSGISSGAALAAALKIGKRPEMENKRLVVVFPSFGERYLSTSMFNNLSTSQPKKDGYI

SEQ ID NO: 21043 - protein, 173 aa, Prochlorococcus marinus subsp. marinus str. CCMP1375
MPSSNNKDNFLDKAFTVIAEGIVKMMPIAAKEKQAYIYYREGFAAQNNGDYSEALENYEESLKLEENAIDRGETLKNMAIIYMSNGDEDKALDTYQKALEQNPKQPSCLKNMGLIYEKRGRALQQNGKQDESDIWFDKAAEVWTKAVRLYPGGYLDIENWLKTTGRSKVDIYL

SEQ ID NO: 21044 - protein, 461 aa, Prochlorococcus marinus subsp. marinus str. CCMP1375
MTRTSTIYICQTCGAETRQFFGRCSTCGEWNSVVEEVISTSNLRPKRKGSNHSNELLDNRSQRISSLQEKSVKRISSGYKELDRVLGGGLVPGSLVLIGGDPGIGKSTLLLQSATEMARYKSILYITAEESSNQVQLRWNRLGKADSDLHLLAETDLEAILNEIERFNPAVAIIDSIQAIHDETIGSTPGSVTQVRECSAALQRIAKAKNITLLIVGHITKEGMLAGPKVLEHLVDAVLTFEGDRFASHRILRTIKNRFGATNELGVFEMQGKGLIEVNNPSELFLDSENAPGIATIVSCEGTRPLAIDLQALINQTSYPSPRRTATGIETNRLHQILAVVEKHMNIALSRYDCYLAVAGGLAVEEPAADLGIAAAVISSYKKTALPKGTVLIGEIGLGGQLRSVGQMQLRLREAERLGFKTAIIPKATNKDSLSKQEGKIDIQEVSNINEVFEIVLNIKT

SEQ ID NO: 21045 - protein, 402 aa, Prochlorococcus marinus subsp. marinus str. CCMP1375
MAKRSLSNLSVEDLCGKRVLVRVDFNVPLNEEGSITDDTRIRAALPTIQHLIEKEARVILSAHFGRPKGKVNEDMRLTPVSQRLSELLGKTVVKTESCIGPDAEKKVHEMSNGDVVLLENVRFIGEEEKNDSEFAKKLASLAEVYVNDAFGAAHRAHASTEGVTNYLSPSVAGYLMEKELKYLQGAIDSPQRPLAAIVGGSKVSSKIGVLESLIDKCDKVLIGGGMIFTFYKARGLSVGKSLVEDDKLDLARALEKKAKEKGVQLLLPSDVVLADNFSPDASSQMVQIDSIPEGWMGLDIGKESVKLFQDALADCKTVIWNGPMGVFEFDKFANGTNSISTTLAELSAKGCCTIIGGGDSVAAVEKAGLASKMSHISTGGGASLELLEGKVLPGVAALDDEI

SEQ ID NO: 21046 - protein, 432 aa, Prochlorococcus marinus subsp. marinus str. CCMP1375
MIDSLDLVIDSIFAREVLDSRGNPTVEAEVLLEGGAKGRAIVPSGASTGAYEAHELRDGGTRYMGKGVLRVVEHIEDRIAPSLCGLSASDQVNVDQIMRELDGTENKENLGANAILAVSIATARSAANAFGMPLYRYLGNPMSSLLPVPLMNVINGGAHAANNLDFQEFMLVPHGAESFREALRMGAEVFHTLKKLLSDKGLSTAVGDEGGFAPDLENNNAAGDLLVQAIEKAGFRPGEEISLALDVASTEFFKNGLYHFGEGKFSSEKMVEELKKLVNLYPIISIEDGLSEDDWSGWELLTKELGNKVQLVGDDLFVTNTKRLRQGIDRSIANSILIKVNQIGTLTETLEAIDLSHRMGYTSIISHRSGETEDTTIADLAVATRAGQIKTGSLSRSERVAKYNQLLRIEDQLGAQAVYAGSVGLGPRGLSK

SEQ ID NO: 21047 - protein, 502 aa, Prochlorococcus marinus subsp. marinus str. CCMP1375
MTTALQSPPRRRIARLQEVSLLEGPMLLLRSIRGFRSNQSLIWLATVPLALLGLGVFGFAARAGVGLSDLSGAQAASFLADNLWLFIATILVIFMNAGFAMVEAGMCRQKNAVNILAKNLFVFALAVTAYWFIGYSIMYGGTPIIGGVIFSNGFFFNPDPSDALSCAAGLGADGCSQLVPAVDFLFQAAFAGTAATIVSGLVAERVKFGEFVVFSLVLTAFIYPIAGSWQWNGAGWLSQLGFIDFAGSSIVHSVGGWAGLVGAMLLGPRIGKFVDGKPQAMPGHNMAIATLGALILWIGWYGFNPGSELAMDEYVAYVAVTTTLAAAGGAIAATLLSTLTSGKPDLTMIINGILAGLVSITAGCGNMTLSGSWLAGFVGGLIVVFAVSALDSAGIDDPVGAFSVHGVCGVWGTVVIGLWGVDGMDPGAAGIGLFNGGGLNTLLIQALGAGAYAIWTVVTCWLAWTVIGGFFGGIRVSEEEEIQGLDIGEHGMEAYPDFASSN

SEQ ID NO: 21048 - protein, 270 aa, Prochlorococcus marinus subsp. marinus str. CCMP1375
MKDLPSKPIESKNYPVVEMDSLSMKWADNSVLNKVSLKMKPGERIAIIGPSGCGKSTVLRLLAGLLLPSSGDLKLFGLMQNYLRLDQTFPPDVRLVFQNPALIGSLTVEENVGFLLRKNSSITDKRAREIVISCLEEVGLYNIADKFPGQLSGGMQKRVSFARALINDPNKESDSMPLLLFDEPTAGLDPVACTRIEDLIVKTTTLAMGCSIVVSHVMSTIERSAERVVMLYGGEFQWDGSIDDFKNTQNPFIKQFRTGSLEGPMQPKEI

SEQ ID NO: 21049 - protein, 457 aa, Prochlorococcus marinus subsp. marinus str. CCMP1375
MIQGFQIENLRNKVVSGHTRSESWRRAQLKKIKGIIDQNQKEILNALSEDLQKPSTEAFFEILSLRQELQLYENQLSSWMKPQNIKVPLWLKPGEASVIAEPLGCVLIIGAWNYPFMLTLQPLISALAAGNTAILKPSEYSPATSELIEQLFTKYFPPDIVKVCQGDEYFAAELLKHKFDHIFFTGGSETGKKVMSAASKYLTPITLELGGKNPALVLKDANIDITAKRLIWGKSINSGQTCLAPNHLLVHKDIEKELIEKMKYYINSFYGKEPQKSKDLAKINDHQFEKIISLIEKAQKENKIISGGEINSIDKKVSPTLIHIENLEESIISDELFGPIFPILSYSNFDSALNNIRSQEKSLAIYMFGGNEQEKNQLLSSTSSGGVCFNDVVIQAGIPELPFGGIGLSGIGRYHGKAGFETFSHLKSILKRPFWLDLKFRYPPYKIDISFMSKLMR

SEQ ID NO: 21050 - protein, 328 aa, Prochlorococcus marinus subsp. marinus str. CCMP1375
MTPIYEDNSLAIGNTPLVKLHSVTKNCKATVLAKIEGRNPAYSVKCRIGANMIWDAEKKGLLNKQQTIIEPTSGNTGIALAFTAAAKGYKLTLTMPESMSLERRRVMAVLGAELILTEAAKGMPGAIAKAKEIAESDPNKYFMPGQFDNPANPEIHFKTTGPEIWNDCNGNIDVLVAGVGTGGTITGVSKFLKQEKRKQVLSVAVEPSHSPVISQTINGQEVKPGPHKIQGIGAGFIPKNLDLSLVDQVEQVSNEESIAMALRLAKEEGLLVGISCGAAATAAIRLAEQEQFAGKTIVVVLPDLAERYLSSVMFAEVPTGIIEQPKTN

SEQ ID NO: 21051 - protein, 490 aa, Prochlorococcus marinus subsp. marinus str. CCMP1375
MIGNNLLSDPLWEAKHLGQAIPQSPHAVSVALPRWQDVIAYEEKDPYCINALQAIYPRFGFNPLIKLIAKKALVFQENESQSVWPYPNINSAKKAKEYCQKLNSNSEVIIQEFSGLQCLIVDDKATPAAKAFWQHTGLGASSRQAAIALNKEKAPSINEGEAARNSIRKRLAKIYGCNSDLIQLHPSGMAALTTALEALREIRPRKAAFQLGFPYVDVLKLPQVIFDGSELLLNPNPIELAKQLDQKKPSAVIVELPSNPMLKCVDLPLITKMAHDRGIPVIADDTIGSAINIDPLPYADLVFSSLTKSFAGQGDIMAGSLTISPKSPWKEVLKEIIPLVSVSNLSDSDAIALQKASKDVTSRIPELNKACINLKNRLEAHPDVARVLHPAQCPNFQLLMKPNAGFGCLFSFELHGGVSKAERFYNSLKVCKGPSLGTIFTLVCPYVLLAHYNELNWAKQCGVPSSLIRVSVGLEATEDLWDRFQKALNN

SEQ ID NO: 21052 - protein, 389 aa, Prochlorococcus marinus subsp. marinus str. CCMP1375
MESTELKEGSHPGINTRVIHHGESFAKTTGTVMPPIFQSSTFRQGNEEGFDYTRSGNPNFRILESVLASLEDCKYSTVFGSGVSAITAIASSLKSGDLVLCEENLYGCTVRLFEKVFSKFGLRTKWLDFSNPSCFDEIKKLSPAMIWLESPTNPLLKVLDLKTICTKAKENQIPVVVDNTFSTAILQKPLDLGASLSLTSTTKYINGHSDALGGAVCTQDSYWHEQMRFAQKALGLQASPFDCWLITRGVKTLPLRLQRQVSNATSLANQLAKNEYVQWISYPFRSDHPQYEIAKKQMAAGGAIITIRLKANLDQTYAFCERLKYFTMAESLGGVESLVCHPATMTHASVSSQTKEKLGISESLVRFSIGCEDVLDLDQDLKQSLEKLK

SEQ ID NO: 21053 - protein, 125 aa, Prochlorococcus marinus subsp. marinus str. CCMP1375
MLVGKELLDKARSLSKCSEDEIARGCGYVGPSGRVLRKSYYRALVQAKGYKLRSNGPGRPGNRSSRGRQAEFKTKVHGNGNLLIGHAYTKKMGLEPGQEFRIDVRRDSGAICLLPLGGKKLEINN

SEQ ID NO: 21054 - protein, 183 aa, Prochlorococcus marinus subsp. marinus str. CCMP1375
MRRLFSILLSAFLLLGLAPIVNAAGEAVNADRAATDFTASALTTCSENTRFNERASQATTPKDIARFERYSKASCGDDGLPHLVIAATIEPWGALANRHHEGDILIPGHIFIYVAGIIGWSGREYLRASKKTKNPAENEIIIDFALARQCLIKGAAWPVEANKQGRSGDLREKDENISLNGPR

SEQ ID NO: 21055 - protein, 433 aa, Prochlorococcus marinus subsp. marinus str. CCMP1375
MTNAFNTSNSQAVFHAAQELMPGGVSSPVRAFKSVNGDPIVFDRVKGAYAWDLDGNRFIDYVGSWGPAICGHSHPEVIASLQEALEKGTSFGAPCELENKLAEMVIEAVPSVEMVRFVNSGTEACMAVLRLMRAFTGRDKLIKFEGCYHGHADMFLVKAGSGVATLGLPDSPGVPRSTTSNTLTAPYNDLEAVKNLFAENPDAIAGVILEPIVGNAGFIQPEPGFLEGLRELTKENGSLLVFDEVMTGFRISYGGAQGRFGVTPDLTTMGKVIGGGLPVGAYGGRKDIMSMVAPAGPMYQAGTLSGNPLAMTAGIKTLEILQQEGTYERLASITNRLINGICESAKQAGIPITGSSISGMFGFYLCEGPVRNFEEAKQTNSDYFGKLHRAMLAKGVYLAPSAFEAGFTSLAHSEEDIDSTLKAFNECFNELSQ

SEQ ID NO: 21056 - protein, 453 aa, Prochlorococcus marinus subsp. marinus str. CCMP1375
MNYSFDLIVLGAGSGGLAAAKRAASYGARVAIVEGDRVGGTCVIRGCVPKKLLVYGSQYGEYLKNAPSFGVKLTASKIEPSILLKNVRNEVDRLNKLHIDLLEKSNVVLIKGWGSIAGPNSVVVKSKDVQDQAIELFAEKILIAVGGRPSFPEIPGASLGWTSDDVFLQEGFPDKVVVVGAGFIACEFACILNGLGVKVKQLVRGRNLLKNFDNEVAFNLQQSMESSGIEFQFASEVNSIEGEIGDLNLVVNHDSNIKSGAVIFATGRKPFIEGLNLEKVDIRTSNNRINVDNKNSTNISNIFAIGDVTDKVNLTPVAIEEGRVFADNNYSDKNRYVNYEFIPKAVFSQPELAYVGKTEEESKRIYGESNIKIYRANFKPMSKMLVKSKEKCFLKLIIEKNSNKVVGCHMLGEHASEIIQMAAISMNMGATKLDFDQTMALHPTISEEFVTMK

SEQ ID NO: 21057 - protein, 267 aa, Prochlorococcus marinus subsp. marinus str. CCMP1375
MESSILERCFSQSKKEGRIALMPFIMAGDPDVNTSAEILIMLEKKGADIIELGIPYSDPLADGPIIQKAASRALNSGTSPKSVLEMLSTLKTKLSVPIILFTYSNPLLNYGMEEFCIDASKAGAAGLVVPDLPLEETEKLSSIALSKNLDLVLLVAPTTPKERMRKISQRSNGFTYLVSVTGVTGERSALENRVQLLINELRGFSSTPVAVGFGISDTKHVIQVKRWGADGAIIGSALVKRISNATTGQEAEEAGKFCSELYKATSL

SEQ ID NO: 21058 - protein, 119 aa, Prochlorococcus marinus subsp. marinus str. CCMP1375
MLTGSDLLTKVKELGDVSKSDLVRACGYVSNKKSGGERLNFTAFYEAVLEAKGVNLGATGVAGIGKGGRKLSYIATVQGNGNLLIGKAYTALLDLQVGDEFEIKLGRKQIKLFPAGSED

SEQ ID NO: 21059 - protein, 226 aa, Prochlorococcus marinus subsp. marinus str. CCMP1375
MMPMNQEFIQKLRFNEKGLIPAIAQDWLDGAILMMAWMNKESLEKTLITGEVHYWSRSREKLWHKGETSGHFQILKGIRFDCDSDVMLLSIEQVGSIACHTGARSCFFQEVEENIPDLEQNSTFNRPLSNTCSELFEVIKDRSSNPQKNSYTNSLLKDGDNKILKKIGEEGSEFVMACKDNDHESISNEAADLIFHIQVALKYHKVEWRDVLEVLAKRRQSKSNPK

SEQ ID NO: 21060 - protein, 1110 aa, Prochlorococcus marinus subsp. marinus str. CCMP1375
MLKRLWSEYRNACLLTLTLLVIGIVASPWVLIIALMPIGWVLLMPKGPQLEQHPETIESSEEVESIEPLKGTTLLEKIKELGDVSKSDLVKACGYVSTKKDGGERLNFTAFYEALLEAKGVEITTSSSDSEEQREDSHQTNLSKSIEEALIRIISENIKEYGISDLQEIYDDSTQRSYDFSRLEGSYESTLYEWIHIYLKNTGLYNSFLNAKQLAQAEAVPEGTIYGPNDEEDENYEGIQEQIDELHWDCILVVAKEGIRQGLNIYGIPEYLENCGMDEYLEEINSIKVDKSNNGVADEVNSENSWEALDEDELIERLKGTEVPIDIIRKFVNSENWEIRRTIALREDLPLEIIEKLRNDDDDDVKDAVAYRQLPVEWRKLDDDEKIEKLKDDENVDDNIIEILSTSNNWGIRQAVAQSPSTTENILKILIHDDDDDVKKATKKALKAKEISYEYSINKDDNDKSIDDDEVGCIKKSQLPAELRSMSLSNIAKRINERGASKELLEVLSSTDNHELKCAIAENTSTSEEVLIKLIKESEVNWRENSCSDSVDDLARENLYRRKIPIEFRAMEEQAIIEALKQEDAEEEMLKTCAEYGPVYIRSAVAGNPKTPQETLGMLANDVNSGWVKEVVALNPNCSKETINRLLHDDDTHGILVRRAALLNGLPNDWIKLIQDEDIGEIRKRMINEHPSLKVINTLLKRDEEEFTSSYDNKQFSACVVYYPDTPDDILNHLRQDDDEYIKAAFRETTMPSDWVVMSDEERISALKSSDVPLEVFNTLALSPNYQIRLAIARSDKTSQPILDILANDSDSEVKEAIRQRELPEEWRELEQEELIKRFEEGLANEIILEFFSKSSDWHVRQAVAQNTSTPEKILTTLREDEDDDVKEAANKSLRILNPNSDAFGKERKSIYMKTEPGGRIAFSQLDQNQVNLLIQSISKMNLDEALDELRYSGVDAEGVVNSGDEGEYGNEGRIFFNEYLQRIGPDEDKETEKFKDGIYAVLMSLSKCSIEFEFELDEEFDNDKLEETCVPIRLPSEIKHGLYGHPDFNIITGFKYDGEEIEEDYEIIDRGYDDQFTIFSIKEGKTTVIYSNYNGDEEWNNSAEILNLM

SEQ ID NO: 21061 - protein, 137 aa, Prochlorococcus marinus subsp. marinus str. CCMP1375
MTDWIRLLKPSGSPDALGTLQLAWLGDAIWEMHQRLRLCEKPAKSKDLHFSVVSLVRAEAQAAALENLDYYLTDLERKFVRKGRNRVGRGSRKVNIAIYGKATGFETLIGWLFLKDPNRLAQLLDRLDQIESDKKKD

SEQ ID NO: 21062 - protein, 442 aa, Prochlorococcus marinus subsp. marinus str. CCMP1375
MTSHRFETLQLHAGQEPDPSTNSRAVPIYQTSSYVFNDAEHGANLFGLKEFGNIYTRLMNPTTDVFEKRVAALEGGVAALATASGQSAQFLAVSNCMQAGDNFVSTSFLYGGTYNQFKVQFPRLGINVKFADGDHIDSFASQIDSQTKAIYIESMGNPRFNIPDFSALSDLAKANKIPLIVDNTLGAAGALIRPLEHGADIVVQSATKWIGGHGTSLGGVIVDGGTFDWGNGKFPLMSQPSAAYHGLIHWDAFGFGSDICKMLGVPDNRNIAFALRARLECLRDWGPALSPFNSFLLLQGLETLSLRIERHCFNASELAKWLKSHPKIASVNFPGLPEDPYHKRAKQYLSGRGMGCMLMFSLKGGFDDAVSFINALKLSSHLANVGDSKTLVIHPASTTHQQLSEDEQKSAGVSPTMVRVSVGLEHIDDIKSDFEQALDQIT

SEQ ID NO: 21063 - protein, 247 aa, Prochlorococcus marinus subsp. marinus str. CCMP1375
MSSAFTSSNRPIQIIPSVLPADWANMGQCVKDLEEAGVDRIQFDVMDGNFVPNLTFGPEMISACRKYCNVPFETQLMVSQYNCETMLEAYVEASKGPNGEPGVVIAHVEANVHLHRILGKIRQLGGSPSVALNPHTPMEMVKDVLDMVDHVLVMTVNPGFGGQAYIPTMLNKIKSLREVIVENNYDIDIEVDGGIKADWTISQCCAAGANCFIAGSGMFAYPSLKEGCDALRSVAKDAQNGKLLEKS

SEQ ID NO: 21064 - protein, 472 aa, Prochlorococcus marinus subsp. marinus str. CCMP1375
MSKAHFGLVGLGVMGENLVLNAERNGFSSVVYNRTYSKTEAFLNGKGLGKKISGASDLQDFVNKLERPRRILMMVKAGAATDAVIEQISPYLQEDDLLIDGGNALFSDTERRVLELESKSFGYIGMGVSGGAKGALEGPSMMPGGTKASYKAIENLLNKMAAQVDDGPCVTYIGPRGSGHFVKTVHNGIEYGIEQILSEGYDLMKRVCKMNCDEISDVFGIWNKTEELSSYLVEITEICLRTKDPTDGADLVEKIMDKAGQKGTGLWTVVSALQLGASVPTIYASLNGRVMSSMKSERVKAEKVFGKLSIERTDLGSPSNGMSPIMDAVVLSTIASYAQGMEILRLASEEYKYDLHMPSIAQIWKGGCIIRSTLLQRIQDAFNNEPQLTNLLMDPWFAEQIKNRLPGLTKTVAVAAQTGVPVPCFSSTLDYINSYRTARLPQNLVQAMRDCFGSHTYERIDKEGSFHTEWIN

SEQ ID NO: 21065 - protein, 355 aa, Prochlorococcus marinus subsp. marinus str. CCMP1375
MALSYYKEELKKTASSLATSGKGILAVDESTKTIGKRLASINVENTEENRKAYRGLLFTTEGLGEYISGAILFEETLFQAHPDGEPMVKKLEKLGVIPGIKVDKGLRPLAGGNDVETFCSGLDGLVERSSDYYAQGARFAKWRAVLQITNNGSPSKLSIKENAWGLARYARSVQESGLVPIIEPEILMDGSHSINKTAEVQEEVIKEVYMACQLNGVFLEGTLLKPSMTVQGADCKDKADPQKISELTIRTMERCVPASVPGIVFLSGGLSEEAASIYLNLMNKQPRKANWNVGFSYGRALQHSCLKEWGGKNLEAGQKALLARAQANSEASKGIYVAGSQPSSDEALFVAGYKY

SEQ ID NO: 21066 - protein, 243 aa, Prochlorococcus marinus subsp. marinus str. CCMP1375
MRKTVIAGNWKMHMTCSSAKEYIDKFIPFSKEFPSDRHVVIAPPFTAISTLASLLQGTNIQLSSQNVHWEDTGAFTAEISPSMLLEHDVRYAIVGHSEPRKYFSESDEQINLRARSAQSNGLIPIVCVGESIEQRERGEAERVIRRQVEQGLEQTDLTKLVIAYEPIWAIGTGKTCESNEANRICGLIREWAGFSDLIIQYGGSVKPANIDEIMSMSDIDGVLVGGASLDPENFARIANYQSI

SEQ ID NO: 21067 - protein, 276 aa, Prochlorococcus marinus subsp. marinus str. CCMP1375
MEKIPVLVAGALGKMGSEVIKAIYKSNDCELVAAIDNANEMEGVDIGTALGMDQMDVAVTADLEGSLCVASQSVRNSSGNAVLIDFTHPNVVYEHSRASIAYGVHPVIGTTGLSIVQLEELREFANKASIGAAIIPNFSVGMVLLQQAAAAAASFYDYAELTESHHNQKADAPSGTCIKTAEIIEEIGKSFNKTTIKEQESIKGSRGGLRESGLRLHSVRLPGIVAQQQVLFGSPGETYLLSHNTIDRSAYMPGVLHTIRKVRHLKSLVYGLEKIL

SEQ ID NO: 21068 - protein, 145 aa, Prochlorococcus marinus subsp. marinus str. CCMP1375
MKAVMNTDKGEISLELFEEDAPNTVSNFVKLVNDGFYDGLSFHRVISGFMAQGGCPNTREGASGMPGTGGPGYNIDCEINKNKHLPGSLSMAHAGKNTGGSQFFIVHESQPHLDGVHTVFGQTKDMDVVLKLTNGSRIEKVSIIQ

SEQ ID NO: 21069 - protein, 473 aa, Prochlorococcus marinus subsp. marinus str. CCMP1375
MGKSPQDVLRQIKDEGIELIDLKFTDIHGKWQHLTVTSDMVDENSFKEGLAFDGSSIRGWKAINESDMSMVPDSSTAWVDPFYRHKTLSLICSIQEPRSGEAYSRCPRSLAQKALAYLSNTGLADSAYFGPEPEFFIFDDVRYDSKEGTSFYSVDTIEAPWNTGRAEEGGNLAYKIQYKEGYFPVSPNDTAQDLRSEMLLLIGELGIPIEKHHHEVAGPGQHELGMKFASLISAADNVMTYKYVVRNIAKKYGKTATFMPKPVWNDNGTGMHVHQSLWKDGQPMFYGEGTYANLSQTAKWYIGGILKHAPSFLAFTNPTTNSYKRLVPGFEAPVNLVYSQGNRSAAVRIPLTGPSPKAKRLEFRSGDALANPYLAFSAMMMAGIDGIKNQIDPGDGVDVDLFELPEDELSKIATVPSSLNNALEALKADNDYLTAGGVFDHDFINNFIEMKYEEVQQLRQRPHPHEFFMYYDA

SEQ ID NO: 21070 - protein, 387 aa, Prochlorococcus marinus subsp. marinus str. CCMP1375
MNIQLGHSKFVRRAYGIDEIALVPGGKTVDPENTDTTLLIGGKSLEIPIIASAMDGVVDVNMAVALSKLGSLGVLNLEGVQTRYEKPNDVLKRISSVGKEEFVPLMQEIYKQPIKENLINQRIQEIKDQGGLAAVSGTPLAAIKFKDTITKAKPDLFFLQATVVSTEHIGGGKQEKLEISNLCQTLGIPVIVGNCVTYEVALNLMRAGVSGILVGIGPGAACTSRGVLGVGVPQATAISDCSAARDDYKKETGNHVPVIADGGIITGGDVCKCIACGADGVMIGSPIARASEAPGNGYHWGMATPSPVLPRGTRIKVGSTGNLMQILRGPAKTDDGTHNLLGALKTSMGTLGAQTIKEMQEVEIVIAPSLLSEGKVYQKAQQLGMGK

SEQ ID NO: 21071 - protein, 220 aa, Prochlorococcus marinus subsp. marinus str. CCMP1375
MNQSKEIEGNDCRILFKNAYENRYTWGDEFKGYKGSCIWDNGIKVVEGSFLLGKDLKSNVTGIADQEVLKAISSQLWEVAIHRVRRGFEKVHGENTFTAGDINQYGLEVLVGGKNVGDKYRIKNNVVTMVFRHIHGVIVEIYTIETVDTGNGYLSRNYSSQYYDPTSGMPTSGKSLFRDEFKPLKNSSIWVLNSREIEKEEFNSSPYTKEKYSFLDLQEI

SEQ ID NO: 21072 - protein, 112 aa, Prochlorococcus marinus subsp. marinus str. CCMP1375
MPLINVRTSVAQFEKPQTLLKELSKELSALTGKPESYVMTLMQTNVPMTFAGTNAPCCYVEIKSIGAITPAKMTAAFCEIISKNTTIPTNRIYIAFEDVSPDSWGWDGRVFG

SEQ ID NO: 21073 - protein, 159 aa, Prochlorococcus marinus subsp. marinus str. CCMP1375
MLINVKETVVETADGEKKNLGDYLGNVLLIVNVASLCGNTPQYKGLEKLFEKYKKNGFCVLAFPCNDFAGQEPGTIEEIKEFCSVKYGTTFEIFNKVHAKGLTTEPYTTLNKVEPKGDVSWNFEKFLVGKDGNVIARFEPSVEPSSEELITAIEVALSS

SEQ ID NO: 21074 - protein, 481 aa, Prochlorococcus marinus subsp. marinus str. CCMP1375
MSKTKFDFDLIVIGAGYGGFDAAKHAAENGLKVGIVESRELGGTCVNRGCVPSKALLAASGKVRELANADHLALFGIHAAPVRFERQKIADHANNLVANVRNNLTKTLERAGVIILRGQGRLEGPQRVGVRESSGVDKVLTAKDVILATGSDPFVPPGIETDGRTVFTSDEAISLEWLPRWIAIIGSGYIGLEFADVYTALGCEVTMIEALERVMPTFDPDITKIASRNLIAGRDIDAKSGVLASKVKPGCPVKIELADVNTRVVVEELEVDAVLVATGRVPSSKDLNLESMSVETHKGFIPIDESMRVLVDGKPLPHLWAVGDVTGKLMLAHTAAAQGTVAVDNILGNKRKIDYRSIPAATFTHPEISSVGLSEEQAKEISAKENFSLGIIRSYFKANSKALAELESDGLMKLLFRKDNGQILGAHIYGLHAADLIQEVANALARKQSVVDLALEVHTHPTLSEVVEVAYKQAVQQMKKL

SEQ ID NO: 21075 - protein, 395 aa, Prochlorococcus marinus subsp. marinus str. CCMP1375
MLDTYKRLPLKIVKGNGCWLWDETGKKYLDAVAGIATCSLGHSDKKLSKVLSQQLRKIQHVSNLYRIPEQEDLAQWLVNQSCADSVFFCNSGAEANEAAIKLARKYGQIKRGIKRPIILSAKSSFHGRTLAALSATGQTKYQKGFEPLVEGFEFFSFNDSNSVQDLYENLEKDEPRVAAILIEPIQGEGGLNLGDQKFFYFLRDYCNKNNILLLFDEVQSGMGRTGKLWGYEHFNVEPDAFTLAKGLGGGHSIGALLVKENASIFEPGDHASTFGGNPFACKAGLTVAKEIQNRNLLENTYCRGNQLREGLQKLINNYPHHLEEVRGIGLMLGLAIKKNSNLTSQKIVELAIKEGLLVIGAGEKVIRMLPPLIITKREIETLLTRLNACFRKLNN

SEQ ID NO: 21076 - protein, 211 aa, Prochlorococcus marinus subsp. marinus str. CCMP1375
MDLSNSVQQIRDWLWMFPSKNSSQGMAAWWLNCEPEPVLIDCPELTPQVINDLEQLSKASNPKILLTSRDGHNKISDLNKKFGWPVLIQEQEAYLLPGIKNLESFREEAITAAGLKLLWTPGTTPGSCVVYAPSPWNVLFCGRLLIPFANAQVGAVRTRNTFHWTNQQNSLVKLIQWLPSEHRPSLASGVVSHSSDSQKLFPWTAWKPNGQ

SEQ ID NO: 21077 - protein, 344 aa, Prochlorococcus marinus subsp. marinus str. CCMP1375
MTEVDPKSKNESKADEDCNEIQVIKESDIEGEKNNSKKRIYPSENLSKVKNSEKLNSTEFFQLALKDLEEKRTELESDIKDLEKRKIKLEKEVSQSFSGQSDSIARRVKGFQDYLTGALQDLSQSVEQLELIAQPVVVTPSPLDKTNIETSTVSEKAEEIAAIADTFKPDKDLILQLLGQYIEGPDYYANPWKFRRSLDAQDAEILEDWFFNMGGRGAQPSLGNRSKNVQLSAALIAILGELYGDRFQALVLASQPERLGEWRRGLQDALGLNREDFGPNSGVVLFERAEPLIERADRLEAENEVPLILIDAAERNIEIPILQFPIWLAFAATNEELYLEEELI

SEQ ID NO: 21078 - protein, 118 aa, Prochlorococcus marinus subsp. marinus str. CCMP1375
MLTGKDLLAKVKDLGDVSKSDLVKACGYVSTKKGGGERLNFTAFYEALLEAKGVNLASESAGGIGKGGRKLSYVATVQGNGNLLIGKAYTALLDLKPGDNFEIKMGRKGFRLVPEGDG

SEQ ID NO: 21079 - protein, 315 aa, Prochlorococcus marinus subsp. marinus str. CCMP1375
MTWSINSIPSQEGRTVFVTGANSGLGFDTAQALLEKGATVILGCRTLEKAERSRQKLLDETDCGKIDVLEIDLADLEKVNEALDKIAVKYKKLDLLINNAGVMAPPQTFSKQGFELQFAVNHLSHMALTLKLLPLIAKQPGSRVVTVSSGAQYMGKINLDDLQGGEGYDRWSSYSQSKLANVMFALELSKRLQQSNLDIASLSAHPGLARTNLQSTSVKLNGSWQEAIAYKLMDPMFQSSRMGALPQLLAATDPTAKTGEQYGPRFNFRGYPKICRIAPSALNSDEREQLWQLSEKLIGDAVDISKGKELLSTKK

SEQ ID NO: 21080 - protein, 434 aa, Prochlorococcus marinus subsp. marinus str. CCMP1375
MDKAMDNILSYPENWHQNIWPPFTQITSSRPPLQISNAKGCLIFKDNGEPIIDAISSWWVTLHGHSDPYIASAIYNQAKQLEQVIFADFVHPQAELLAKRLSQATGLQRLFFSDNGSTAVEVALKIALQYWHNKGEQRHHIIAFEGAYHGDTFGAMSVGERNLFNEPFKEMLFPVSRATWPSTWWGDEGIERREEEAIKKLEIMLERPTAAVILEPLIQGAGGMTMVRPEFLQAVQGVVRQAKALLIADEVMVGFARTGSLFASQRAKISPDLMALSKGLTGGFLPMGITMASQEIYNTFLGNDPQKTFWHGHSFTANPLGCAAANASLDLLERNPTAYTNFESRHLPHLEQLVKHPKIKKIRLTGTIAAFDLKTDGNDGYLNNTGKVIKAYALANNVFIRPLGNVIYLLPPLCISDHQLEQCYKVIKSSLDII

SEQ ID NO: 21081 - protein, 119 aa, Prochlorococcus marinus subsp. marinus str. CCMP1375
MTNDPAIAFRVTALEDNQPNGREPILGGILRKKAVWVDESLCIGCTYCSCVATNTFTMEPDNGRARAFRQDGDSTEVIQEAIDTCPVNCIDWVKFEDLDDLRSQLNAKTIRPLGLPPLR

SEQ ID NO: 21082 - protein, 1134 aa, Prochlorococcus marinus subsp. marinus str. CCMP1375
MTSSGKIRIYELSRDLHLENKDVLDAANKLSISAKSHSSSISDEDATKIKKLLLAQKSSNSSSPPAKQKPNKEILTLKKAITSPPTKSEANAKTNASLDKTSSLKNKPASPKKEIPTSPKPPSAAKQRVDAIKKPTPSISKNNSLKVQPTIKKPSLVSPKQPNIPSPPIAPNKGIKPTIKRQDSNNENLETNKTKAKPNIVSKPQARQIKQSSDLINRSPKTSPKQPIQEIQTNKPKAPQRPIAPPPRPKVQSQFNQKPGNNNLRGGPNQRKGIPQGAPSGQPGSTKHPRNLPTGSYKGNRVELVGAPIRRNTKPDNGGRGARDGNFRQGGPNQGPPISRQGGARRQEGGGGRGQQMRPRTGMPPGMRKPVAPGELMQLQKPTSSATPPIKRGDLNKGPKKDGISTAKPPANRPTPSAAPKRPPARTGAPGSSRKRKPDWDDAAKLEALRNKSPQKQRQKVHIIGENDDALTAETSGFAGGGQAVVLSASLARPGKPKASKKSGSKPTGALRKRKKESTRQRQRRRAMELRAAREAKQIRPEMIVVPEDNITVQELADKLSVESSEIIKSLFFKGITATVTQSLDLSTIETVAEEFGVPVLQDDIEEAAKKTVEMIEETDIKHLTRRPPVVTVMGHVDHGKTSLLDAIRKARVAAGEAGGITQHIGAYQVEVEHEKKLRTLTFLDTPGHEAFTAMRARGTKVTDVAVLVVAADDGVRPQTLEAISHARAAKVPIVVAINKIDKEGASPDRVKQELSEQELVAEEWGGDVVMMPVSAIKGENIDKLLEMILLVTEVEDLQANPARLAKGTVIEAHLDKAKGPVATLLVQNGTLKAGDVVAAGPVLGKVRAMVDENGKRLKEAGPSCPVEALGFNEVPTAGDEFEVYPDEKSARSVVGERASDARATRLAQQMASRRVSLSAMSGQVNDGDLKELNLILKADVQGSVEAILGSLEQLPKDEVQVRVLLSAPGEITETDVDLAAASGAVIIGFNTSMASGAKKAADANSVDVRDYEVIYKLLEDIQLAMEGLLEPDLVEEKIGEAEVRAIFTIGKSAVAGCYITNGKLQRNCKVRVKRADQIVFNGDLDSLRRNKDVVKDVSSGFECGIGCDRFANWKEGDTIEGYKLVTQRRKLNT

SEQ ID NO: 21083 - protein, 280 aa, Prochlorococcus marinus subsp. marinus str. CCMP1375
MPTQVAYLGPKGTYAEQAAGYLAKLEKLSQPEFIPCCGLRSVIEHLVNKHCEAAVVPIENSVEGGVTTTLDSLWAHPNLFIQRALVLPIRHAFISSGSLNEITEVLSHPQALAQCTDWLSNNVPNAIQLPTNSTSEAVRMVKGSKFRAAIASKTSSEVEGLENIAYPINDVAGNCTRFVLLTNQKSDITGDIASFAFSLHANKPGALLKALTCIADLGLNMNRIESRPSKRELGEYIFFVDIDLQEKSIDTKDRLNKLLKPLCENIIYFGSYVTSEMTLD

SEQ ID NO: 21084 - protein, 182 aa, Prochlorococcus marinus subsp. marinus str. CCMP1375
MKNRLLFLGPPGAGKGTQASLICKDQGFLHLSTGDLLREEVSGGTDLGKKAELIMNKGELVSDEIVISIVEKRLIKYSEGWLLDGFPRNLAQASLLQNLLGRISQPIEIVLLIEIDDEILTERMLGRGRKDDNKAVIKNRLKIYKDQTSPLVDHYKKQGILKSINGCGSVEDVNSRIKEALS

SEQ ID NO: 21085 - protein, 478 aa, Prochlorococcus marinus subsp. marinus str. CCMP1375
MTQSSLIPVILCGGSGTRLWPLSRESYPKQFWDLTGDSNKTLLQQTHQRIQNIRGLQEPYLICNEKHRFIVAEQMREINVQPQAIFLEPVGRDTAPAVTIAALKAQEKGEDPLLLVLSSDHIIANNENFTKAIDEGRQAAESGKLVTFGIYPTAPETGYGYIEATENDNKSLIALPIKRFVEKPDLKTAEQFLKDSRFTWNSGMFLFKASVILQEIERFSPEILSHCKKALKDNSKDLDFLRLNVQAFHKCPSLSIDKAVMEKTNLGAVLQLNAGWNDIGSWQSLWETSTKDKNGNVLKGKVILEDSKNCYLRSEKRLVVGLGVKDLIVVETDDAVLVADRQQSQKVKSIVATLKNNKSAEAKAHTKIYRPWGHYTSIVQGKRWQVKKIEVKSGASLSLQMHHHRSEHWVVVKGTALVERDGEKQLLEENQSTYIPLGCKHRLTNPGKIPLELIEVQSGAYIGEDDIVRIDDNYGRKN

SEQ ID NO: 21086 - protein, 338 aa, Prochlorococcus marinus subsp. marinus str. CCMP1375
MKNPNVICFGEALVDRLGPLGGDPASDKPVDDCLGGAPANVASGLARLGINAAFVGCLGNDSIGNQFRELFMARGVNFAGLQIHESLLSRIVLVYRDLNGERSFGGFAGDQSNIFADQYLDLNVHKKIFPSLLDEAKWLLLGTIPLAVEHSREVVQWTIEQSLNNGLQIAFDLNWRPTFWDINMTPNNPPDTKTCSLITSFLEHASLIKLAKEEAEWFFNSKDPWEISNALPEKPSVIVTDGAQPINWVLGGFSGQTPALSPQKVVDTTGAGDAFMAGLMTQIISFSSQPKLFSEAEAMIQFSAGCGALVCGAPGAIEPQPSYSEVQSLLSSFLNDRS

SEQ ID NO: 21087 - protein, 287 aa, Prochlorococcus marinus subsp. marinus str. CCMP1375
MFENENPNGSWLDEYQNDVRYGLKGKKIIEEISNFQKITIFESNRYGKALLLDNCWMTAEYQEKQYHECIVHPALCGSKEINKVLIIGGGDGGSARECLKYQELKNLDLIEIDKRVVELSQQYLSVIGGNCWKDQRLNLKLTNGINWVKDAKDNSYDVIIIDGSDPKGPAKGLFNKDFFKDCHRILKPDGVLGAQTESPESFEDIHINTVKMIKEVFKYADPLYGYVPIYPSGIWSWTFASIKKPRHLYPIISRANTISKTCQVWSPRWQRGGFDAIPANIERKLQQ

SEQ ID NO: 21088 - protein, 303 aa, Prochlorococcus marinus subsp. marinus str. CCMP1375
MNKSNQNKDPIFNCDDAIYMCAKREVDNCNLGIYGVNYDGTTSFRPGARFGPSSIRQVSNGIESFCPQLNLDLEDINFTDFGNLEINFGAPEPVIKKVKTASNFIYSLGMKPLLIGGEHSITIGSIQSTIEYFPNLILIQLDAHADLREEWLGSKFNHACVMRRCLEMISSERVFQVGIRSGTKKEMHELRKTKRLVNFISGQPAKELYNALNPHKGKPIYLTVDVDWFDPSVISGTGTPEPGGFTWQDFSAIINVLQNHKIIGADIVELAPQLDPSGVSSIVGAKITRSLIMLLSISQSTIR

SEQ ID NO: 21089 - protein, 445 aa, Clostridium cellulovorans
MEKLRFPKDFIFGTATAAYQIEGAYKEDEKGESIWDRFSHIPGNVAKMHNGDIACDHYHRYKEDVQLLKSLGIKSYRFSIAWPRIFPKGFGEINQKGIQFYRDLIDELIKNDIEPAITIYHWDLPQKLQDIGGWANPQVADYYVDYANLLFREFGDRVKTWITHNEPWVASYLGYALGVHAPGIKDMKMALLAAHNILLSHFKAVKAYRELEQDGQIGITLNLSTCYSNSADEEDIAAAHRSDGWNNRWFLDAALKGTYPEDMIKIFSDTNIMPELPKELFTEVFETSDFLGINYYTRQVVKNNSEAFIGAESVAMDNPKTEMGWEIYPQGLYDLLTRIHRDYGNIDLYITENGAAFNDMVNRDGKVEDENRLDYLYTHFAAALSAIEAGVPLKGYYIWSFMDNFEWAEGYEKRFGIVHVNYKTQERTIKKSAYWYKELIERSNK

SEQ ID NO: 21090 - protein, 450 aa, Shewanella massilia
MSEQLSSTAVPSGSFLDRYFSIQQRGSTVRQEVIAGLTTFLAMVYSVIVVPNMLGQAGFDPGAVFIATCLIASFGSLLMGLWANLPMAIGCAISLTAFTAFSLVLGQGMSIPVTLGAIFLMGVTFTLVSVTGIRQWVLANLPKGIAHGTGIGIGLFLLLIATNSVQLIVANSAGLPVKLGDINSLPVIATILGLAATIGLERRGVPGGILLVIIALSVFGLVFDPSVKYQGLFALPDLTSEHSLIGQLDIMGAFNPVVLPIVLALVMTAIFDATGTIRAVAGQANLFDKDDNIVGGGKALTSDSVSSMVAGLVGGAPAAVYIESAAGTAAGGKTGLTATIVGVLFLLMMFLAPLSYLVPAYATAPALMYVGLLMLSNVAKLDFDDKVDAMAGLTCAVFIILSCNIVTGIMLGFVTLVVGRICSGEWRKLKVGVLAITLGLVVFYMGGWAI

SEQ ID NO: 21091 - protein, 458 aa, Marchantia paleacea
MPKRSNGSLVVRCAVSVVRFSKENVSCDLASENFTFSRDSFPVVSTVLRVSEAVYRMAAVASLGSALSVSSAALSQNVSVSNNATKESAFLGLRMGEVAKFGGALLSVSTVAANLKSKPGVLSVNAVTAPAETMNKPSSKKTATKSTCIITGASSGLGLATAKALADTGEWHVIMACRDFLKAERAARSVGIPKDSYTVIHCDLASFDSVRAFVDNFRRTERQLDVLVCNAAVYFPTDKEPKFSAEGFELSVGTNHMGHFLLARLLMEDLQKAKDSLKRMIIVGSITGNSNTVAGNVPPKANLGHLRGLAGGLNGVNSSSMIDGGEFDGAKAYKDSKVCNMFTMQEFHRRYHAETGITFSSLYPGCIAETGLFRNHVTLFRTLFPPFQKYITKGYVSEEEAGKRMAQVVSDPKLSKSGVYWSWNKDSGSFENELSEEASNPEKAKRLWELSERLSGLV

SEQ ID NO: 21092 - protein, 482 aa, Solanum tuberosum
MASATASHTFCGIPTTSSSSTTNRSTTHSSARFLLKTPLRRLGFAGAVADPLFTNHVATKLRSLKASSNPVRAVVSMAKKSVGDLSSSDLKGKKVFVRADLNVPLDDAQNITDDTRIRAAIPTIKHLIANGAKVILSSHLGRPKGVTPKYSLAPLVPRLSELLGIQVVKADDCIGPEVEKLVDSLPEGGVLLLENVRFYKEEEKNEPEFAKKLASLADLFVNDAFGTAHRAHASTEGVTKFLKPSVAGFLLQKELDYLVGAVSTPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSIKTFNDALDTTKTVIWNGPMGVFEFDKFATGTEAIAKKLADLSGKGVTTIIGGGDSVAAVEKVGVASVMSHISTGGGASLELLEGKVLPGVIALDEADAPVAV

SEQ ID NO: 21093 - protein, 512 aa, Streptomyces clavuligerus
MVTAAISGTDEIRARAEQALTRCGVDLTAVKGDALTARTPLTGADLFGLRAQTPEDVDRAVEAAHTAFLTWRTTPAPVRGALVKRFGELLTEHKQDLADLVTIEAGKIRSEALGEVQEMIDICDFAVGLSRQLYGRTMPSERPGHRLMETWHPLGVVGVISAFNFPVAVWAWNAAVALVCGDTVVWKPSELTPLTALACAALLDLAIADAGAPKGLNQVVVGAADVGERLVDSPRVPLVSATGSTRMGRAVGPRVAARFGRTILELGGNNAAVVTPSADLDLTVNAAVFAAAGTAGQRCTTLRRLIVHEDIADTVVERLTAAFERLPIGDPFQDTTLVGPLVNEAAFGRMREAVERATAEGGTLCAGGERQFPDAAPGAYYVRPALVRMPAQTAVVREETFAPILYVLTYRDLDEAIRLNNEVPQGLSAGIFTADQSEAERFLAPDGADCGIANVNIGTSGAEIGGAFGGEKETGGGRESGSDAWRAYMRRATNTVNYSGRVALAQGVDFSQ

SEQ ID NO: 21094 - protein, 291 aa, Arabis gemmifera
MTNNFQRALGEGGFGIVYHGHLNDSEEVAVKVELLLRVHHTNLVSLVGYCDERGHLALIYEYMSNVDLKHHLSGKHDVSILKWSTRLRIAIDAALGLEYLHIGCRPSMVYRDVKSTNILLDERFTAKIADFGLSRSFQLGDESHISTVVAGTPGYLDPETGRLAEMSDVYSFGIVLLEMMTNQRVIDQNREKRHITEWVALVLNRGDITKIMDPNLYGDYNSNSVWKALELAMSCANSSSEKRPSMSQVISVLKECLTSENLMRNKNHDMESDSSLELTKSFDTEVVPRAR

SEQ ID NO: 21095 - protein, 161 aa, Vibrio cholerae
MRDITPDLCDKYESQVTLLNLPLQNFGQRSAFWGEIVTVRCYHDNSKVRDVLSQNGKGKVLVVDGHGSCHKALMGDQLAILAIKNDWEGVIIYGAVRDVVAMSEMDLGIKALGTSPFKTEKRGAGQVNVTLTMQNQIVEPGDYLYADWNGILMSETALDVA

SEQ ID NO: 21096 - protein, 208 aa, Arabidopsis thaliana
SSSSSPSSSIKRKLSYLLPLCVALVVIAEIGFLGRLDKVALVDTLTDFFTQSPSLSQSPPARSDRKKIGLFTDRSCEEWLMREDSVTYSRDFTKDPIFISGGEKDFQWCSVDCTFGDSSGKTPDAAFGLGQKPGTLSIIRSMESAQYYPENDLAQARRRGYDIVMTTSLSSDVPVGYFSWAEYDIMSPVQPKTERAIAAAFISNCGAR

SEQ ID NO: 21097 - protein, 499 aa, Oryza sativa (indica cultivar-group)
MGRVAPSVEEVGGEQPPPALGPGETVSGTVAELRAAYESGRTRSLEWRQSQLRGLLRLLAEEEAAAFRALREDLGKHQAEAYRDEIGVLVKSANAALREVGKWMAPEKVWVPLIAFPARAQLEPQPLGVILVFSCWNVPLGLSLEPLVGALAAGNAVALKPSELAPATAKFLGDNVGKYMDATAVKVIQGGPEVGEQLMEHRWDKVLFTGSPRIARVVMAAAAKHLTPVALELGGKCPCIFDTIGGSARDLQTAVNRVVGGKWSSCAGQACLAIDYVLVEERFVPVLIKALKSTLKKFFADSDHMARIVNARHFQRLSDLLKDKSVAASVLHGGTLDAKNLCIEPTILLNPPLDSAIMTEEIFGPLLPIITVKKIEDSIAFVRARPRPLAVYAFTKNAALRRRIVEETSSGSVTFNDAVVQYGIDSLPFGGVGESGFGQYHGKYSFEMFSHKKAVLTRGYLIELTARYPPWDDSKISMMRQLYRYNYVGFVLTFLGLKK

SEQ ID NO: 21098 - protein, 496 aa, Pastinaca sativa
MIGVWCMLLAYTLVSIGRIRAKATRKLPPGPFPLPIIGNIHKLGKHPHKSLANLAQVYGPIMRLKLGHMTTVVISSSTTARQVLRKQDIAFSNRALPNAVRALDHNKYSAVWLPVGSQWRGLRKIMSMNLFTANKLDANQHLRSQKVHDLIRYCEKCSQSGEAVDIGGAAFLTSLNLMSNTIFSKDMIDSYENSEAKVFRDLVWNIMVEIGKPNLVDYFPLLQWMDPQGIKRRLAYNFDTLIKLFDVMVDERLELNGPQNSRDVLDELLKLVNTDEIDKSHIQHMFLDLFGAGTDTSSSTVEWAMSEILRKPATVLVKAKAELDQVIGNGKIVEEADISKLDYLRCIVKETLRLHPPAPLLVPRQVQEEVELCGYTVPKNSQVLVNAWAIGRDPMLWENPLSFQPERFVDSEIDINGHGYELIPFGAGRRICPGMPLAMRMVPIMLGSLLNCFDWKLQGGIAPEDLNMEDKFGLTLAKLHPLRVVPTSRPTHLFAF

SEQ ID NO: 21099 - protein, 462 aa, Sorghum bicolor
MAASPSPRAAALRGPSLTALLFLVAAVVSVPPVAAEIRETAIRADPRSIIPLDEFGFSHSGVLELNVSGIAFDPPASAELDLSQLGFFLSTLDAWVHVLRQLQDLDVTCALQSELVKLASSFDLLRPPSNPAGVEVARSSSFSTAFRVNEPGQYTLVFANCLGGGLKVDMDVRSAMYNIDQATGERQYLSAGASALPSFYFLFCLAYAGLAAAWVAILLRKRAAVFRIHYFMLAVLVLKALNLLAEAEDKSCIERTGTAHGWDVLFYIFSFLKGISLFTLIVLIGTGWSFLKPYLADREKKVLMVVIPLQVVANIAQVVIDESGPYARDWVTWKQIFLLVDVVCCCAVLFPIVWSIKNLREAARSDGKAAVNLMKLTLFRQYYVVVICYIYFTRVVVYALQTITSYRYLWTSVVAGELATLAFYVFTGYKFRPEVHNPYFAIDDEEEEAAAEALKLDDEFEL

SEQ ID NO: 21100 - protein, 414 aa, Zea mays
MAGRSAPTLPPLNNRTPTPHPNPLAPASPPHPRVPLTRLVRPYRTINVPPRLPCPPHARHSLVLQHIMEGAAAVETAAAANGKTCCHTAKGPGYATPLEAMEKGPREKLVYVTCVYNGTGINKLDYLATVDLDPSSPTYSQVIHRLPVIHIGDKLHHSGWNSCSSCHGDPSAKRRFLILPSLLSGRVYVVDTATDPRTPSLHKVVESEDIAENIGLGFPHTSHCLASGDIMISCLGDKEGNAAGNGFLLLDSEFNVKGRGSNRLFPISKERTHLYENYAWGLFWSWIQCCSLFYTTGAELMCLTASGVHVISCLDNYIMRVIDESLPLQDQAGANNPILCLRSIHWKNINQDYDVVEVSFSGRGGSDPDAYAVVLKRKLDLYYAVVAKFGVVSLSNEFPPAWIFFSDLLIIFLS

SEQ ID NO: 21101 - protein, 219 aa, Lactobacillus delbrueckii subsp. lactis
GETEFWFAMIKIIAIISLVVTGIIMVAANAKTPVGHASLSNFTGSFSLLPKGKYAFFTAFPMVFFSFAGIEFVTITIGEAKNPKKVIKKAVNETLLRILLFHIATLAVIMCVIPWGKITSGTSPFVQVFKIAGFNAVASVFNFVVLTAAASSLNSGIFSAGRHFFQLAEEAPKDSFLKKHFAKISANGVPAAGIVISVALMLIAPIMSFSSTAIEVFGT

SEQ ID NO: 21102 - protein, 107 aa, Lactobacillus delbrueckii subsp. lactis
  misc_feature (104)..(104): Xaa can be any naturally occurring amino acid
LKAAEGSNLHVGAENCYWENSGAFTGETSPAVLKEMGVQYVIIGHSERRDYFHETDEDINKKAKAIFANGLTPILCCGESLEIREAGKEKEWVVSQIKADLEGXTSE

SEQ ID NO: 21103 - protein, 164 aa, Lactobacillus delbrueckii subsp. lactis
RLRILVMNYPTNPTGVMYSQEELDALAAVIKDRPTFVLCDEIYSELNYDQEHASMAKSLRSQAIVLNGVSKSWAMTGYRIGIMAAPQEITDQLAKVHQFITTTEPTPMQDAAEEAFKNGDRDAREMKAAFKERRDYLYQALTETGFEVVKPQGAFYIWAKIPAG

SEQ ID NO: 21104 - protein, 104 aa, Lactobacillus delbrueckii subsp. lactis
  misc_feature (40)..(40): Xaa can be any naturally occurring amino acid
  misc_feature (45)..(45): Xaa can be any naturally occurring amino acid
KDGSTSLETRARLAAKAFRLTASYDALISQYLAEKAGETXPEKLXLTYDLKEAMRYGENSHQKAWLYGDALPKAFSVLQAEQLNGKQLSYNNIKDADEALRCVR

SEQ ID NO: 21105 - protein, 104 aa, Lactobacillus delbrueckii subsp. lactis
  misc_feature (56)..(56): Xaa can be any naturally occurring amino acid
  misc_feature (98)..(98): Xaa can be any naturally occurring amino acid
RIVSRFGNDQQYRERSAKMLALLLHGLRGTPYIYQGEEIGMTNCPVSAIDEVEDIXARRMYQERLAEGWKKEDLIKAINAQGRDNARTPMQWDASASXGFTSGR

SEQ ID NO: 21106 - protein, 146 aa, Lactobacillus delbrueckii subsp. lactis
  misc_feature (38)..(38): Xaa can be any naturally occurring amino acid
  misc_feature (122)..(122): Xaa can be any naturally occurring amino acid
  misc_feature (134)..(134): Xaa can be any naturally occurring amino acid
MTKVVIENVHAREIFDSRGNPTVEVEVTLSNGVVGRAXVPSGASTGENEAVELRDGGSRLGGKGVMKAVNNVNTAINNELQGADPFNQPAIDKAMIELDGTPNKGKLGANAILGTSMATAVXAAKATHQPLYRXLGGTDLSMPQTF

SEQ ID NO: 21107 - protein, 233 aa, Bacillus subtilis
MGKGKVMDSYQDAAALIKDGDTLIAGGFGLCGIPEQLILAIRDSGVKNLTVVSNNCGVDDWGLGLLLANRQIKKMVASYVGENKTFERQFLSGELEVELVPQGTLAERIRAGGAGIPAFYTPAGVGTSVAEGKEHKTFDGRTYLLEKGITGNAAIVKAWKADPLGNLMFRKTARNFNPLAAMAGKVTIAEAEEIVDAGELDPDQIHTPGIFVQHVLLGGIHEKRIERRTVRQA

SEQ ID NO: 21108 - protein, 3982 aa, Bacillus subtilis
MYTSQFQTLVDVIRERSSISDRGIRFIESDKNETVVSYRQLFEEAQGYLGYLQHLGIKPKQEIVFQIQENKSFVVAFWACILGGMIPVPVSIGEDDDHKLKVWRIWNILNHPFLIASEKVLDKIKKYAAEHDLQDFHHQLNEKSDIIQDQTYDYPASFYEPDADELAFIQFSSGSTGDPKGVMLTHHNLIHNTCAIGTALTVHSKDSFLSWMPLTHDMGLIACHLVPFITGINQNLMPTELFIRRPILWMKKAHEHKASILSSPNFGYNYFLKFLKNEPDWDLSHIKVIANGAEPILPELCDEFLKRCAAFNLKRSAILNVYGLAEASVGARFSKIGKEFVPVYLHRDYLNLGERAVKVSKEDQNCASFVEVGQPIDYCQLRISDETNERVEDGIIGHIHIKGDNVTQGYYNNPESTEKALTSDGWVKTGDLGFISESGNLVVTGREKDIIFVNGKNIYPHDIERVAIEMEEVDLGRVAACGVYDQKTQSGEIVLFVVYKKSPEKFAPLVKEIKKHLYKRGGWSIKEVLPIRKLPKTTSGKVKRYELARQYEAGNFSTESAAINECLESSTETSGQTPIHEIETELLSIFSDVLNGKKVHLADSYFDMGANSLQLSQIAERIEQKFGRELAVSDLFTYPSITDLAAYLSESRAEIKQDAAAKPSHVTPKDIAIIGLSLNVPGASTKSDFWNLLEKGEHSIREYPESRLKDAADYLKSIQSEFNESQFVKGGYLDEIDRFDYSFFGLAPKTAQFMDPNQRLFLQSAWHAIEDAGYAGGSMNGSRVGVYAGYSKVGYDYERLLSANYPEDLHQYIVGNLPSVLASRIAYFLNLKGPAVTVDTACSSSLAAVHMACKSLISGDCEMALAGGIRTSLLPICIGLDMESSDGYTKTFSKDSDGTGTGEGAAAVLLKPLQDAVRDGDHIYGVIKGRAMTQDGTTAGITAPNPAAQTEVIETAWKDAGIAPETLSFIEAHGTGTKLGDPVEFNGLCKAFEKYTAKKQFCAIGSVKSNIGHLFEAAGIVGLIKSVLMLNHKKNPPLAHFNEPNPLIHFHSSPFYVNQEAAAFTSGDEPLRGGISSFGFSGTNAHVVLEEYISQSEYAPEDEHGPHLFVLSAHTEKSLYELAQQYRQYVSDDSQASLKSICYTASTGRAHLDHGIAMIVSGKQELSDKLTRLIQGDRNLPGVYIGYKNMKEMLPAHKEELNQQAAALIKQRLRTQDERITWLHRAAELFVQGAVIDWRALYSGETVQKTPLPLYPFERSRCWAEADQLRLNEGEKKGGAALNINQSKAHIESFLKTVISNASGIRAEELDLNAHFIGLGMDSIMLSQVKKAIADEFGVDIPMDRFFDTMNNLQSVIDYLAETVPSSFASAPPQENVPAQEIQVISEAQSESDRREGHQEHMLEKIIASQNQLIQDTLQAQLNSFNLLRNSGHHSDEKEYAKAQKKSIPSVKQGHPTVNAEKKAAQEAKPYVPFQPQNLNDQGHYTARQKQYLEDFIKKYADKTKGSKQYTDNTRFAHANNRNLSSFRSYWKEIVYPIIAERSDGSKMWDIDGNEYIDITMGFGVNLFGHHPSFITQVIDDSTRSSLPPLGPMSDVAGEVADRIRTCTGVERVAFYNSGTEAVMVALRLARAVTGRKKVVAFSGSYHGTFDGVLGVAGTKGGAASANPLAPGIPQSFMDDLIILHYNNPDSLDVIRSLGDELAAVLVEPVQSRRPDLQPRPFLKELRAITQQSGTALIMDEIITGFRIGLGGAQEWFGIQADLVTYGKIIGGGQPLGVVAGKAEFMNAIDGGTWQYGDDSYPQDEAKRTFVGGTFNTHPLTMRMSLAVLRHLQTEGEHLYEQLNQKTAYLVDELNRCFEQAQVPIRMVRFGSLFRFVSSLDNDLFFYHLNYKGVYVWEGRNCFLSAAHTADDIENIIQAVKDTVEDLRRGGFIPEGPDSPDGGGRKKSGTRELSPEQKQLVMASHYGNEASAALNQSIMLKVKGELQHTPLKQAVRHIVDRHEALRTVIHPDDEVQQVQERMNIDIPVIDFTGLPHEHREPEIQKWLTEDAKRPFHFHEQKPLFRIHVLTSAHNEHLIVLTFHHIIADGWSIAVFVQELESSYAAIVQGIPISPKEADVSFRQYLDWQQAQIDSGHYEEGVRYWRRHFSEPIQQPILPSTASVRYPNRYEGDRCTVRLGRPLSEALRSLSIQMKNSVFVTMLGAFHLFLHRLTKQSGLVIGIPAAGQSHMKQHALIGNCVNMIPVKNTSSSESTLSGYLGNMKESVNLAMRHQAVPMTLVARELPHDQVPDMRIIFNLDRPFRKLHFGKAEAEPVAYPVKCTLYDLFLNITDAHQEYVLDFDFNTNVISPEIMKKWGAGFTKLLQKMVEGDSIPLDAMMMFFDEEQHDLQALYADHQKRVSSIGSNTANFTEAYEAPVNETERQLARIWEELFGLERVGRSDRFLALGGNSLQATLMLSKVQKTFHQKVSIGQFFNHQTVKELARFIQNETKVIHLPMKTAEKKAYYPTSPAQQRVYFLHQLEPDQLAQNMFGHISITGKYDEQALISSLQQVMQRHEAFRTYFDIIDGDIVQKLENEVDFNVHVRTMSRDEFDAYSDRFVKPFRLDQAPLVRAELIKIENEQAELLIDMHHIISDGYSVNILTNELLALYHQKPLPDIEFEYKDFAEWQNQRLNDDAMKRQETYWLEQFQDEIPILDLPTDGSIAAERSSEGQRVTCSLQPDVIRSLQDLAQKAETTLYTVLLAAYNVLLHKYTGQEDIVVGTPASGRNHPDIEKIIGIFIQTIGIRTKPHANRTFTDYLEEVKRQTLDAFENQDYPFDRLVEKLNVQRETTGKSLFNTMFVFQNIEFHEIRHNECTFKVKERNPGVSLYDLMLTIEDAGQQIEMHFDYKPGRFTKDTIEQITRHYTAILNSLVEQPEMTLSSVPMLSETERHQLLTECNGTKTPYPHKETVYRWFEMQAEQSPDHEAVIFGNERYTYRQLNERANRLARTLRTKGVQADQFVAIICPHRIELIVGILAVLKAGGAYVPIDPEYPEDRIQYMLRDSRAEVVLTQRSLLDQLPYDGDVVLLDEENSYHEDHSNLESDSDAHDLAYMIYTSGSTGNPKGVLIEHQGLADYIWWAKEVYVRGEKTNFPLYSSISFDLTVTSIFTPLVTGNTIIVFDGEDKSAVLSEIMRDSRIDMIKLTPAHLHVIKEMNIAGGTAIRKMIVGGENLSTRLAKRVSEQLKGRLDIFNEYGPTEAVVGCMIYHFDAERDKREFVPIGTPAANTDIYVADASRNLVPFGVIGEIYISGPGVARGYWNRPDLTAEKFVENPYVPGAKMYKSGDLAKRLKDGNLAYIGRVDEQVKIRGHRIELGEIEAAMHNAEAVQKAAVTVKEEEDGLKQLCAYYVSDKPIAAAQLTEQLSSTLPDYMVPSYFVHLEHMPLTSNGKINRKALPAPEASLQQTAEYVPPGNETESKLTDLWKEVLGISHAGIKHNFFDLGGNSIRAAALAARIHKELDVNLSLKDIFKFPTIEQLADKALHMDKNRYVPIPAAKEMPYYPVSSAQRRMYLLSHTEGGELTYNMTGAMNVEGTIDPERLNAAFRKLIARHEALRTSFDLYEGEPAQRIHQNVDFTIERIQASEEEAEDRVLDFIKAFDLAKPPLMRAGLIEIAPARHVLVVDMHHIISDGVSVNILMKDLSRIYEGNEPDPLSIQYKDFAVWQQSDIQKRNIKSQEAYWLDQFHGDIPVLDMPADYERPAIRDYEGESFEFLIPEHLKQRLSQMEEDTGATLYMILLAAYTILLSKYSGQEDIIVGTPSAGRTHLDVEPVVGMFVNTLVIRNHPAGRKTFDAYLNEVKENMLNAYKNQDYPLEELIQHLHLPKDSSRNPLFDTMFVLQNLDHAELTFDSLQLKPYPFHHPVAKFDLTLSIQADRDNYHGLFEYSKKLFKKSRIEVLSNDYLHILSAILEQPSILIEHIGLSGSNEEEENALDSIQLNF

SEQ ID NO: 21109 - protein, 257 aa, Melilotus alba
MAIVATSFISILFFVLSLCLKGTYGDYGGGWQNAHATFYGGSDASGTMGGACGYGNLYSQGYGVNTAALSTALFNSGLSCGACFELKCSNDPSWCHPGSPSILVTATNFCPPNFAQPSDNGGWCNPPRPHFDLAMPMLLKIAQYRAGIVPVSYRRVPCRKQGGIRFSINGFRYFNLVLITNVAGAGDIVKTSVKGSKTGWMSMSRNWGQNWQSNSVLVGQSLSFRVTASDKRTSTSLNIVPSNWQFGQTFIGKNFRV

SEQ ID NO: 21110 - protein, 310 aa, Bacillus megaterium
MPLDPHIQIFLNQYNEMPRPSLEDVTPPQLREMEKMSLTPSKEAVKKVYNEEIELNERTLTLRVYEPEGTGPFPALVYYHGGGWVLGSLDTHDSICRSYANETNCIVVSVDYRLAPESKFPAAVNDAYDALDWISAHASQLNIDSNKIAVGGDSAGGNLAAVVSILAKQRQGPSIVHQLLIYPSVGFKNQHPASMKENAEGYLLSKDLMDWFRLQYLNNKEEEQHPYNAPVLLEDLSSLPSATIITAQYDPLRDSGKDYADALKNHGVPVTYENYETMIHGFLGFHEFVPLAQQAINKSAAQLRQVFDSI

SEQ ID NO: 21111 - protein, 190 aa, Cucumis sativus
NSLVIGAYGIVCSVLNSETNEMVAVKKIANAFDNHMDAKRTFREIKLLRHLDHENVIGIRDVIPPPLRREFNDVYISTELMDTDLHQIIRSNQSLSEEHCQYFLYQILRGLKYIHSANVIHRDLKPSNLLLNANCDLKICDFGLARPTSENECMTEYVVTRWYRAPELLLNSDYTAAIDIWSVGNRIPAA

SEQ ID NO: 21112 - protein, 182 aa, Cucumis sativus
YRGDWHGSEVAVKILTEQDFHPERVNEFLREVAIMKSLRHPNIVLFMGAVTKPPNLSIVTEYLSRGSLYRLLHKSGVKDIDETRRINMAFDVAKGMNYLHRRDPPIVHRDLKSPNLLVDKKYTVKVCDFGLSRLKAHTFLSSKSAAGTPEWMAPEVLRDEPSNEKSDVYSFGVILWESNSRG

SEQ ID NO: 21113 - protein, 328 aa, Petunia integrifolia subsp. inflata
MAVNGVSSGGLIVSFGEMLIDFVPTVSGVSLAEAPGFLKAPGGAPANVAIAVTRLGGNSAFVGKLGDDEFGHMLAGILKENGVKAEGINFDTGARTALAFVTLRADGEREFMFYRNPSADMLLTPDELNLDVIRSAKIFHYGSISLIVEPCRSAHLKAMEVAKEAGALLSYDPNLRLPLWPSAEEARKQIKSIWDKADVIKVSDNELEFLTGSDKIDDESAMSLWHPNLKLLLVTLGEKGCRYYTKNFHGGVEGFHVKTVDTTGAGDSFVGALLTKIVDDQSILEDEARLKEVLTFACACGAITTTKKGAIPALPTESEALTLLKRGA

SEQ ID NO: 21114 - protein, 328 aa, Petunia integrifolia subsp. inflata
MAVNGASSGGLIVSFGEMLIDFVPTVSGVSLAEAPGFLKAPGGAPANVAIAVTRLGGNSAFVGKLGDDEFGHMLAGILKENGVKAEGINFDTGARTALAFVTLRADGEREFMFYRNPSADMLLTPDELNLDVIRSAKIFHYGSISLIVEPCRSAHLKAMEVAKEAGALLSYDPNLRLPLWPSAEEARKQIKSIWDKADVIKVSDNELEFLTGSDKIDDESAMSLWHPNLKLLLVTLGEKGCRYYTKNFHGGVEGFHVKTVDTTGAGDSFVGALLTKIVDDQSILEDEARLKEVLTFACACGAITTTKKGAIPALPTESEALTLLKRGA

SEQ ID NO: 21115 - protein, 300 aa, Atriplex nummularia
MSSKAEPPAEVSLSVPPTPEGTPAPLISSRRVDSLSYERSSMPRCNCFPDGPLGFGSGPACFTDFKVPDVTLTRKLVAEFVGTFILIFAATAGPIVNEKYNGAETLIGNAACAGLAVMIIILSTGHISGAHLNPSLTIAFAALRHFPWIQVPAYIAAQVAASILASLALKGVFHPFMAGGVTVPSVGIGQAFALEFLITFNLMFVVTAVATDTRAVGELAGIAVGATVMLNILVAGPSSGASMNPVRTLGPAVAAGNYRAVWIYLVAPTLGALGGAAIYKLVQLQEHEVEPPRPTRSFHR

SEQ ID NO: 21116 - protein, 294 aa, Atriplex nummularia
PPAEVSLSVPPTPEGTPAPLISSRRVDSLSYERSSMPRCNCFSDGPLGFGSGPACYTNFKVPDVTLTRKLLAEFVGTFILIFAATAGPIVNEKYNGAETLIGNAACAGLAVMIIILSTGHISGAHLNPSLTIAFAALRHFPWIQVPAYIAAQVAASILASLALKGVFHPFMAGGVTVPSVGIGQAFALEFLITFNLMFVVTAVATDTRAVGELAGIAVGATVMLNILVAGPSSGASMNPVRTLGPAVAAGNYRAVWIYLVAPTLGALGGAAIYKLVQLQEHEVEPPRPTRSFRR

SEQ ID NO: 21117 - protein, 276 aa, Haemophilus influenzae
MSNFNQISRRDFVKASSAGAALAVSNLTLPFNVMAKETQYLNENSQERIVWSACTVNCGSRCPLRMHVKDNRITYVETDNTGTETYNLDHQVRSCLRGRSMRRRVYNPDRLKYPMKRIGKRGEGKFKRISWDEALTEIADALKRNIKKYGNESIYLNYGTGTLGGTMAKSWPPASTMIARFMNCIGGYLNHYGDYSTAQIAVGLDYTYGGGWALGNGMADIENTKLIVLFGNNPAETRMSGGGLTYCIEQAKARSNAKMIIIDPRYNDTGAGREDE

SEQ ID NO: 21118 - protein, 298 aa, Oryza sativa
NKTKIVDAGALEPLLGYLQSSDLNLQEYATAALLTLSASSTTKPIISASGAIPLLVKVLKEGNSQAKNDSVMALYNLSTVTDNLQTILSVQPIPSLIELLKGGKRSSKTADKCCALLESLLSFDQGRAALISEEGGVLTIVEVLEEGSLQGREHAVGALLTMCESDRNKYRDIILNEGAIPGLLELTVHGTPKSRVKAHVLLDFVRNSPYSRSKLPADTLENIVSNIASQIDGEDRGGKAKKMLAEMVKVSMEQSLRHLQRRASLLHDQVIGTFCNGSRHSGNNEFAGDAGPGLDRTE

SEQ ID NO: 21119 - protein, 431 aa, Pantoea endophytica
  misc_feature (91)..(91): Xaa can be any naturally occurring amino acid
  misc_feature (228)..(228): Xaa can be any naturally occurring amino acid
  misc_feature (230)..(230): Xaa can be any naturally occurring amino acid
  misc_feature (367)..(367): Xaa can be any naturally occurring amino acid
  misc_feature (399)..(399): Xaa can be any naturally occurring amino acid
MAVMGRNLALNIESRGYTVSVFNRSRDKTEEVIAENPGKKLVPFYTVKEFVESLETPRRILLMVKAGAGTDAAIDSLKPYLEKGDIIIDGXNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDXFXKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRASSCRKITDXYAENAGIANLLLAPYFKKIADEYQQALRDVVXYAVQNGIPVPTFSAAVAYYDSYRAAVLPANLI

SEQ ID NO: 21120 - protein, 431 aa, Pantoea endophytica
  misc_feature (7)..(7): Xaa can be any naturally occurring amino acid
  misc_feature (424)..(424): Xaa can be any naturally occurring amino acid
MAVMGRXLALNIESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVRYAVQNGIPVPTFSAAVAYYDSYRAXVQPANLI

SEQ ID NO: 21121 - protein, 431 aa, Pantoea endophytica
  misc_feature (32)..(32): Xaa can be any naturally occurring amino acid
  misc_feature (46)..(46): Xaa can be any naturally occurring amino acid
  misc_feature (149)..(149): Xaa can be any naturally occurring amino acid
  misc_feature (419)..(419): Xaa can be any naturally occurring amino acid
MAVMGRNLALNIESRGYTVSVFNRSRDKTEEXIAENPGKKLVPFYXVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKXAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVPYAVQNGIPVPTFSAAVAYYXSYRAAVLPANLI

SEQ ID NO: 21122 - protein, 431 aa, Pantoea endophytica
  misc_feature (40)..(40): Xaa can be any naturally occurring amino acid
MAVMGRNLALNIESRGYTVSVFNRSRDKTEEVIAENPGKXLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVPYAVQNGIPVPTFSAAVAYYDSYRAAVLPANLI

SEQ ID NO: 21123 - protein, 431 aa, Pantoea endophytica
  misc_feature (418)..(418): Xaa can be any naturally occurring amino acid
  misc_feature (427)..(427): Xaa can be any naturally occurring amino acid
MAVMGRNLALNIESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVVYAVQNGIPVPTFSAAGGYXNSYRAAVLXANLI

SEQ ID NO: 21124 - protein, 431 aa, Pantoea endophytica
  misc_feature (415)..(415): Xaa can be any naturally occurring amino acid
  misc_feature (419)..(419): Xaa can be any naturally occurring amino acid
  misc_feature (431)..(431): Xaa can be any naturally occurring amino acid
MAVMGRNLALNIESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEIAKIFRAGCIIRAQFLQKITDAYAENAGIANLLLAPYFKKIADEYQQALRDVVPYAVQNGIPVPTFSAAXAYYXSYRAAVLPANLX

SEQ ID NO: 21125 - protein, 426 aa, Pantoea endophytica
  misc_feature (9)..(9): Xaa can be any naturally occurring amino acid
  misc_feature (13)..(13): Xaa can be any naturally occurring amino acid
  misc_feature (32)..(32): Xaa can be any naturally occurring amino acid
  misc_feature (35)..(35): Xaa can be any naturally occurring amino acid
  misc_feature (279)..(279): Xaa can be any naturally occurring amino acid
  misc_feature (330)..(331): Xaa can be any naturally occurring amino acid
  misc_feature (346)..(347): Xaa can be any naturally occurring amino acid
  misc_feature (372)..(372): Xaa can be any naturally occurring amino acid
  misc_feature (408)..(408): Xaa can be any naturally occurring amino acid
  misc_feature (418)..(418): Xaa can be any naturally occurring amino acid
  misc_feature (425)..(425): Xaa can be any naturally occurring amino acid
RNLALNIEXRGYXVSVFNRSRDKTEEVIAENXGKXLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELBSYLIDITKDIFTKKDEEGKYLVDVILDEAANKGTGKWTSQSSLDLGEPLSLITESVFARYISSLKXQRVAASKVLSGPQAKPAGDKSVFVEKVRRALYLGKIVSYAQGFSQLRAASXXNNWDLNYGEIAKIFXXGCIICREFLQKITDAYAENAGIANXLLAPYFKKIADEYQQALRDVVAYAVQNGIPVPTFSXAVAYYDSYRXAVLPANXI

SEQ ID NO: 21126 - protein, 431 aa, Pantoea endophytica
  misc_feature (346)..(346): Xaa can be any naturally occurring amino acid
  misc_feature (388)..(388): Xaa can be any naturally occurring amino acid
MAVMGRNLALNLESRGYTVSVFNRSRDKTEEVIAENPGKKLVPFYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPQAKPAGDKSVFVEKVRRALYLGKIVSYAQGFSQLRAASDENNWDLNYGEXAKIFRAGCIIRAEFLQKITDAYAEKRRIANLLLAPYFKKIAXEYQQALRDVVAYAVQNGIPVPTFSAAVAYYDSYRAAVLPANLI

SEQ ID NO: 21127 - protein, 426 aa, Pantoea agglomerans
  misc_feature (23)..(23): Xaa can be any naturally occurring amino acid
  misc_feature (25)..(25): Xaa can be any naturally occurring amino acid
  misc_feature (166)..(166): Xaa can be any naturally occurring amino acid
  misc_feature (227)..(227): Xaa can be any naturally occurring amino acid
  misc_feature (334)..(334): Xaa can be any naturally occurring amino acid
  misc_feature (362)..(362): Xaa can be any naturally occurring amino acid
  misc_feature (398)..(398): Xaa can be any naturally occurring amino acid
  misc_feature (426)..(426): Xaa can be any naturally occurring amino acid
RNLALNIESRGYTVSIFNRSREXTXEVIAENQGKKLAPFYTVEEFVESLEKPRRILLMVQAGEATDKTIASLTPHLDKGDILIDGGNTFYKDTIRRNKELSDQGFNFIGTGVSGGEEGALKGPSIMPGGQKEAYELVAPILDKIAARAEDGEACVAYIGPDGAGHXVKMVHNGIEYGDMQLIAEAYALLKGALGLNNEELAETFTEWNNGELSSYLIDITKDIFTKXDEEGKYLVDVILDEAANKGTGKWTSQSSLDLGEPLSLITESVFARYLSSLKTQRVAASKVLSGPQAKPSGDKAEFIEKVRRALYLGKIVSYAQGFSQLRAASEENNXDLHYGEIAKIFRAGCIIRAQFLQKITDXYAEDAGIANLLLAPYFKDIADQYQQALRDVVSYAIXNGIPTPTFSAAIAYYDSYRSEVLPANLX

SEQ ID NO: 21128 - protein, 430 aa, Pantoea oleae
  misc_feature (157)..(158): Xaa can be any naturally occurring amino acid
  misc_feature (379)..(379): Xaa can be any naturally occurring amino acid
  misc_feature (381)..(381): Xaa can be any naturally occurring amino acid
MAVMGRNLALNIESRGYSVSIFNRSREKTDEVVAENQGKNLVAHYSVEDFVDSLEKPRRILLMVQAGEATDKTIASLTPHLDKGDILIDGGNTFYKDTIRRNKELSEQGFNFIGTGVSGGEEGALKGPSIMPGGQKEAYELVAPILTEIAAVAEGEXXVAYMGPDGAGHYVKMVHNGIEYGDMQLIAEAYSLLKNALNLGNEELAKTFSEWNEGELSSYLIDITKDIFTKKDEEGKYLVDVILDEAANKGTGKWTSQSSLDLGEPLSLITESVFARYLSSLKTQRVAASKVLSGPTVQRGGDKAEFVEKVRRALYLGKIVSYAQGFSQLKAASDENNWDLHYGEIAKIFRAGCIIRAQFLQKITDAYADNANIANLLWXPXFKNTADEYQQALRDVVAYAVQNGIPTPTFSAAIAYYDSYRSAVLPANLI

SEQ ID NO: 21129 - protein, 431 aa, Pantoea agglomerans
  misc_feature (48)..(48): Xaa can be any naturally occurring amino acid
  misc_feature (74)..(74): Xaa can be any naturally occurring amino acid
  misc_feature (139)..(139): Xaa can be any naturally occurring amino acid
  misc_feature (159)..(159): Xaa can be any naturally occurring amino acid
  misc_feature (170)..(170): Xaa can be any naturally occurring amino acid
  misc_feature (369)..(369): Xaa can be any naturally occurring amino acid
MAVMGRNLALNIESRGYTVSIFNRSREKTDEVIAENQGKKLAPFYTVXEFVESLEKPRRILLMVQAGEATDKTXASLTPHLDKGDILIDGGNTFYKDTIRRNKELSDQGFNFIGTGVSGGEEGALKGPSIMPGGQKEAXELVAPILDKIAARAEDGEAXVAYIGPDGAGXYVKMVHNGIEYGDMQLIAEAYALLKGALGLNNEELAETFTEWNNGELSSYLIDITKDIFTKKDEEGKYLVDVILDEAANKGTGKWTSQSSLDLGEPLSLITESVFARYLSSLKNQRVAASKVLSGPQAKPSGDKAEFIEKVRRALYLGKIVSYAQGFSQLRAASEENNWDLHYGEIAKIFRAGCIIRAQFLQKITDAYXEDAGIANLLLAPYFKDIADQYQQALRDVVSYAIQNGIPTPTFSAAIAYYDSYRSEVLPANLI

SEQ ID NO: 21130 - protein, 431 aa, Pantoea agglomerans
  misc_feature (11)..(12): Xaa can be any naturally occurring amino acid
  misc_feature (378)..(378): Xaa can be any naturally occurring amino acid
  misc_feature (421)..(421): Xaa can be any naturally occurring amino acid
MAVMGRNLALXXESRGYTVSIFNRSREKTDEVIAENQGKKLAPFYTVEEFVESLEKPRRILLMVQAGEATDKTIASLTPHLDKGDILIDGGNTFYKDTIRRNKELSDQGFNFIGTGVSGGEEGALKGPSIMPGGQKEAYELVAPILDKIAARAEDGEACVAYIGPDGAGHYVKMVHNGIEYGDMQLIAEAYALLKGALGLNNEELAETFTEWNNGELSSYLIDITKDIFTKKDEEGKYLVDVILDEAANKGTGKWTSQSSLDLGEPLSLITESVFARYLSSLKTQRVAASKVLSGPQAKPSGDKAEFIEKVRRALYLGKIVSYAQGFSQLRAASEENNWDLHYGEIAKIFRAGCIIRAQFLQKITDAYAEDAGIANLXLAPYFKDIADQYQQALRDVVSYAIQNGIPTPTFSAAIAYYDSXRSEVLPANLI

SEQ ID NO: 21131 - protein, 261 aa, Nicotiana tabacum
MEAANHNNDNGCTNESPYISSVLPGWFSEISPLWPGEAHSLKVEKILFQGKSDYQNVMVFQSSTYGKVLVLDGVIQLTERDECAYQEMIAHLPLCSIPNPKKVLVIGGGDGGVLREVSRHSSVEQIDICEIDKMVVEVSKQFFPDVAVGYEDPRVNLHIGDGVAFLKNVAAGTYDAVIVDSSDPIGPAQELFEKPFFDSIARALHPGGVVSTQAESIWLHMHIIEEIVANCRQIFKGSVNYAWTTVPTYPSGMIGFMLCST

SEQ ID NO: 21132 - protein, 230 aa, Pyrus pyrifolia
HKAVAGAIVVGVILHAGNHLACDFPRLIKVPESDYEKYLHHDFGKHKPTYLDLVKGAEGVTGIIMVICMIIAFTLATRWFRRSLIKLPKPFNRLTGFNAFWYSHHLFVIVYILLIIHGVFLYLVHTWYLKTTWMYLSVPVLLYAGERILRIFRSGSYIVRLLKVAIYPGNVLTLQMSKPQQFKYKSGQYMFVQCPAVSPFEWHPFSITSAPGDDYLSVHIRQLGDWTQEL

SEQ ID NO: 21133 - protein, 230 aa, Pyrus pyrifolia
HKAIAGAIVVGVIPHAGNHLACDFPRLIKVSESVYKKYLLHDFGKHKPSYLDLIKGPEGLTGIIMLICMIIAFTLATRWFRRNLVKLPKPFNRLTGFNAFWYSHHLFVIVYVLLIIHGVFLYLVHTWYLKTTWMYLSVPVLLYAGERILRIFRSGFYTVRLLKVAIYPGNVLTLQMSKPQQFKYKSGQYMFVQCPAVSPFEWHPFSITSAPGDDYLSVHIRQLGDWTREL

SEQ ID NO: 21134 - protein, 199 aa, Pyrus pyrifolia
QIELYNKNGKPAAIQYGTGAISGFFSEDHVTVGDLVVKDQEFIEATKEPGITFLVAKFDGILGLGFQEISVGNAVPVWYNMVNQGLLKEPVFSLWFNRNADEEEGGEIVFGGVDPNHYKGKHTYVPVTQKGYWQFDMGDVMIDGQTTGFCADGCSAIADSGTSLLVGPTTIITELNHAIGASGIVSQECKTVVAEYEAQ

SEQ ID NO: 21135 - protein, 199 aa, Pyrus pyrifolia
QIELYNKNGKPAAIQYGTGAISGFFSEDHVTVGDLVVKDQEFIEATKEPGITFLAAKFDGILGLGFQEISVGNAVPVWYNMVNQGLLKEPVFSFWFNRNADEEEGGEIVFGGVDPNHYKGKHTYVPVTQKGYWQFDMGDVMIDGQTTGFCADGCSAIADSGTSLLVGPTTIITELNHAIGASGIVSQECKTVVAEYEAQ

SEQ ID NO: 21136 - protein, 347 aa, Datura metel
MATLVSNWSTNNVSESFIAPLEKRAEKDVALGNDVPIIDLQQDHLLIVQQITKACQDFGLFQVINHGVPEKLMVEAMEVYKEFFALPAEEKEKFQPKGEPAKFELPLEQKAKLYVEGERRCNEEFLYWKDTLAHGCYPLHEELLNSWPEKPPTYRDVIAKYSVEVRKLTMRILDYICEGLGLKLGYFDNELTQIQMLLANYYPSCPDPSTTIGSGGHYDGNLITLLQQDLVGLQQLIVKDDKWIAVEPIPTAFVVNLGLTLKVMSNEKFEGSIHRVVTHPIRNRISIGTLIGPDYSCTIEPIKELISQENPPLYKPYPYAEFAEIYLSDKSDYDAGVKPYKINQFPN

SEQ ID NO: 21137 - protein, 293 aa, Streptomyces coelicolor A3(2)
MQIGLVGLGKMGGNMRERLRNAGHTVVGYDTNPDRADVDSLVELVDRLERPRAVWVMVPAGGATQHVIDQLATLLKPGDTVIDGGNSRWTDDEKHAEELGKRGINFVDAGVSGGVWGLKNGYALMVGGDKETVDDLKPVFDALKPDGPYGYVHAGKVGAGHFSKMVHNGIEYAMMQAYAEGWELLEKVDSVDNVREVFRSWQEGTVIRSWLLDLAVNALDDDHHLEKLRGYADDSGEGRWTVEAAIDNAVPLPAITASLFARFASRQEDSPQMKMVAALRNQFGGHAVESAKK

SEQ ID NO: 21138 - protein, 234 aa, Thermus thermophilus
MRAENPVFFLDYDGTLAPIAQRPEEAFPHPEAPRVLRALMERHPVYVVTGRRVRDLEPLLPLPGLPVVGGHGLEEGVLFGEVRPLFPVDLGPLRARLPSCPGVRVEDKGFALALHYRGAEDEEKARACLEAWLKAVEGLLEALGLEALPGKKVLELKPKGVDKGQAVLRLLGRHPDHTPVYIGDDTTDEAAFLALRGRGLTFKVGEGPTAAQGRLKDVEEVLAYLQTYLRPTSL

SEQ ID NO: 21139 - protein, 364 aa, Arabidopsis thaliana
MLSLSCSSSSSSLLPPSLHYHGSSSVQSIVVPRRSLISFRRKVSCCCIAPPQNLDNDATKFDSLTKSGGGMCKERGLENDSDVLIECRDVYKSFGEKHILKGVSFKIRHGEAVGVIGPSGTGKSTILKIMAGLLAPDKGEVYIRGKKRAGLISDEEISGLRIGLVFQSAALFDSLSVRENVGFLLYERSKMSENQISELVTQTLAAVGLKGVENRLPSELSGGMKKRVALARSLIFDTTKEVIEPEVLLYDEPTAGLDPIASTVVEDLIRSVHMTDEDAVGKPGKIASYLVVTHQHSTIQRAVDRLLFLYEGKIVWQGMTHEFTTSTNPIVQQVPSFHILLQAASMDQSDTRGGKPSLKRDTNR

SEQ ID NO: 21140 - protein, 371 aa, Acinetobacter calcoaceticus
MSELKDIIAAVTPCKGADFELQALKIRQPQGDEVLVKVVATGMCHTDLIVRDQKYPVPLPAVLGHEGSGIIEAIGPNVTELQVGDHVVLSYGYCGKCTQCNTGNPAYCSEFFGRNFSGADSEGNHALCTHDQGVVNDHFFAQSSFATYALSRENNTVKVTKDVPIELLGPLGCGIQTGAGACINALKVTPASSFVTWGAGAVGLSALLAAKVCGASIIIAVDIVESRLELAKQLGATHVINSKTQDPVAAIKEITDGGVNFALESTGSPEILKQGVDALGILGKIAVVGAPQLGTTAQFDVNDLLLGGKTILGVVEGSGSPKKFIPELVRLYQQGKFPFDQLVKFYAFDEINQAAIDSRKGITLKPIIKIA

SEQ ID NO: 21141 - protein, 481 aa, Pseudomonas sp.
MSILGLNGAPVGAEQLGSALDRMKKAHLEQGPANLELRLSRLDRAIAMLLENREAIADAVSADFGNRSREQTLLCDIAGSVASLKDSREHVAKWMEPEHHKAMFPGAEARVEFQPLGVVGVISPWNFPIVLAFGPLAGIFAAGNRAMLKPSELTPRTSALLAELIARYFDETELTTVLGDAEVGALFSAQPFDHLIFTGGTAVAKHIMRAAADNLVPVTLELGGKSPVIVSRSADMADVAQRVLTVKTFNAGQICLAPDYVLLPEESLDSFVAEATRFVAAMYPSLLDNPDYTSIINARNFDRLHRYLTDAQAKGGRVIEINPAAEELGDSGIRKIAPTLIVNVSDEMLVLNEEIFGPLLPIKTYRDFDSAIDYVNSKQRPLASYFFGEDAVEREQVLKRTVSGAVVVNDVMSHVMMDTLPFGGVGHSGMGAYHGIYGFRTFSHAKPVLVQSPVGESNLAMRAPYGEAIHGLLSVLLSTEC

SEQ ID NO: 21142 - protein, 502 aa, Arabidopsis thaliana
MAQVLSTPLAIPGPTPIQFMAGLLARIVTKNTNKETSTPESPRSPRTPQGSILMDKYEIGKLLGHGSFAKVYLARNIHSGEDVAIKVIDKEKIVKSGLAGHIKREISILRRVRHPYIVHLLEVMATKTKIYIVMEYVRGGELYNTVARGRLREGTARRYFQQLISSVAFCHSRGVYHRDLKLENLLLDDKGNVKVSDFGLSVVSEQLKQEGICQTFCGTPAYLAPEVLTRKGYEGAKADIWSCGVILFVLMAGYLPFDDKNILVMYTKIYKGQFKCPKWFSPELARLVTRMLDTNPDTRITIPEIMKHRWFKKGFKHVKFYIENDKLCREDDDNDDDDSSSLSSGRSSTASEGDAEFDIKRVDSMPRPASLNAFDILSFSDLSGLFEEGGQGARFVSAAPMTKIISKLEEIAKEVKFMVRKKDWSVRLEGCREGAKGPLTIRVEIFELTPSLVVVEVKKKGGNIEEYEEFCNKELRPQLEKLMHYQADEVEEVMCLPPEIEQ

SEQ ID NO: 21143 - protein, 265 aa, Arabidopsis thaliana
MEFERYLGEGSFGSVSLFSYKRRCDVETLYAAVKTSDDAKSLYEEFQILSKFKGCSRIVQCYGSGVEQRLNDKGYVEYTIPMEYAAGGSLSDFMDRFNDKKLPDPMIRKFTRMLLEGLATIHRHGYVHCDLKPENILVFPGSVCDLKLKISDFGLSKRDGDTTWWHPLKSYAGTPIYMSPESISHGEIGKGLDLWSLGCVVLEMYTGKRPWWHTNYELEDLMKCYEPLFPPNLPCDAKLFLMTCFAPEPDERKDALTLLRQSFFR

SEQ ID NO: 21144 - protein, 483 aa, Ralstonia sp. U2
MKTKLFINNTWSASSDKKSFDRKHPVSGEVVTQCANATVDDAVNAARAAQEAFKSWKAVGPSERRRLLLKVADVMESKTPEFIEVMAKEVGASALWAGFNVHLSANVFREAASLATQIQGETIPTDKPDTLSMTLRHAVGPILSIVPWNGTAVLAARAIAYPLVCGNTVVFKGSEFSPGTHALITKCLQEADLPAGVLNYLNSSPDRSPDIADALISSKEIRRINFTGSTRVGRIIAQKSAQHLKRCLLELGGKSPLIVLDDADIDAAVKAAVFGSFLFQGQICMSTERLVVDEKIADEFVAKFVEKTKQLSAGDPCVTGDCIIGPMVSPNSGDRINGLFKDAISKGAKVVCGGIAEGAVMPATILDHVTADMQIYDEETFGPITVVIRCKSEADAIRIANDSAYGLSSGVFGRDVNRALRVGMAIEYGSVHINGSTVQNEAQAPYGGTKATGYGRFDGRAVIDEFTELKWLTIEPFEQQYPF

SEQ ID NO: 21145 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIGKIIEQHINEPEKML

SEQ ID NO: 21146 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 21147 - protein, 242 aa, Escherichia coli
LKERKEGAFVPFVTPGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 21148 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 21149 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHFNEPEKML

SEQ ID NO: 21150 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 21151 - protein, 242 aa, Escherichia coli
LKERKEGAFVPFVTLGDPGIEQSLKIIDTLIEAGADALELGIPFSDPLADGPTIQNATLRAFAAGVTPAQCFEVLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 21152 - protein, 242 aa, Escherichia coli
LKERKEGAFVPFVTLGDPGIRQSLKIIDTLIEAGADALELGIPFSDPLADGPTIQNATLRAFAAGVTPAQCFEVLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 21153 - protein, 242 aa, Escherichia coli
LKERKEGAFVPFVTPGDPGIEQSLKIIDTLIEAGADALELGIPFSDPLADGPTIQNATLRAFAAGVTPAQCFEVLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 21154 - protein, 242 aa, Escherichia coli
LKERKEGAFVPFVTLGDPGIEQSLKIIDALIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVTKLKEYNAAPPLQGFGISAPDQVKAAIDAGAAGAISGSAIVKIIEQHINEPEKML

SEQ ID NO: 21155 - protein, 242 aa, Escherichia coli
LKERHEGAFVPFVTLGDPGIEQSLKIIDTLIEAGADALELGIPFSDPLADGPTIQNATLRAFAAGVTPAQCFEMLALIRQKHPTIPIGLLMYANLVFNKGVDEFYAQCEKVGVDSVLVADVPVEESAPFRQAALRHNVAPIFICPPNADDDLLRQIASYGRGYTYLLSRAGVTGAENRAALPLNHLVTKLKEYNAAPPLQGFGISAPDQVKAAIDAGAAGAISGSAIVKIIEQHINEPEKML

SEQ ID NO: 21156 - protein, 242 aa, Escherichia coli
LKERHEGAFVPFVTVGDPGIEQSLKIIDTLIEAGADALELGIPFSDPLADGPTIQNATLRAFAAGVTPAQCFEMLALIRQKHPTIPIGLLMYANLVFNKGVDEFYAQCEKVGVDSVLVADVPVEESAPFRQAALRHNVAPIFICPPNADDDLLRQIASYGRGYTYLLSRAGVTGAENRAALPLNHLVTKLKEYNAAPPLQGFGISAPDQVKAAIDAGAAGAISGSAIVKIIEQHINEPEKML

SEQ ID NO: 21157 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVTKLKEYNAAPPLQGFGISAPDQVKAAIDAGAAGAISGSAIVKIIEQHINEPEKML

SEQ ID NO: 21158 - protein, 242 aa, Escherichia fergusonii
LKKRKEGAFVPFVTLGDPGIEQSLKIIDTLIEAGADALKLGIPFSDPLADGPTIQNATLRAFAAGVTPAQCFEMLALIRQKHPNIPIGLLMYANLVFNKGIDEFYAQCEKVGVHSVLVADVPVEESAPFRQAALRHNVAPIFICPPNADEDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 21159 - protein, 222 aa, Saccharomyces cerevisiae
MSSSESIRMVLIGPPGAGKGTQAPNLQERFHAAHLATGDMLRSQIAKGTQLGLEAKKIMDQGGLVSDDIMVNMIKDELTNNPACKNGFILDGFPRTIPQAEKLDQMLKEQGTPLEKAIELKVDDELLVARITGRLIHPRSGRSYHKIFNPPKEDMKDDVTGEALVQRSDDNADALKKRLAAYHAQTEPIVDFYKKTGIWAGVDASQPPATVWADILNKLGKD

SEQ ID NO: 21160 - protein, 513 aa, Hordeum vulgare subsp. vulgare
MDGNNRGGGHSEVLKNYNLGKTLGLGTFGDVKVAEHKLTGQRVAIKILNRRKMETMEMEEKANREIKIMRLFIDFIHPHIIRVYEVIETPKDIFVVMEYCNNGELLDYIIENGRLQEDEARRIFQQILAGVEYCHRIMVVHRDLKPENLLLDSKYNVKLADFGLSNVMRDGHFLKTSCGSLNYAAPEIISSKLYAGPEVDVWSCGVVLYALLCGSVPFDDDNIPSLFRKIKGGTYILPSYLSDSARDLIPKLLNIDPMKRITIHEIRVHPWFKNHLPCYLAVPPPYKEQQAKMIDEDILREVVNLGYDKDHVCESLWNRLQNEETVAYYLLLDNRFRSTSGYLGADHQHLMDRSFNEFTLSESASPSTRNYLPGINDSQGGGLRPYYPVQRKWAIGLQSGAHPRDIMIEVLKALKELNVCWKKNGLYNMKCRWCPGFPQVSDMLLDSNHNFVDDSTIMDNGNADGRLPAVVKFEIQLYKTKDNKYLLDIQRVTGPQLLFLEFCGAFLTNLRVL

SEQ ID NO: 21161 - protein, 372 aa, Saccharum officinarum
MTVVDAVSTDAAGAPAAAAAPVQQPGNGQTVCVTGAAGYIASWLVKLLLEKGYTVKGTVRNPDDPKNAHLKALDGAAERLILCKADLLDYDAICRAVQGCHGVFHTASPVTDDPEQMVEPAVRGTEYVINAAAEAGTVRRVVFTSSIGAVTMDPSRGPDVVVDESCWSDLEFCKKTRNWYCYGKAVAEQAAWDAARQRGVDLVVVNPVLVVGPLLQPTVNASIAHVVKYLDGSARTFANAVQAYVDVRDVADAHLRVFESPRASGRYLCAERVLHREDVVRILAKLFPEYPVPTRCSDEVNPRKQPYKFSNQKLRDLGLEFRPVSQSLYDTVKNLQEKGHLPVLGEQTTEADDKEAAPAAAELQQGGIAIRA

SEQ ID NO: 21162 - protein, 365 aa, Saccharum officinarum
MGSLASERKVVGWAARDATGHLAPYTYTLRSTGPEDVVVKVLYCGICHTDIHQAKNHLGASKYPMVPGHEVVGEVVEVGPEVTKYGVGDVVGVGVIVGCCRECKPCKANVEQYCNKKIWSYNDVYTDGRPTQGGFASTMVVDQKFVMKIPAGLAPEQAAPLLCAGVTVYSPLKAFGLTTPGLRGAILGLGGVGHMGVKVAKAMGHHVTVISSSSKKRAEAMDHLGADAYLVSSDAAAMAAAADSLDYIIDTVPVHHPLEPYLALLKLDGKHVLLGVIGEPLSFVSPMVMLGRKAITGSFIGSIDETAEVLQFCVDKGLTSQIEVVKMGYVNEALDRLERNDVRYRFVVDVAGSNVEEVAADAPSN

SEQ ID NO: 21163 - protein, 445 aa, Gossypium barbadense
MAATIVSVKARQIFDSRGNPTVEVDVETSNGIKARAAVPSGASTGIYEALELRDGGSDYLGKGVSKAVANVNTIIGPALIGKDPTEQTAIDNFMVQQLDGTQNEWGWCKQKLGANAILAVSLAVCKAGAEVKKLPLYKHIANLAGNSKLVLPVPAFNVINGGSHAGNKLAMQEFMILPVGASSFKEAMKMGVEVYHHLKSVIKKKYGQDATNVGDEGGFAPNIQENKEGLELLNTAIAKAGYTGKVVIGMDVAASEFYGTDKTYDLNFKEENNDGKQKISGDALKDLYKSFVAEYPIVSIEDPFDQDDWEHYSKLTKEIGEKVQIVGDDLLVTNPKRVAKAIAEKTCNALLLKVNQIGSVTESIEAVKMSKQAGWGVMASHRSGETEDTFIADLSVGLATGQIKTGAPRRSERLAKYNQLLRIEEELGAKAVYAGASFRAPVAPY

SEQ ID NO: 21164 - protein, 505 aa, uncultured bacterium
MKRTALLTVAQMTKADEVTIQSGTAGHVLMDRAGRAVAKAILARWTERPVVVLCGPGNNGGDGLVIARYLLGEGWPVRVAVLGELWAYWGDALVHARGWDPSSCVPVGPEALAGAALVVDALFGAGLSRPLDGAAALTLHAAARAGMPVVAVDVPSGVFGDTGVDTGAAQAALTVTFFRKKPAHVLMPGRALCGEVIVADIGMGADVAESVQPGAFENAPECWASDWPFLGAEQHKYQRGHALVYGGGLMTGAARLSARAAARVGAGLTTVSVPELAWAVYAAALDSIMVQPLPGQDALALSASLHEVLGDARISAVLVGPGAGGGLAKGVRPLVEVALASGRPVVLDADALSAFESDPQALFTAIKASPGAVVLTPHEGEFARLFPQAAALPSRDKLSRARWAARQSGAVVVLKGADTVISSPDGRALVNTNAPPWLATAGAGDVLAGMVTGLLAQGMDALMAASAAVWLHGEAAQAFGPGLIADDLPAQLPAVLRKLLAPSSD

SEQ ID NO: 21165 - protein, 474 aa, Tetragenococcus halophilus
MKSHPLTLTQNIMNNKGLNRYVITITLIATLGGLLFGYDTAVISGAEQSIQNNLVNGVGLGSFAHGLTVSSALIGCVFGGLLSGIFSNNLGRRNSLKLAGSLFLISALGSAYPEFLFFQAGDASVGLLIVFNLYRVLGGIGVGMASGISPTYIGEIAPGKVRGSLVSWYQFAIIFGQLVVYFVNWGIATGQSPEWVNDIGWRFMFASEAIPAILFFALLFYVPETPRYLVLKNNEEKAFDVLSKINNSKEEAKDILTDIKGSLNTTETSGKLFSYGKTVVIVGVLLSIFQQFIGINVALYYAPRIFESMGAGQNASMVQTIIMGIVNVTFTYVAIRTVDKWGRRPLLLVGSIGMAIGMFAVALLAKNGVLGIWTLVFIIVYTASYMMSWGPIVWVLLSEIFPNKIRGQAMAFAVAAQWLSNFFISSTYPAMIDFSGPLTYGFYGLMCVISAIFVWKMVPETKGKTLEQLENTWL

SEQ ID NO: 21166 - protein, 352 aa, Chlamydomonas reinhardtii
MLCGCGGAKQVSRVALVPKAVAAPEKAAVKMNIATDVTELIGKTPMVYLNKVATGTHAKIAAKLEIMEPCCSVKDRIGYSMISSAEKEGLITPGKTVLVEPTSGNTGIGLAFIAAARGYKLILTMPASMSLERRILLRAFGAELVLTDPAKGMKGAVAKAEEILASTPDAFMLQQFQNPNNPKVHYETTGPEIWSATDGKVDILVSGVGTGGTITGTGRYLREKKSDVQLVAVEPAESPVLSGGKPGPHKIQGIGAGFVPAVLDTALISEVVQVSSDDAIDMARRLALEEGLMVGISSGAAVQAAIKVASRPENEGKLVVVVLPPFGERYLSSVLFQQLRDEASKMTFEPSA

SEQ ID NO: 21167 - protein, 484 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRRDRLPANLVQAQRDYFGAHTYERVDMPVLSTPRLRETTSALTRYEKV

SEQ ID NO: 21168 - protein, 496 aa, Mentha x gracilis
MELDLLSAIIILVATYIVSLLINQWRKSKSQQNLPPSPPKLPVIGHLHFLWGGLPQHVFRSIAQKYGPVAHVQLGEVYSVVLSSAEAAKQAMKVLDPNFADRFDGIGSRTMWYDKDDIIFSPYNDHWRQMRRICVTELLSPKNVRSFGYIRQEEIERLIRLLGSSGGAPVDVTEEVSKMSCVVVCRAAFGSVLKDQGSLAELVKESLALASGFELADLYPSSWLLNLLSLNKYRLQRMRRRLDHILDGFLEEHREKKSGEFGGEDIVDVLFRMQKGSDIKIPITSNCIKGFIFDTFSAGAETSSTTISWALSELMRNPAKMAKVQAEVREALKGKTVVDLSEVQELKYLRSVLKETLRLHPPFPLIPRQSREECEVNGYTIPAKTRIFINVWAIGRDPQYWEDPDTFRPERFDEVSRDFMGNDFEFIPFGAGRRICPGLHFGLANVEIPLAQLLYHFDWKLPQGMTDADLDMTETPGLSGPKKKNVCLVPTLYKSP

SEQ ID NO: 21169 - protein, 494 aa, Mentha x gracilis
MELNLLLVIIILVATYTVSLLNKQWRKPKSQQKQPPKLPVIGHLHLLWGGLPPQHLLRSIAREYGPVAHVQLGEVYSVVLSSAEAAKQAMKVLDPNFADRFDSVGSRIMWYDNDDIIFSPYNDHWHQMRKICVSELLSPKNVRSFGFIRQEEIERLIRVMKQSEGAPVDVTEEVSKMSCFVVCRAAFGSVLKDQGSLAELVKESLAMASGFELKDLYPSSWLLNLLSFNNYRLKRMRRRLDHVLDGFLEEHRVKKNGEFGGEDIVDVLFRMQKDSNIKIPITSNGIKGFIFNTFSAGAEASSTTISWALSELMRNPAKMAKVQAEVREALKGKTSVDLSEMQELKYMRSVVKETLRLHPPFPLIPRQSREECEINGFYIPARTRILINAWSIGRDPLYWEDPDTFRPERFDEVSRDFMGNDFEFIPFGAGQRICPGLHFGLANVEIPLAQLLYHFDWKLPQGMTDADLYVAGTPGLSGPRKKNVFLVPTIHKSR

SEQ ID NO: 21170 - protein, 497 aa, Mentha x gracilis
MELQISSAIIILVATFVASLLIKQWRKSESQQNLPPGPPKLPLVGHLHLLWGKLPQHAMADMAKKYGPVTHVQLGEVFSVVLSSREATKEAMKLLDPACADRFESIGTRIMWYDNDDIIFSPYSDHWRQMRKICVSELLSARNVRSFGFIRQDEMSRLLRHLQSSAGETVDMTERIATLTCSIICRAAFGAIINDHEELVELVKDSLSMASGFELADLFPSSKLLNLLCWNKSKLWRMRRRVDTILEAIVEEHKLKKSGEFGGEDIIDVLFRMQKDSQIKVPITTNAIKAFIFDTFSAGTETSSTTTLWVMAELMRNPAVMAKAQAEVRAALKGKTSVDVDDVQELKYMKSVVKETMRMHPPIPLIPRSCREECEVNGYKIPNKARIMINVWSMGRNPLYWEKPETFWPERFDQVSRDFMGSDFEFIPFGAGRRICPGLNFGLANVEVPLAQLLYHFDWKLAEGMKPSDMDMSEAEGLTGIRKNNLLLVPTPYNPSS

SEQ ID NO: 21171 - protein, 373 aa, Physcomitrella patens
MRKTLKKCCCFASLMELCVRASVEGRRAHHLVTLSSLFNKGTQPTIKANKPSVSYGQALQAKKEEDFVIVKTNCQRIPGDGSSTYDAFAVLDGHNGSAAGAFTKENLLNNVVNAVPSGLSRDEWLAALPRAMVAGFVKTDKDWRSKGIFSGTTVTLVIVDGYIVTCACVGDSRCVLDAQGIVTALTIDHRFDTNEEECERVVASGGQVARLHPYGCDIGPLRSWPGGICLSRTIGDVDAGEHIVPVPHVKQIKLSPGGGRLIIASDGVWDALTSEKAAKVCRGEKHPEVAAKNIVKEVIKVQGLRDDTTCLVVDIVPPGRASRSFAPAVRKQMMVMRFLRRTRSKKGSGSGAPMEELFEESSATLSERLRPVT

SEQ ID NO: 21172 - protein, 444 aa, Pinus taeda
MKEERSSAMGDTAGFMGVMIYRWVTWVLLLFSCLLLSRFFILAQLRNINRAYHQWTPDPTSSRFIVPKEGVRDDKFLEVPQIVWGLNNQKIALARAALTGRKLNRTLLMPNLSASLFYKETDLLEPLGFDRLFSLHRFNSLCNGFVRISSMDSRSFSDVLVVAKGSGRRRTAERDKAQLEQCKTSEKDSHTVIKLEGKHPFLWHDHWPVLDYARVFEGLVLVDNLSTEVSRVVSKLKSLSSRTGIDQNKIRMSPFIFQPKYVAVHMRIEKDWMIHCKKLEMRSRARNGKDLKICSSKEEIMKRVSNIPGLEKPSVVYLAVANDLLEDRALLEGWSGFLAPYEKKKLGVLDIYSKYPYLIQSAIDYEVCLQADTFVGNSFSTFSSLIVLHRTMRMDRARDCEGSTMASYAYNIEGPAGRPKRWATNMSDSSLASINYGSNEVSCQ

SEQ ID NO: 21173 - protein, 255 aa, Prunus persica
ERLYQLKQHNEDPYNEFEVIRIIGKNPFLWHDHWPVKDYAKVFECLVLVDEIMNEADKVVSRIREIGAAQVRSQNESPQNGINRAEKPLLQPVPYVAVHMRIEIDWMIHCKKLEQRSNISQICSSKEEIMERVGNIAGLKTPVVGYLTVADSLLHDPSILSGWKEGLIPYEKKKLGFEGTYKKFPYLIQSAIDYEVCSRADVFVGNSFSTFSNLIVLDRTQKLIRMGVTSSCGVDVKWPSYAYNILGKQKALKDG

SEQ ID NO: 21174 - protein, 288 aa, Cucurbita pepo
MSSSQDPQLVQQQSVVDVEEFVSVENPDSKRSQFGSLFKNHYPPGFSRKLVAEVIATYLLVFVTCGAAALNGSDAQRVSQLGASVAGGLIVTVMIYAVGHISGAHMNPAVTTAFAATRHFPWKQVPLYAAAQLSGATCAAFTLRLLLHPIKHLGTTTPSGSDLQALVMEIVVTFSMMFVTCAVATDTKAVGELAGLAVGSAVCITSILAGPVSGGSMNPVRTLGPAMASDNYKGLWVYFVGPVTGTLLGAWSYKFIRASDKPVHLISPHSFSLKLRRMSRSDVGEGER

SEQ ID NO: 21175 - protein, 457 aa, Alcaligenes faecalis
MSRFEQIQSREAGLHKRLNARQMSMIAIGGAIGTGLFLGSKFAIGFAGPGVVLSYVIGGFIALVLMGCLAEMTVEHPTSGSFGAYAEFYIHPLAGFLVRYSYWACIVLAVGTEVTAVADYMKFWFPEVSPWIWIVFFSAVLIAVNAYSVKAFGSVEYWFALIKVFAIIAFIVLAIGMLTGYYQPAQVQENLLGQGGFMPNGWYGVWVGVIISIFSYLSIEMIAVAAGEAENPEQAVRQAFKATIWRLIIFYLLSLSLIVMLVPWQVLIADGTSSPFITVMQSVGIPYADSILNFIVIIAALSAMNSMLYISTRMMFSLSRAGDAPLVLGKVARNGVPLNALALSASGVGVAAVVYAYNPETAFPVMIALSMFGALFTWGMIFLTHLFFRRRVAQEGVQLRFRMPAYPIGTLLGLIGIVAILITTWFINIFHYTLLFGVPFLLTLIVIYFVRSKSRVA

SEQ ID NO: 21176 - protein, 361 aa, Fusarium oxysporum f. sp. lycopersici
MFSSTVLLSGLVASVLAAPALEPRAGSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSTGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPMTDVTINKVTGTVSSPAGTEVYILCANCKNWTWNNNKVTGGKTSTKCKGIPSGASC

SEQ ID NO: 21177 - protein, 130 aa, Mangifera indica
EQAWNEVADKFQGANLYMKNLDDSIDDDKLKQLFSQFGSITSCKVMRDPNGISRGSGFVAFTTPEEASRAILEMNGKMVVSKPLFVALAQRKEDRRARLQAQFSQIRPVAMAPSVASRMPMYPPCGPGHG

SEQ ID NO: 21178 - protein, 130 aa, Mangifera indica
EQAWNEVADKFQGANLYMKNLDYSIDDDKLKQLFSQFGSITSCKVMRDPNGISRGSGFVAFTTPEEASRAILEMNGKMVVGKPLYVALAQRKEVRRARLQAQFSQIRPVAMAPSVASRMPMYPPCGPGHG

SEQ ID NO: 21179 - protein, 412 aa, Spiroplasma citri
MTNKKELKDVQVKGKKVLVRVDFNVPMKDGQVTDDNRIIAALPTIKYLIAQEAKVILFSHLGKVKTADDLEKRDMAPVAKVLEQKLGQPVKFINAFEGKQLEEAINEMHNKEVILFQNTRFADIINSNGQISVDSEGKAAAKRESKNDSALGKYWASLGDVFVNDAFGTAHRAHASNVGIAENITESCLGFLVEKEVKMLSQCVDNPVKPFVAIIGGAKVSDKIGVIEHLLTKADKILIGGGMAYTFFAAQGHKIGNSLLEVDKVEIAKTFLAKGQGKIILPIDALEAPEFADVPAKVTTGFDIDDGYMGLDIGPKTIELFKKELADAKTVTWNGPMGVFEFKNYSIGTKAVCEAIAELKGAFTLIGGGDSAAAAIQLGYKDKFTHISTGGGASLEYMEGKPLPGIEAVQSK

SEQ ID NO: 21180 - protein, 360 aa, Camptotheca acuminata
MAKSPAEEHPVKAFGWAASDTSGVLSPLTFSRRATGEKDVKFKVMYCGICHSDLHCLRNEWGSTIYPIIPGHEIAGIVTEVGSKVEKFKVGDKVGVGCMVGSCRSCNDCDNNIENYCPKMMFTYSSIYHDGTVTYGGYSDIMVTDEHFVVRWPDNLPLDSGAPLLCAGITTYSPLRYYGLDKPGMNLGVVGLGGLGHVAVKFAKALGVKVTVISTSLNKKEEAIERLGADSFLVSRDPDQMQAAAGTLDGILDTVSATHPLLPLLGLIKSHGKLVLVGAPEKPLELPVMPLLMGRKIVGGSNMGGMKETQEMLDFAAKHNITADVEVVPMDYVNTAMKRLEKGDVRYRFVLDIANTLKAT

SEQ ID NO: 21181 - protein, 391 aa, Candidatus Blochmannia floridanus
MKDETKIINSGRNIQFTHRAINPIVQRTSSIIFNSIAQKKHAAKNYKNGELFYGRYGTLSHFSLQKSMIELENGSGCMLFPCGTAAITHTIFAFITYGDHILITESAYAPTQNFCRFLLNKMNVHTTWFHSSISNNITNLIQHNTKLIILESPGSITMEVQDIPTLIQATRKKKPDIIILLDNTWSSGVFLKALDIGVDISIQSGTKYIIGHSDGMMGTAVSNARCWNTLQEQSYLMGQTIDADTAYIAARGLRTLYVRLKQHEKTGLHLAQWLNNHPKVDRVNHPALPSCQGHKYFIRDFTGSSGLFSFILKKRLTDKQLSNFLDNMKYFKMAYSWGGFESLITTMQIEELNSIRPINKLNFTGTLIRIHAGLEHQEDLIQDLSDGLNRI

SEQ ID NO: 21182 - protein, 377 aa, Candidatus Blochmannia floridanus
MVKSDYYEILGVSKNADEREIKKSYKRLAMKFHPDRNPGDVSAESKFKEIKEAYEVLSNPEKRSAYDQYGHAIFEQNSGGMGGSNTGGSDFSDIFGDVFGDIFGGSRRSRSRRGSDLRYDIELSLEEAVKGVVREICVPTLVTCLQCRGSGAKSSASIVSCVTCHGHGQIQMRQGFFSVQQSCPSCNGHGKIIKEICNKCRGSGRIERTKTLSVKIPAGVSTGDRIRLSGEGESGKNGAPAGDLYVQVQIKKHPIFDREEKNLYCEVPISFSMAALGGEIEVPTLDGRVKLKIPPETQTGKLFRMRGKGVKSVRGIGGHGDLLCRVVVETPVRLSDRQKQLLQDLSDSFGGPYGHKNSPKSKTFFDGVKKFFDDLTR

SEQ ID NO: 21183 - protein, 470 aa, Candidatus Blochmannia floridanus
MSIQIETQVLVLGSGPGGYSAAFRCADLGINTILVERYPNLGGVCLNVGCIPSKALLHISKLIQTNSDLNEFNISKNITNIQLDINKIRLWKNDIIKKLSNNLNSIATAKRNIKIIYGFGTFINKHTLQVSCDKEIIKVIFDYAIIATGSHPTSLPFSPNDHRIWNSTDALELKFIPEKLLIIGSGAIGLEMSTVYHSLGSKVDLMEASDQIMPILDKDIINLFSKNLIKKSINCTVNTQVHAFNSKPNGIDVITTNKLDPNTKKTHRYDAVLIAIGRFPNSKELNLDGIGIQTNKNGFISVDKQMRTNISNIFAIGDIVGNPMLAHKSIHEGHIVSEVISGKKYYFDSTVIPGVIYSDPEIAWVGYTEKEAQTKNIKYASVTFPWNSLGKAITSNYTEGITKLIFDKNTHRIIGGSVIGLHASEIIGEIALAIEMGCDVEDITLTIHAHPTLYESIELAASIYNKSINT

SEQ ID NO: 21184 - protein, 447 aa, Candidatus Blochmannia floridanus
MPEIVNIISREIVDSRGNPTVESEVHTKSGFFGLASVPSGSSLGSQEALELRDNDHARFFGKGVKKSVNIINSTIRVSLLNIDVTKQSVIDEIMINLDGTNNKSQLGANSILSVSLAIAKAAASFMGMPLYQYIARLYGMSSNVYSMPVPMMNIMNGGKHADNNLDIQEFMIVPVGAKNIKQAIQMGSEISYSLKNVLNNLGISIALGDEGGYAPNLKSHSYALELINKSIEQSNYVLGKDVVLAIDCAASELFEVSTGKYVINSEKVSFTSEEFVDYLSSLARKYCIFSIEDGQSEHDWHGFSYLTKKLGDIMQLVGDDLFVTNPNLLKMGINKNVANSILVKPNQIGSLTETLNVIKLAKESGYSTIVSHRSGETEDTSIADIAVGTSAGQIKTGPVRCSERTSKYNRLIRIEEFLKDNSKFYGVNEIKNLSAQLWMYQNKNMNI

SEQ ID NO: 21185 - protein, 298 aa, Candidatus Blochmannia floridanus
MINDTSRIHIAFLGPKGSYSHIAAKKYANYHFNKITEYSCQNFSDILHVVENNQVDYGILPIENSNSGLINEVCDLLLTTHLILIGDITIPIQHRILVNNYNSSLKQIQTIYSHPQPIQQCSNFLKKFPHWKIILCESSSIAIKKVAYLNQPNIAALGSTQGGIIYGLHPLLLSPYIISNYPLNSTRFIILKNENLLFTNTTAILEKIMLIISIDTKLNKLYSILKILQFYKIKINFLRLCCSLLPNNTTNSIILEITAHFHHTYTQQALIKIYNIAYSLKILGCYSTIAYQPYQQYT

SEQ ID NO: 21186 - protein, 303 aa, Candidatus Blochmannia floridanus
MCTLMHKHDDSLFSNSFGFLRLPLEFYPYTRHNDWVITGVPFDIATSGRSGSRFGPASIRKASINLAWENCRWPWNFDIRQKLKIIDCGDLIYKSGNVQDFTNILQKHIENLLRFRKKILLLGGDHYITLPVLRAYSKFFGTISIIHFDAHADYYDNNNQYDHGAVILYALHEKLINPNRSVQIGIRTEYDKNFGFTVLDAEYVNTTAVHVLINQIVSVIQNRPVYLTFDIDCLDPSVAPGTGTPVIGGLTTSCALQIIRGFQKLNIIGIDIVEVAPVYDCAQITALAAATLGLEMLYTQVKF

SEQ ID NO: 21187 - protein, 400 aa, Candidatus Blochmannia floridanus
MVMIKMSDVDLFNKRILIRADLNVPIRNGIITSARRIHASLPTIQLALSRSNQVMVTSHLGRPVEGEYDSQFSLQPVVDYFQKNLSAKIGGVRLVKDYLDGINWISNELLILENVRFNKGEKTDDEVLAKKYASLCDVFVMDAFGSAHRIQSSTHNVSKFVKVACSGLLLEQEIAALHKALSNPVRPMVAIVGGSKVSSKLMVLESLSKVVDYLIVGGGIANTFLAAQGQNVGKSLYEAELISTAKSLLKDCNIPIPTDVRVSSEFSETAQSIMKNVTEIKDDEQILDLGDNSIINILNILNNAKTILWNGPVGVFEFPNFRKGTEMVSNAIANSNAFSIAGGGDTLMAIDLFGIANQISYVSTGGGAFLEFIEGKTLPSIEVLEEHKRMRNGNYSDINY

SEQ ID NO: 21188 - protein, 158 aa, Candidatus Blochmannia floridanus
MIDDNGYRLNVGIVLCNTYGQVLWAKRYKQCSWQFPQGGINIGETPEQAMYRELFEEIGLNYCDVRILSITRCWFCYKLPTQLVRWRIKPLCLGQKQKWFLLKLLSKDTKINMKTSKVCTFDTWQWVSLWYPIRQVVFFKRHVYRKVMKEFVKLIISR

SEQ ID NO: 21189 - protein, 226 aa, Candidatus Blochmannia floridanus
MYNIIFLGPPGSGKGTQAHLISTKYGISNISAGEILKHALSVTKFHFNFNTDNMLNQINSGNLVDDELIIPLIIKRIRQDDCKKGFILDGFPRTIGQAIAIEQNKIAIDFVIEFNISDSAIINRIVGRQVHIKSGRTYHIKFNPPKLDGIDDITGEKLVIRADDNAQVILQRLNQYRKYTIFLSDYYQKQSQQGNMRYFIINGNQEITKIYKELINIFNFHIFKMN

SEQ ID NO: 21190 - protein, 232 aa, Candidatus Blochmannia floridanus
MHIIKTVLIRHGESQWNKDNRFTGWIDVDLSNQGYSEAKRAGQLLKKYKFIFDYGYTSVLKRTIHTLWVILDQLNQTWLPIQKVWQLNERHYGALQGLNKNEAIKTYGYDTIQKWRRSFKDIPPKNNKNDLFLGTNDIRYKNIETNTLPNGESLELTANRVIPYWQKYIEPKIYNNNCIIIVAHGNSIRAILKFLNQLDDSEIFNIEIPTGIPLIYEFDNNIKPIRYYYLSE

SEQ ID NO: 21191 - protein, 271 aa, Candidatus Blochmannia floridanus
MNRYQTMFKSLNQNKLGAFVPFITIGDPDPTTFIHIIDTLIQSGADALELGIPFSDPVSDGPSIQKSMERSFKSGANISSCLQLIKKIRNKYPTLPIGLLIYANLIFKNGIKNFYAHCSTLSIDSILIPDLPIEESSLFYNSAMYYQIAHIFICPTNASLDLIKKITDKGIGYIYLLSRSGITGINNTEFNKIKLNTLIYNIKQCNQKLPILQGFGIYSSEQARSSLLSGTSGIISGSCIANIIEENHPNIDLLLEKIRKFTHLMKIAMKL

SEQ ID NO: 21192 - protein, 488 aa, Candidatus Blochmannia floridanus
MPQLLRRTKIIATLGPATDQKNTLEKIIISGVNIVRLNFSHGNSSEHFFRANKVRKLANQLHKYIAILGDLQGPKIRISTFQTNNIYLQSGDDFLIDSTLKNSHNNQKYVGVNYKELPQDVSPGDYLLLDDGKIQLKVIKIQNTQIFTKVVIGGLLSNNKGINKLGGGLSAKVLTNKDKLDIITAAKIGVDYLAISFPRNSMDLNFARKLITDAGSNAKIISKIERAEVVKSDDTIDDIIKASDAVMIARGDLGIEIGEPQLVGIQKKIIQRAHLLNRAVITATQMMESMIINSVPTRAEIMDVANAVLDGTDAVMLSAETATGQYPSETVSSMADVCLGAEKTLNNTNNQLIFINQLQKKINNTKEAIAASTMHIANCLSKIRAIISITDWEHIVLLLSRFNSQLPIFALSKHIHILNIVTLYKGVIPIYFNRTGNNIIDARQASNLLRDQGFLTPGELVIIIQDNIVNQSNINNVTHILTIEEQCK

SEQ ID NO: 21193 - protein, 213 aa, Candidatus Blochmannia floridanus
MLTTEKYQGLNWSKNHGLIPAIIQHSISGEVLMLGYMNQESMAITEKTGYVTFFSRSKNRLWIKGESSGNVLKLINWYPDCDFDSLLILVLPQGFTCHKNTNSCFHPALTDFSFLFQLENIISIKKNHTSSHGNQQSSYTSDLYTSGIERIAQKVGEEGLETALAAVSRNSKSLIDEASDLIYHLLVLLQHESLNFHDVIQELRVRSKLKKKH

SEQ ID NO: 21194 - protein, 474 aa, Candidatus Blochmannia floridanus
MFKQQEVGVIGMGIMGQNLALNIENKGYRVSIYNRSPDKTNIIIKNNPTKNLIPYFSIEQFIFSLKKPRVIFLMITAGVHVDHIIQVLSNYLEIGDILIDGGNSFYQDTVRRDLYLSEKKINFIGLGISGGEEGALKGPSLMPGGSQDAFKIVESLLKKIAARFNDNEICMEYIGPNGSGHYVKMMHNGMEYGDMQIISEIYFFLKMVLHLTAKQLGKIFSDWNMGELSSYLIEITSHILMKSDNNQYCVLDYILDVADNKGTGLWSSKDALDLGVPSTMITESVFARYLSTLKNQRIQASKVFSNVFEGKVNFDLENIDIFVEKARKALYLSKIILYAQGFYQLKISSMTYHWNLNYQKIAKIFRAGCIIRSNFLQEIINIYSKTPKIENLLLDSYCVNIINNYQQDLRDIVTIGIDHGIPMPALSAAISYYDGFRSLMLPANLIQAQRDCFGSHTYKRIDKSGVFHTRWLSK

SEQ ID NO: 21195 - protein, 314 aa, Candidatus Blochmannia floridanus
MNKIYQDNSYTIGHTPLVRLNKIGNQFIMAKIESRNPSFSVKCRIGSNMIWDAEKKNILNPNITIIEATSGNTGIALAYVTAARNYKLLLTMPETMSIERQKLIRALGADIILTEGHLGMKGAINRATEIANDNPSKYLLLQQFSNPANPNIHERTTGPEIWYDTHGNIDIFVAGVGTGGTITGVGRFFKQIQNKKITIVAVEPKDSPVITQTLSGQSIKPAPHKIQGIGAGFIPKNLDLNLIDQVVTVETDAAISYAKFLMQKEGILAGISSGAALAAAVQLQQQEKHTNKNIVIILPSSGERYLSTILFSDS

SEQ ID NO: 21196 - protein, 350 aa, Candidatus Blochmannia floridanus
MNIEIDKISKVFNHRKILTNISINIKSGEMIALLGPSGSGKTTLLRIIAGLESHSSGYLRLKGQDVGGVSARDRRVGFVFQNYALFRHMTVLDNVSFGIRMLPRHKRPSRYIIDKKAMQLLSIVQLDHLANRYPSQLSGGQKQRVALARALAIEPKILLLDEPFGALDTQVRKELRRWIRNLHQEFKFTGVFVTHDQEEAMEIANRIVIMNHGVIEQIGTPEDIWCVPSTRFVFEFLSEINCVIGMICGTELFIGPYYWNLSYIPKVQGEVELFFRPWEMEIRKEFSIFSPLPVKIINVSFHGYYWQLSVEPLGWHHDLLTIILGVKDSFGIPEFGMYCYLSGRNAKLYS

SEQ ID NO: 21197 - protein, 489 aa, Candidatus Blochmannia floridanus
MLSVNIKEALTFDDVSIVPARSAVLPVEAILKSNLTDSIILNIPIISAAMDTVTEASLAIALAQEGGIGFVHKNMSLKNQINEVIRVKRYESGVVTNPQCVNPDTTVLEVKERTCRNGFAGYPVVINSNELVGIVTSRDVRFVNDLSIPVSDVMTPKDSLVTVYERESRETVLAKMHDKRVEKILLVDSLFHLKGMITAKDFEKAERKPNACKDNYGRLRVGAAIGVSADYKYRANALVNAGVDILLIDSSHGHSESVLRCVSYVRKLYPDLPIIGGNVVTEEGALALIEAGVSAVKVGIGPGSICTTRVVTGVGIPQITAISDVSKALKYTNIPVIADGGIRFSGDIAKAIAAGAHCVMIGSLLAGTEESPGDIEFYQGRSFKSYRGMGSLGAMNQGSSDRYFQQNENINSKLVPEGIEGRVIYKGKVKSIIHQLMGGLRSCMGLTGCLTIDDLRIKTKFVRVSYSGMQESHVHDVTITKESPNYQLK

SEQ ID NO: 21198 - protein, 226 aa, Candidatus Blochmannia floridanus
MKRDMKEYLIEPSILAADFSKLGEDVSNVISAGADVLHFDVMDNHYVPNLSIGPMVLKSLRNYGIDIPINVHLMIKPINDRLILDFLEAGATGISFHPESTDHVDRFLQLIKEHGCKTGLVLNPSTDLSCLEYVMHKIDVIILMSVNPGFGGQIFLPEILRKITQTRKLIDNNPYDINLAVDGGINMSNFCKICESGANVFIIGSAIFNASNYHDVIYNFRSMLLY

SEQ ID NO: 21199 - protein, 385 aa, Candidatus Blochmannia floridanus
MKNNKSTVSVRSGLNNDKQHGCVVSPITLSTTYNFFEFNKPRLYDYSRRKNPTRDIVQKTVADLEQGKNAIITSSGMSAIYLICIALLNSDDCLIAPYDCYGGTYRLLNALNSKKVCRVQFVNQNDTELMLKCLKQKDVKLVFIETPSNPMLRVVDIRYMCSLKERDDIVYVVDNTFMTPIFQNPLNLGADLVVHSCSKYLNGHSDVILGAVISKDIYLHEKLMWWSNALGITGGAFDSYQLLRGIRTLSIRVCQQQCNTKNIVDFLLKQPQIKSIYYPGLYSHVGYKIACQQQTGFGSIFSFELKGTEGVVSKFLKSLKLFTLAESFGGVESLIAHPETMTHAAMSKQSRDTAGINNMLLRVSVGLEDSVDLINDLDQALQSIS

SEQ ID NO: 21200 - protein, 262 aa, Candidatus Blochmannia floridanus
MKNLSIIANWKLNGNKNTITNSLINLTTQLTNIPQYIKIAIAPPILYIDMVKNHLTSYNNKTIELCSQNVDIHLSGAFTGDISASMLKDLSVKYVLIGHSERRIYHKENNSLIAQKFSIIKQTELIPILCIGENKEERDSGSTQSICIQQIDSIIKLVGIKAFENTIIAYEPVWAIGSGSSASPRNVQSIHQFIRNYIAQYDKTIANQISIQYGGSITTDNVLEFITQKDIDGVLVGSASLDIRNLIKIINLSSNLIKKTYQ

SEQ ID NO: 21201 - protein, 473 aa, Candidatus Blochmannia floridanus
MNVDYFISFINKNKVKFIDLRFTDIMGKEQHFTIPQSQIDNHFFENGKVFDGSSMVGWKNVHESDMILIPDLTNDHIIVDPFYQDTTVILRCDVLDPHSMQNYDKDPRYISKKSEKFLQDSGIADFAMFGPELEFFVFDDVRFKTSMSGCHVMIDDPEASWNSDKVYFYGNKGHRPKIKGGYSPVPPIDSSQNLRSMMSIMMEKMGLIVETHHHEVATAGQNEIITRFNSLTRKADEVQIYKYIVHNVSNKFGKTATFMPKPIIKDNGSGMHCHISLYKNKVNLFSGDQYGNLSEIALFYIGGILKHTKALNAITNPTTNSYKRLIPGYEAPTFLTYSLSNRSSAIRIPAIINNNPNLCRIEVRFPDPSANPYLAFPALLMAGIDGIINEIHPGNPVNKNLYTLSDLEKEHTLYTSQSLNESLQYLSEDYEFLIRNNVFSKNFIDSYILIHKKMDSLVRSVPHPMEFELYYSI

SEQ ID NO: 21202 - protein, 457 aa, Erwinia amylovora
MQKYLSEARQLLALAIPVILAQVAQTSMSFVDTVMAGAVSATDMAAVAVGTSIWLPAILFGHGLLLALTPVVAQLNGSGRRDLIAHQVRQAYWLAGMVSVLVMIVLYNAGYLIGSLHNVDPLLSQKAIGYLHALLWGAPGYLFFQVARDRCEGLSKTKPAMVVGFLGLLVNIPLNYVFIHGHLGMPALGGVGCGVATASVYWVMFIVIRAWTNRAKSMRDIQLPQRFSAPDWKAIGRLTGLGLPVALALFFEVTLFAVVALLVSPLGIVNVAGHQIALNFSSLMFVVPLSLGVATTIRVGHRLGQGSAEQAKVAAWTAQGIGICMACITALFTIAFRERIAQLYADDPEVITMAAQLMLLAAVYQLSDSVQVIGSGVLRGYKDTRAIFFITFIAYWILGLPIGYLLGMTNLLLPAMGPAGFWIGFIIGLTSSAIMMIWRMRRLQRQPNATVLARAAR

SEQ ID NO: 21203 - protein, 103 aa, Erwinia amylovora
  misc_feature (83)..(83): Xaa can be any naturally occurring amino acid
MKKTKIVCTIGPKTESEEMLTNLLDAGMNVMRLNFSHGDYQEHGKRISNLRNVMNKSGHQAAILLDTKGPEIRTMKLEGGQDXSLKAGQTFTFTTDQSVIGNA

SEQ ID NO: 21204 - protein, 498 aa, Medicago truncatula
MGILSYLCYSLFYLSIFFIIRLLFQSRKFKNLPPGPTSLPIIGNLHHLKRPLNRTFKALTEKYGNVISLWFGSRLVVVVSSLSEFQECFTKNDVVLANRPRFLSGKYIFYNYTTLGSTSYGEHWRNLRRITSLDVLSNHRINNFAPIRRDETQRLIKKLAEDSSTKFAEVELTFRFFDMTFNNIMRMISGKRYYGDDCDISEVQEASQFRDMVSELLQLSGANNKTDFMPLLKFLDFENLEKRVKRIGEKNDVFLSGLLQEQRSKKERTNTMIDHLLNMQESQPEYYTDTIIKGLCLAMLLAGTDSSAVTLEWTMSNILNYPEVLKKVRDEVDTHVGQDRLVDESDLPKLTYLRNVIYETLRLYTPAPLLLPHSTADECIMGGYKVPRDTIVLINAWAIHRDPETWSEATTFKPERFDKKGELEKMIAFGMGRRACPGEGLALRAISMTLALLVQCFDWKRINDEKIDMSERDGFTMTKLLPLKAMCKTRPVVNKVFK

SEQ ID NO: 21205 - protein, 501 aa, Medicago truncatula
ALFYYSLLSLSFIITIKILLKITSRRLKNLPPGPPTIPIIGNLHHLKHPLHRTFTTLSQTYGDIFSLWFGSRLVVVVSSPSLAHECFTKNDIILANRPRFLTGKYIFYNYTTLGSASYGDHWRNLRRITTIDVLSNNRLNSFLGVRRDETNRLIQKLLKDVVSEGFGFTKVELRPRLTEMTFNAMMRMISGKRYYGDDGDVSDVEEAKQFREIISEMMSLLGANNKGDFLPLLRVVDLDNLEKRCKRIAKRSNAFLEGLIEEHRRGNIHSDGGTMIDHLLKLSESQPEYYSDHLIKGLIQGMLLAGTDTSAVTIEWVMSELLNHPEVLKKAKEELDTQIGKNKLVDEQDLSKLPYLQNIISETLRLHPPAPLLLPHYSSEDCTIGEFNVPKDTIILTNVWGIHRDPKHWNDALSFKPERFEKEEEVNKVMAFGLGRRACPGLSLAQRTVGFTVGLLIQCFEWERESEEKLDMMEGKGITMPMKIPLRAMCKALPIANDVTK

SEQ ID NO: 21206 - protein, 447 aa, Pseudomonas fluorescens
MSQTALSAQINARIEGLPVVGWQARVRLLLGVITFFEAFDLLLISFTLPLLKQQWQLDPTQVGLIVGSGTFGMLLGALCAGALADRVGRKPVLLAAMLLTGLFSALIACASDWQGLLVGRLLQGLGIGAEVPIAALYLSEIITSKVRGRFVLLYELSFPCGLMFAGVACTWALPVMGWRPLYWLGSVPMVLAVAVYLYVPESARWLAARGQLRRAQACMAYMERASGHAVATPLLTEAPVARPRDSGRWRQLFDPVLRHASGSVGLLWFLGYLVNFALLIWLPSLYVEVFSTSLAQALNFTLWSNIAGLGGCMAAAWCVDRIGRVRLLFGGYLGAGLSLLLIALTVAWQQVLLVALLAASCSFFLYAANMSLHLYTPELYPTLLRGKGAAWGALCNRSGALLGAVGMGWVLALHWGATAIFILLGGLLLLASAIALQARETRGQVLG

SEQ ID NO: 21207 - protein, 450 aa, Trichoderma viride
MLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVNDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASTTPSATSTCSSPTSRATASAPRRSPPLAPVRPAATSWCGSARGTYPPIYVTENGTSIKGESDLPKEKILEDDFRVKYYNEYIRAMVTAVELDGVNVKGYFAWSLMDNFEWADGYVTRFGVTYVDYENGQKRSPRRAQRA

SEQ ID NO: 21208 - protein, 500 aa, Agaricus bisporus
MPSIFTHQWDTPVYKGSTSINTGLFINGEFVDGVKNTTIDVVNPANGKLITKISEATEADIDIAVEAAHKAFETTWGLNCSGSKRGDMLYKLAQLMEKNIDDLSAIEALDNGKTFLWAKSVDLSLSISTIKHYAGWADKNFGQVIETDEKKLTYSRHEPIGVVGQIIPWNFPLLMLAWKIGPALATGNCIVLKPSEFTPLSALRMCALIQEAGFPPGVVNVVTGYGSTTGQAISSHMKIDKVAFTGSTLVGRKVMEAAAKSNLKNVTLELGGKSPVVIFDDADLEQSVNWTAHGLFWNHGQACCAGTRIFVQEGIYDKFLQKFTDKIKEIKLGDPFGLGIDQGPQVSQIQYDRIMSYIESGRAEGATVHVGGERHGNEGYFIQPTIFTDTTPDMKIVKEEIFGPVGAVIKFKDGKEVIKQANDSNYGLAAAVFSQDINKAIETAHAFKAGTAWVNCANTIDAGVPFGGYKQSGIGRELGEYALHNYTNVKAVHVNLNWKM

SEQ ID NO: 21209 - protein, 376 aa, Pseudomonas stutzeri A15
MAKRDFYEVLGVERGASEAELKKAYRRLAMKHHPDRNPGDKAAEEAFKEANEAYEVLSDPSKRAAYDQYGHAGVDPQMGAGAGGAGYGGANFSDIFGDVFSDFFSGGRGGSRGGAQRGSDLRYTLELDLEEAVRGTTVTIRVPTLVECKTCDGSGAKKGTSPVTCTTCGGIGQVRMQQGFFSVQQTCPRCHGSGKMISDPCGSCHGQGRVEEQKTLSVKVPPGVDTGDRIRLSGEGEAGTQGGPAGDLYVVVNVREHAIFQRDGKHLYCEVPISFADAALGGELEVPTLDGRVKLKIPEGTQTGKQFRLRGKGVAPVRGGAAGDLMCRVVVETPVNLSKRQREMLEEFRGTLQGDTSHSPKASGWFEGVKRFFGDV

SEQ ID NO: 21210 - protein, 259 aa, Arabidopsis thaliana
MAMPQANPQPSPFGNPFSGPGSGLIRSGLGAYGEKIFGSSSEYVQSNISRYFSDPQYYFQVNDQYVRNKLKIVLLPFLHRGHWTRISEPVGGRLSYKPPIYDINAPDLYIPLMAFGTYVVLAGLSLGLYGKFTPEALNWLFVKGMVGWFLQVMLLKITLLSLGSGEAPLLDIVAYAGYTFTGLCLAVLGKIIWGYSYYVLIPWTCLCTGVFLVKAMKRVLFAESRSYDSSRHHYLLIFVALAQFPLLIWLGNISVNWLF

SEQ ID NO: 21211 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 21212 - protein, 465 aa, Chlamydomonas reinhardtii
MGSCLAKPAESAEQKKASSVPSPPPAPAPQPVQQAAAPAPKDSGDVKPGQQATPVPPPSPPPQPKPAPPAQPAPAPAAKVVEAIPAVADEKSPQGKQPRRSQEHDNGVKAEEIELVKQKSTEPQPSASATAAVATPKAIEPAMEPKVAAPSAPAAAPAPAQAPAAAPTPARPGSKLRTDVKLRDLYKLGKTLGTGGFSVVKLATDRGTGVEYACKIMALPPVGQEVGENENTREDIFKEIDLLCGMNHENVIFLKEYFEEGNKVYLITELLTGGELLEAVLKRGSYTEAEARLCFVQVLRGIEYLHSKNVVHRDLKLENLLLAKQDDISLVKIADFGLAKHAVNGMQTICGTPQYVAPEVIVGAKGHVYGPGVDMWSAGVVLYILLGGYPPFWSDSEPQLFDMIRKGKYSFGDPVWNKVSEGAKDLIRKLLVVDPTKRLSATEALQHQFILEGNFNPPSTPKGPR

SEQ ID NO: 21213 - protein, 424 aa, Physcomitrella patens
MASSTAGAVSGTNMIGGGRAAPTKAGSSGVELLPKEMHEMKLRDDKVDHGDDKEIEATVVDGNGTETGHIIATTIGGRNGQPKQTISYSAERVVGTGSFGIVFQAKCIESGETVAIKKVLQDKRYKNRELQIMRLLDHPNIVALKHCFFSTTEKDELYLNLVLEYVPETVYRIAKHYNRMNQRMPLVYVKLYTYQICRSLAYIHSGIGVCHRDIKPQNLLVNPHTHQLKLCDFGSAKVLVKGEPNISYICSRYYRAPELIFGATEYTTAIDIWSMGCVMAELLLGQPLFPGESGVDQLVEIIKVLGTPTREEIKCMNPNYTEFKFPQIKAHPWHKVFHKRMPSEAVDLVSRLLQYSPNLRCNALEACVHPFFDELRDLNCRLPNGRPLPPLFNFKPQELKGATPEILQRLIPEHARKQNPMLAL

SEQ ID NO: 21214 - protein, 279 aa, Bordetella pertussis Tohama I
MGSVAQQNLFSATDLAVAPVIAVRGLRTAFGDHVVHDNLDLSVYPGEILALVGGSGTGKTVLLRQIIGLERPAAGTIEVLGRRVQELEPAERRRLSHRWGMLFQAGALFSSLSVFDNVALPLRELRTVPEDLVCDVVMCRLAMVGLTSKDADKRPADLSGGMVKRVALARALSLDPELLFLDEPTAGLDPLRSDEFVDLVRSLHRQLGFTVVMVTHDLDTLLALATRVAVLADKRVIVCDTVREVLKVDHPFIRSFFLGERGRRALGDLAPKETGNGKP

SEQ ID NO: 21215 - protein, 397 aa, Bordetella pertussis Tohama I
MTDESRHIDTLLQHLGTAPFDPDTGAAPVNLPSMRASTVRFRDLAALEQAQRRKAGGDRAVTYGRMGMDTHAALEHVFKELEAGTHCYLASSGMGAVTMAFLSLLSAGEHALVADCVYGPVYELDNAVLKRMGIELTFFAPGDDLQALVRPNTRLLYVESPGSLLFQMLDLPALAEFARRNQLVLATDNTWGSGYIYRPLELGAQVSVIAGTKYVGGHSDLMLGAVVTNDEAVAQRLNRTQYAMGYSVSADDAWLALRGVRTLPIRMAQHARHAQRVCEFLQGRPEVARIYHPAWPQDPGHALWLRDCSGSNGMLTVELRLSQPAARVFVESLQLFDIGFSWGGFESLVQLVTPGELARHRYWQGGGNALVRLHIGLESPEDVIADLTQALARAASA

SEQ ID NO: 21216 - protein, 310 aa, Bordetella pertussis Tohama I
MASAQLATLSAQVRQLYAGWDPNTDIARIRRDWDAFFGAVRLPARVTPVDAGGVPCHWIEAPASTRDRVVVFIHGGGYQIGSHRSHHNLMARLSAWSGRAVLSIGYRLAPQARCPAALEDVDAAHAWLAGQGWSARQTALCGDSAGGALAVLLLARLRARGAALPAACAVMSPWIDLQARGESYTANAASDPIANRATVLRMARAYLGRDGDPEAPAVSAQHADLRGLPPLLVQAGSAEALLDDARALAARAAASGVAVRLSVWQDMPHVFQLFAARLDAADAAIAELADFINHPLRAPTGAEPRHETST

SEQ ID NO: 21217 - protein, 476 aa, Bordetella pertussis Tohama I
MHANFIDGAWLDGVDARPNINPSNLADVVGDYAQADAAQAGMAIAAASAAAHAWARSTGQRRADVLDAVGTELLARKEELGRLLSREEGKTLPEGVSEVTRAGHIFKFFAGEALRIQGEKLPMTRPGIEVDVTREPVGVVGIIAPWNFPIAIPAWKIAPALAYGNTVVFKPADLVPGSAWALAEILSRAGLPAGVFNLVMGRGSVVGQAILDDRRVNAISFTGSVATGRRVAEAAIGRMAKVQLEMGGKNPLVVLNDADLKVAVDCAVNGAFFSTGQRCTASSRLIVQKGIYPRFVEAVRERLQGLKVDDALAPGTDIGPVVDRSQFDQNLAYIAIGREEGAQLAWGGEPLKRANEGYYLAPALFVDCDNSLRIAREEIFGPVAAVIPVDSYEQALEVANDTEFGLSSGIVTTSLRHATHFKRESQAGMVMVNCPTAGVDYHVPFGGRKGSSYGPREQGRHAAEFYTSVKTAYTAA

SEQ ID NO: 21218 - protein, 228 aa, Bordetella pertussis Tohama I
MISKLVATAADALADVPDGATVMIGGFGTAGQPMELIDALLEQGAKDLVIINNNAGNGTTGLAALLGAGRVRKIICSFPRQVDSQIFDGLYRAGKLELELVPQGNLAERIRAAGAGIGAFFTPTGYGTPLADGKETREINGRQYVLEYPLHADYALIQAERGDRWGNLVYRKTARNFGPIMASAARVAVAQVRQVVELGQLDPEAVVTPGIFVKRVVQIDAPRGAKEQ

SEQ ID NO: 21219 - protein, 334 aa, Bordetella pertussis Tohama I
MTTAALPYPLDPQIQRFVERMQADSAAHPRRDLVPVEQAHAISEAVRRPWAEGGPQMARTREIHVPTPHGPVRLRVYTPRAARPGPALLYVHGGGWVLFSLDTHDRLMREYAERAGLTVIGVDYTRAPEARYPRAIEEIVGVIDWLDAHGAELEVDRARLCIGGDSAGANLSVAACLTLRERGAAPLAGMVLNYGVYDANLFRDSTVKYGGGEYLLSTQQMVWFYWNYLRAGDDPRDPRISPVHADLRGLPPAFMAITELDLLHDTNQDMAARLREAGVDVQAKVYPGTVHSFLEAVSLAQVSVAAFDDTAAWLRAVLRPDAAAAAIHTGEHQP

SEQ ID NO: 21220 - protein, 427 aa, Bordetella pertussis Tohama I
MSTNAELFDRACRSIPGGVNSPVRAFRSVGGTPRFIQRAQGPYVWDAEGKQYIDYVGSWGPAILGHAHPEVVRAVQEAAVHGLSFGAPTEAEVELAEMLIARLPSLEQVRLVSSGTEATMTAIRLARGATGRHKIIKFEGCYHGHSDSLLVKAGSGLLTFGNPSSAGVPPEFVAHTLTLEFNNLAVVDAAFSQHGAEIACVIVEPVAGNMNLIKPAEGFLAGLRELCTRHGAVLIFDEVMTGFRIGPQGVQGLTGVRPDLTTLAKVIGGGMPVGAFGGRADLMTHIAPLGGVYQAGTLSGNPVAVAAGLATMRLIGEPGFYERLSAQTARLAQGLQERARAAGVPFSADAIGGMFGLYFGDRVPASFAEVSACDTEAFKRFFHAMLERGIHFAPSAFEAGFVSATHDDAVIDATLEAAEQVFATLRA

SEQ ID NO: 21221 - protein, 486 aa, Bordetella pertussis Tohama I
MEDLRNHEFKNYIGGQWVACAAGKTYPNVNPADTDDIVGRFQASQAEDAAAAVAAAQAAFDGWRNLAVSKRAALMQRAADYLEAHAEQFGRELTREEGKALNLAKDEVLRSAQTIRFYAAEGQSFSGETFVNDDPDMVVYSQREPLGVVTVISPWNFPVSIPARKIAPALITGNTVVFKPSSDAPLSGLRLVEAFEQAGLPPGVLNLVTGSASAIGAAITQASQVRAVSFTGSTAAGEQIHRSVDMTTRTQMELGGKNPLIVMADADLDRAVDLVVKGGFSLSGQACTGTSRVLVDAPVKAAFTEKLLAKVKALKVGNSLEGSFDLGPLATARQLESVMRYIEVGKQEARLLCGGERLEGPGYERGYYLTPAVFADVTQQMRIAREEIFGPVIALIEVNGYEDAIAKANDTEYGLAAAIATTNAQYAHRFARDIQAGTVKINRTTTGNLINAPFGGLKRSSTSTFRESGRIGLEFYTQIKTVYRAG

SEQ ID NO: 21222 - protein, 396 aa, Bordetella pertussis Tohama I
MEFSQFKVNALMEITARPDLVFVRGQGSWLEDHAGKRYLDFVQGWAVNTLGHCAPEMKRAMAEQADKLMNPSPAFYNLPSIELAQRLTSASCFDRVFFANSGAEANEGAIKLARKWGRVNRNGAYKIITMNHGFHGRTLATMSASGKPGWDTMFAPQVEGFPKAEINDLDSVRALIDAQTVAVMLEPVQGEAGVIPATREFMQGLRKLADEHGILFIVDEVQTGMGRTGSLFAYQQFDVIPDIMTLAKGIGGGIPLAALLAREEVCVFAHGDQGGTYNGNPLCAAVGVAVFDTITAPGFMEAAQARTRQLSEGLLALSAKWSLRGERGMGLLRALVLDRDDAPAIVEAARMLAPEGLLLNAPRGNLLRFMPALNVTEADMARMLEQLDGVIAAVRK

SEQ ID NO: 21223 - protein, 477 aa, Bordetella pertussis Tohama I
MKQHFIDNASVPGSSGERIPVIDPSTGQEFDSIARGNAADIDLAVQAARRAYEGAWGRLSAAERGRLMLALSLKVLEHRDELTALESRDCGKPLKQARADVIAIARYFEYYGGAADKLHGETIPYQQGYTVLTLREPHGVTGHVVPWNYPLQIFGRSVGAALAAGNACVVKPAEDACLSLLRVAELAAETGFPAGALNIVTGYGHEAGDALTRHPGIDHISFTGSPRVGVLVTQTAAERHVPVTLELGGKSPQIVFADADLDALVPVAVNAIVQNAGQTCSAGSRLLVERGAYERVLERLGAAFAALRAGPAQSDLDCGPLIRKTQQERVRGFLDLARGDGIATVAQGRIVPEAPAEGYYQAPTLLRDVPVDHPLAQEEVFGPVLAAIPFDDEADAVRIANATEYGLAASVWTRDGGRQLRIARKVRSGQVFINNYGAGGGIELPFGGVKASGHGREKGFEALYGFTVLKTISIKHD

SEQ ID NO: 21224 - protein, 314 aa, Bordetella pertussis Tohama I
MIAASFPHGVSLIGAPTDIGAGQRGASMGPEALRVAGLVRLLERRGLQVTDRGNLQGAPNPWRPPANGYRHLNEVIGWNQLVHDAVSAELRQERLPILLGGDHSLAIGSISAVARYCRASGRKLRVLWLDAHADFNTNRLTPTGNVHGMPVACLCGNGPAALTSMAGRTPAIEPGWVRQIGIRSVDEGERNLVYDAGLEVYDMRYLDEVGMRAVMEAALAGLDPQTHLHVSFDVDFLDPELAPGVGTTVPGGPTYREAQLCMEMIADTGLMRSRDIVELNPALDVRNKTAQVAVDLVESLFGKSTLMRRRPGSA

SEQ ID NO: 21225 - protein, 413 aa, Bordetella pertussis Tohama I
MNMPAPAATRRDRIEDELGAHNYQPLDVVLARGSGVWLYDTAGRRYLDCLSAYSAVNQGHCHPRILAAMVEQAQRLTLTSRAFRHDQLAPLYEDLARLTGAHKVLPMNSGAEAVETALKAVRKWGYEARGVPAGQAEIIVCANNFHGRTLGIVGFSTDPDARGGYGPFAPGFTVVPFGDFAALQAAVTPRTVAFLVEPIQGEAGVILPPPGYFRQVRKLCSERDIVLILDEIQTGLGRTGAFLAEAHEGIEADVTLIGKALSGGFYPVSAVLSNQAVLGIFQPGQHGSTFGGNPLACAVARAALRVLHDEGMIDNAREQGAYFMQRLRALPGPVREVRGRGLMLALELEPDAGPARAYCERLMARGMLVKDTHGQTLRLSPPLIVTREQIDWACAQLAHVLAHSAPGSSGGPS

SEQ ID NO: 21226 - protein, 420 aa, Bordetella pertussis Tohama I
MDEIQSIVIVGAGQAGAVAAASLRQLGYRGGLTLVGQEAHPPYERPPLSKAVLQGTATHAEAAVHPAGFYAENDIALLTETAVAALDPAARTVRLADGRTLPYDRCLLATGGHARELPALPRGRAGVHYIRTLDDALDLRAALRPGVRAAVIGGGFLGLEVASTARELGAKVTVIENGSRLLERALPAIVSDWLAERVRASGVDLRLGGAIAAIGDGPPYAITLADGTQVNADLIVVSIGLAPEVTLARQAGLPLDDNGGICVDSQARTADPQVYAAGDCASQPRACLGTAARFESWQNANEQARAAAAAMLGLAPAAEPYPWFWTDQYGCNIQILGLPQPGLRYVCRPQTDPQAAPRVLWIGLRDGVPCHGIAVNAGGDLRQLRVLFERGIPVDPHRLADPAEALKPLVKAWQAAIAVA

SEQ ID NO: 21227 - protein, 250 aa, Bordetella pertussis Tohama I
MYKLVLMRHGESQWNLENRFTGWTDVDLTETGREQARKAGELLKREGYAFDLAYTSVLKRAIRTLWIALDAMDAMYTPVGINWRLNERHYGQLQGLNKAETAAKYGDEQVLIWRRAYAIAPEPLDLEDPRHPRFDGRYAKIPADQLPATECLKDTVARVLPFWNESIAPAIRAGRRVLVAAHGNSLRALIKHLDNVSDDDIVGVNIPTGQPLVYELDEDLKPIRHYYLGDAAEIEAAMAAVAAQGKAKKD

SEQ ID NO: 21228 - protein, 469 aa, Bordetella pertussis Tohama I
MASTMETDLLVLGGGPGGYTAAFRAADLGLSVVLVEQRPTLGGVCLNVGCIPSKALLHCAKALDEARAMSELGIEFSEPRIRLDKLRAHKEALVAKLCGGLGGLARQRKVEVVTGTGRFDGPHSLAVSDGSRVAFKQAVIAVGSRPVRLPFLPDDPRIMDSTGALELKEIPRRLLVIGGGVIGMELATVYAALGARVTVVELTDGLLPGCDRDLVKPLAQRVASRYEAVLLGTRVSAAQARDDGIHVSFDGPQAPGPQVYDQVLVAAGRRPNGAAIDAERAGARVDEGGFIRVDAQQRTNVGHIYAIGDVVGEPMLAHKAAHEGKVAAETAAGMRVANDARVIPAVAYTDPEVAWVGLTETAAQRDGIAYEKAAFPWAASGRALSLGRGEGLTKILVDPATHALLGVGMVGPQAGDLIAEAALAIEMGAEPGDIALTIHPHPTLSETLAFAAEAYEGTLTELYLTRKKS

SEQ ID NO: 21229 - protein, 497 aa, Bordetella pertussis Tohama I
MFNLSASIAFHARRTPDKAAIVYRDQEIGYAEFHQRILQAAAMLHARGIGQNDVVALFMKNSAAFLELAFAASYLGAVFLPVNYRLAAPEAAYILGDAGAKLLLVDEEFDAIVALETPKIVIDAQAQADSRRLGQPGLEIPPQAAVAETDLVRLMYTSGTTSRPKGVMHSYGNLHWKSIDHVIALGLTASEKLLVVGPLYHVGAFDLPGIAVLWVGGTLCVHREFDPEAVLASIERHRLTCGWMAPVMLSRVLTVPDPDRFDLDTFAWCIAGGEKTPESRIRDFTRVFTRGRFVDGFGMTETCSGDTLMEAGREIEKIGSTGRALPHVEIRIADGAGGWLPANRKGEICMRGPKVTKGYWNAPEKTAEAFYGDWLRSGDVGYLDEEGFLFVTDRTKDMILTGAENVASSEVEAALYELPQIAEAAVIGVHDDKWGERITAVVVLNPGQTLTLEEIDRHCRQRLASFKVPRELKVVAELPRNPSGKVLKRVLRDEYNG

SEQ ID NO: 21230 - protein, 493 aa, Bordetella pertussis Tohama I
MSLSVGNAALLPGRNLIGSEWREAALGARFAVADPATGKVIAHVPDSGARDAGAAVTAAHQAFADWRRTPAKVRAQIIKRWNALLHENAEDLARLISSEQGKPLAEARGEVSYAASYVEWFAEEATRADGDLIPSPAQGRRMFALREPVGVVAAITPWNFPAAMIARKIAPALAAGCTVVCKPAEDTPLTSLALTALAQQAGVPPGVLNIVTASRGRAAEVADAWLDDPRVRKITFTGSTPVGKHLARRSADTLKRVSLELGGNAPFIVFDDADLDAAVEGLMVSKFRNGGQTCVCPNRIFVQAGVHDAFVRKLAARVEGLVVGPASDPASQIGPMINARAVEKIEHHVADALERGARLAVGGKRIHSARCAGDHYYAPTVLTGVDETMACFREETFGPVAPITVFASEAEVVAAANATAFGLAAYFYSTDVRRIWRLADALETGIVGVNEGALAAEAAPFGGVKDSGYGREGSRHGLAEYMQIKYVCQGQLD

SEQ ID NO: 21231 - protein, 247 aa, Bordetella pertussis Tohama I
MELLSMIEIERLGKCYGDLPVLKDCSLAVARGEVVVVCGPSGSGKSTLIKCVNRLEPFESGRIVVDGTDVGAPGTDLPALRARVGMVFQHFELFPHLSVLENVCLGQMSVLGRSRAQARAKADALLERVGVAAHRDKHPGQLSGGQQQRVAIARALAMDPVVMLFDEPTSALDPEMIGEVLDVMTGLARDGMTMMVVTHEMGFARRVADRIVFMEAGEIIDDVASAEFFGSAASPRSREFLSRIISH

SEQ ID NO: 21232 - protein, 325 aa, Bordetella pertussis Tohama I
MRAVEITRPGGPEVLVPTERSVPEPASGEVLIKVSAAGVNRPDVLQRKGNYAPPPGASDLPGLEVAGEIVGGDAAAGGFAIGDKVCALVAGGGYAEYVVAPAPQCLPIPRGLTEIEAAGLPETYFTVWSNVFDRGRLAAGEALLVHGGASGIGTTAIQLARAMGNKVYATVGSDERARAVEALGAALGINYKTQDYVKEVLDATGGAGVDVVLDMVAGEYIGRNLKCLADDGRIVIIALLGGAHANVDCNQVLRRRLTITGSTLRPRPVEFKGEIARALRERVWPLLENGTLKPVVHATLPLEQAAAAHAMMEAGENIGKIILTV

SEQ ID NO: 21233 - protein, 383 aa, Bordetella pertussis Tohama I
MKFDTLLTHGGRDPKAHKGMVNTPVYRTSTVVFESMAEYKATRGAKFDHVRYGRLGTHTVKELENLVAAIEGGHRAVLTPSGVSAIATTLNTLARPGSHILVPDNVYYPCREFCEKVLAPRGVRVEYYAGSEVERLVRPDTSVVYCESPGSLTMEMQDFARIAAAAHAVGAKVVADNTWATPVFLQPFEHGIDVSIHAATKYLVGHSDVMMGTVTAHDPELWLAIRTEAAAQGLSISPDDAYLATRGIRTLGVRMAAHYRNALDVAQWLAGHPRVAQVLYPALPQHPDHALWRRQMRGASGLLTLELEPCSLEQRDAFIDRLTLFAIGASWGGYESLVLPADTAGKRSLAGRDYAGPLVRLHIGLEDVEDLKRDLDQALRRED

SEQ ID NO: 21234 - protein, 361 aa, Bordetella pertussis Tohama I
MDDSLQDKLRPLRDRIDAIDAQILDLLSQRARTAQEVGSVKHAAHADGPVLRPEREAEVIRRLQYSNPGPFPKAAVAAVWTEIMSACRGLERGMTVAYLGPQGSFSEQAALEHFGHSVQQLPCPSFDEVFRAVEAGQADVGMVPVENSTEGAVNRSLDLLLNTPLTILGERSLVIRHCLMSQSGTMDGIKTISAHPQALAQCQGWLTRHYPDLNRVAAASNSEAARVAAEDPTVAAIAGEVAAPAWNLRVVAAGIQDDPQNRTRFLAVGHIEPLSSGKDKTSLILAVPNRAGAVYDMLAPMAANGVSMTRFESRPARTGQWEYYFYVDVLGHRDDANVARALAALQAQVAFFKVLGSYPAQ

SEQ ID NO: 21235 - protein, 303 aa, Bordetella pertussis Tohama I
MSTPTYPTIEQTVGNTPLVRLQRIPGAAGQARGNVILAKLEGNNPAGSVKDRPALSMILRAEERGEIHPGDTLIEATSGNTGIALAMTAAMRGYRMVLIMPDNLSLERRAAMTAYGAELILTPAAKGGMEYARDLATAMQAEGKGKVLDQFGNPDNPRAHIEGTGPEIWNQTDGRVTHFVSAMGTTGTIMGVSTYLKSRNAAVQVVGAQPAEGSQIPGIRKWPEAYMPKIFDRALVDAYESIAQAEGETMARRLAAEEGIFAGISSAGALVAALRVAERVENATIVFIVCDRGDRYLSTGVFN

SEQ ID NO: 21236 - protein, 307 aa, Bordetella pertussis Tohama I
METMYLTHPSCRLHEMGDWHPESPQRLDAISDQLLASGLLPYLQERQAPEASRADILRVHTPAYLDSLRAHQPEHGYYAIDADTSMNRHTYEAALRAAGAGVAAVDAVLGGEAITAFCSVRPPGHHAERDHAMGFCFLNNVAIAARHALDFHGLQRVALVDFDVHHGNGTEHAFAGDPRVLMCSFFQHPFFPNSGADDPAPNMLNVPVAAYTGGASIRTIVREQWLPRLHAHRPELILISAGFDAHREDDMAQMGLVEADYAWITDRLVEVADQHCQGRIVSTLEGGYNLSALGRSVVAHIRSLSKL

SEQ ID NO: 21237 - protein, 354 aa, Bordetella pertussis Tohama I
MSIEVRGLSKRFGAFRALDEVSLHIETGELVALLGPSGCGKTTLLRIIAGLESADAGSVLFAGEDATEVDVRQRQVGFVFQHYALFKHMTVFENVAFGLRVRHRSQRPSEARIRAKVLDLLGLVQLDWLADRYPAQLSGGQRQRIALARALAVEPRVLLLDEPFGALDAKVRKELRRWLRRLHDELHVASVFVTHDQEEALEVTDRVVLMNAGRIEQVGSPREVWERPATPFVYGFLGDVNQLHGHATRGVWRLGEVALPAPDLPEADNQRAIAYVRPHDIDLARAGTAAPGIPVRLNHVYLAGPSAYLELARQDDQAIIEAQVPEPLFRSLGLKEGEALLAQPRRARVFAVQP

SEQ ID NO: 21238 - protein, 397 aa, Bordetella pertussis Tohama I
MSNVNTLSALAKSGALSGKRVFIRADLNVPFDDAGRISEDTRIRASVPGIRLALDAGAAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELDALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKTAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 21239 - protein, 312 aa, Bordetella pertussis Tohama I
MEFKDYYKILGVQSDAPEDEIRRAYRKLARKYHPDVSKESDAETRMRDVNEAYDVLGNQEKRQAYDNLAAGVAPDGGFQPPPGWDQGFEFHYARDGEGDQQFSDFFSSLFGGQARRRAAQQDFRARGEDHHAAIEVDLEDALRGATRDISLRSMQPDEHGQPQVRTRTLSVRIPAGVREGQYIRLAGQGMPGYGGAENGDLYLEVRFKPHPRYRAEGRDLYMNLPVAPWEAALGAQVEAPTPGGAVEVAVPPGSRNGRKLRLRGRGIPGDPPGDLYLVLDLVLPPADSEAAREAYRKMAQDLAFDPRRNLGV

SEQ ID NO: 21240 - protein, 475 aa, Bordetella pertussis Tohama I
MSKQFDVVVIGAGPGGYIAAIRAAQLGMSVACIDAWQNGQGGPAPGGTCTNVGCIPSKALLQSSEHYEQANHHFAEHGIEVKGVSLKLDTLIGRKNTVVKQNNDGILYLFKKNKVTYFHGKGAFAGQVDGGWSIKVTGTTDADLVAKHVIVATGSSARELPGLPFDEKNILSNDGALNIGAVPKKLGVIGAGVIGLEMGSVWRRLGAEVTILEAMPEFLAAADQQVAKEALKSFAKQGLDIQTGVKIGEIKAAAKSITVPYVDAKGAEQKLVVDKLIVSIGRVPYTGGLNAEAVGLKLDERGFVAVDEDCKTNLPNVWAVGDVVRGPMLAHKAEEEGVAVAERIAGQHGHVNFATVPWVIYTSPEIAWVGKTEQQLKAEGREYKAGSFPFMANGRARALGDTTGFAKVIADAKTDEVLGVHIIGPMASELISEAVTIMEFRGAAEDIARICHAHPTLSEAVKEAALAVDKRTLNF

SEQ ID NO: 21241 - protein, 305 aa, Bordetella pertussis Tohama I
MMQTLGFVGLGMMGLPMLENLAGDERWQILAYDRSPAPFERLAGHPAWGKRLRAAAGLQELAACDTVITMLPNSAITNAVVLGGDGQPGLIDLLESGAAIVDMGSSNPADTRRLSEQLAARGLTLIDAPVSGAVAKASTGTLAIMAGAAEADLRRVRPILERMGAAIIHTGAVGSAHAMKALNNYVYAAGLLAVSEAMVIARRMELDLEVFTDVLNASSGRNVASETKLRQFIIPGTYNGGFALALMAKDLGTAQSLQALTGVQADQLALCAELWRQALAQLPGGADNTEIHRFLAQRTPATEPA

SEQ ID NO: 21242 - protein, 226 aa, Bordetella pertussis Tohama I
MSSIGFRILPLPEPPAADEVLAGFAQIGTAQISDCMGRLYGVQGLRPLHAGAARIVGRAITVKTRPGDNLMIHKAISLAGPGDVIVVDGAGETANALVGELMMMDAQSRGVAAFVIDGAVRDLDVFQQGAFGCFARAVSHKGPYKDGPGEINVPVSIGGQVVAAGDVIVGDADGVVAIPLAQAGAVLAAARRKEDAELAAKEKLRAGTYAKPWVDRIIAEKTGDAQ

SEQ ID NO: 21243 - protein, 459 aa, Bordetella pertussis Tohama I
MPLPPHPRLLAAAGLVLAWLLLYLWAWRQARMRAASQARALRALEARPGPQTVLVAYASQTGFAAELAEHTAAALASGGLQARVAELGQIDAATLGHYARALFIVSTYGEGDPPDAAAPFADTAMQSGAGLGALRYAVLALGDSSYAHFCGFGHRLDDWLRANGAAPLFDLVEVDAGDAAALRHWQHHLGVVTGCTDLPDWQAPAYQAWRLARRTLLNPGSQGAPCYFIELTPPHSTAPQWQAGDIAEIGPRDAPDSPLHAHREYSIASLPADGAVHLLVRQMRTADGALGLGSGWLTHTAQTGQAIDLRVRANRNFHPPADARPLILVGNGTGLAGLRALIKARRSAGHGRNWLVFGERSAAHDWFCRDELEQWRGEGWLEYVDAVFSRDAPQRRYVQDLLRDRAERVRDWIREGAAVYVCGSLHGMAEGVHQALADILGPAQLQALQHAGRYRRDVY

SEQ ID NO: 21244 - protein, 453 aa, Bordetella pertussis Tohama I
MAKSRTIYVCAECGGTSLKWQGKCPHCSAWNTLEETVESAAPSAGGHRYAPLAAASPVRSLSEIEARETPRQPTGLDEFDRVLGGGLVAGAVVLIGGDPGIGKSTLLLQALASLSATTKVLYVTGEESAEQVALRARRLGLQTGNVDLLAEIRLEAIQAAVSEQKPTVAVIDSIQTLYSGELTAAPGSVSQVRECAAQLTRLAKQTGIAIVMIGHVTKDGALAGPRVLEHIVDTVLYFEGDTHSSFRLVRAFKNRFGAVNELGVFAMTDRGLRGVANPSALFLSQHQQQVAGSCVLATQEGTRPLLVEVQALVDTSHAPNPRRLTVGLEGNRLAMLLAVMHRHAGVSTYDQDVFVNAVGGVRITEPAADLPVLLAIMSSLRDKPLPAGLVAFGEIGLAGEIRPAPRGQERLREAAKLGFSVALIPKANAPRQPIEGLEIWAVDRLDAALDKLR

SEQ ID NO: 21245 - protein, 468 aa, Bordetella pertussis Tohama I
MTPAAAPSPGFGATMRDIARQAWPVLISQWAGISFGVLDTAMTGHASPQDLAAMSLSVSVYITVFVGLMGVVHALIPILAQHFGAGQQREVGSTWGQGVWLALGLSVVGAILMLFPDAWLSLSGDVDPAVRDRVAAYLRALVLALPATLVFRTIYALGTAVSRPKVVMSINLAAVFVKAFCNWVLIYGKFGLPALGAVGAGLATAISGWLSLAAGLWIITHDRYYRRFRLRVGRPDWRALKELLRLGLPMGGSYLVEVSAFTFMALLVAREGTYVSGGHQIMSNLAALCYMMPMALGVATAALTAQAIGAGRPDLAHRTGMAGLALGLLGAALTAAVLLVGRPLIIAAYTDDLEVAAVAASLLAIIPLFHLCDSMQCINSYLLRAHKVAVMPLVLQTVALGGVGLLGGWWLGFGPGRGGLDPLRTALMPGSPAGAGTMWLMAMAGLGLSAVLLHYWYRRIARLALARG

SEQ ID NO: 21246 - protein, 166 aa, Bordetella pertussis Tohama I
MNTMYDFSAPTITGAERALADFRGQVALVVNVASRCGFTPQYSGLEELYRSYRNEGFVVLGFPCNQFGRQEPGDEAAIAQFCETQYAISFPLFAKIDVNGAHAHPLYRWLKARKPGLLGTRAIKWNFTKFLVGRDGLPLRRYAPAHTPESLRHDIARACAAPGPTP

SEQ ID NO: 21247 - protein, 1113 aa, Bordetella pertussis Tohama I
MPATHPAPDPLWYKDAVIYQLHVKSFFDANDDGVGDFAGLLAKLDYIVELGVNTIWLLPFYPSPRRDDGYDIADYRGVHPDYGSLADARLLVRAAHARGLRVITELVINHTSDQHPWFQRARAARPGSAHRAYYVWSDDDKAYAGTRIIFCDTEKSNWTWDPVAGAYFWHRFYSHQPDLNYDNPQVLREVLGAMRYWLDMGVDGLRLDAVPYLVEREGTNNENLPETHAILRRIRRVIDSEYPGRMLLAEANQWPEDAQEYFGAGDECHMAFHFPLMPRMYMAIAQEDRLPVTDIIRQTPSIAPQCQWAIFLRNHDELTLEMVTSRERDYLWNVYAAEPRARINLGIRRRLAPLLERDRRRIELMNSLLLSMPGTPVLYYGDELGMGDNIHLGDRDGVRTPMQWSPDRNGGFSRADPERLPLPLLMGPLYGYEAVNVEAQQRDPHSLLNWTRRMLAKRRQSHVFGRGELSFLYPGNRKILAYLRTWEDTVVLCVANLSQAAQPVELHLSEYAGRVPVEMLGGTAFPQIGELPYLLTLPPFGFYWLDLSAGAAPPAWHSELPPQMPESITLVSRGAGAALRLTEASRRQLEADVLPAYLQRQRWYAARRKPGVMRLAYSVPLNDDVESYYEAEIEVSDDGPPRRFHTPVALAWQDDTAAQYPLARVRRGAQLGTLTDASLQPGYARVLLAALTAGRDIQAGGEPAVRLRFLPEPGLADLALRDDSEVRALSADQSNSSLLVGERVVFKLLRELHAGPHPEAEMTRYLTQAGYAHTPALLGEVVRVQGDQAPHTLALAHAYVVNEGDAWNWTVAYLKRTLDAAILTGASADDYQQELAGYEVLAGTIGQRLAQMHSVLARAGELPGFAPRPASERDAALAGERAVAQLDRALQALRACESGLAPASHACAQWLFEHRDRLAAHIMTLAQAETGALRIRVHGDFHLGQILVAQTDAYLIDFEGEPARPMAERRQLSSPFKDVAGILRSFDYAVAELSRDDPLGGAPRDFNTGVAEPADPASAPRETREALLARFRQRAGAALLASYGNAIDPVLALPPERAQALTCLYLLEKAAYEICYESAYRPERLPVPIHGLAETARAALLAAAVDHDEGPAP

SEQ ID NO: 21248 - protein, 297 aa, Bordetella pertussis Tohama I
MSSIAFIGLGNMGAPMALNLVKAGHDLTVFDLVPAAVKTLTDAGARAAGSAAEAVQGAELVISMLPASKHVEGLYLGQDLLASIGASALVIECSTIAPDSARKVAAAAQARGIAMIDAPVSGGTGGAAAGTLTFIVGGEAPALERARPVLASMGKNIFHAGGAGAGQVAKICNNMLLGILMAGTSEALALGVANGLDPKVLSDIISKSSGRNWATELYNPWPGVMEHAPASKGYAGGFGVDLMLKDLGLAAEAALGTRSSIPLGELARNLYSLHSQGGSGGLDFSSIVNLYSPGERN

SEQ ID NO: 21249 - protein, 397 aa, Bordetella pertussis Tohama I
MSSTPSFHWQDPLLLDQQLTEEERMVRDAAVAYSQDKLAPRVLEAFRHEKTDPAIFAEMGELGLLGATIPTEYGGAGLNYVCYGLIAREVERVDSGYRSMMSVQSSLVMVPINEFGSEAQKRKYLPKLAAGEWIGCFGLTEPNHGSDPGGMETRATKTPDGYKLTGNKMWITNSPIADVFVVWAKCVGGDFDGKIRGFILEKGMKGLSAPAIHGKVGLRASITGEIVMDEVEVSEEQMMPGVSGLKGPFTCLNSARYGIAWGALGAAEACWHTARQYTMDRKQFGRPLAANQLIQKKLADMQTEITLGLQGCLRLGRMKDEGTAAVEITSIMKRNSCGKALDIARLARDMLGGNGISDEFGVARHLVNLEVVNTYEGTHDVHALILGRAQTGLQAFY

SEQ ID NO: 21250 - protein, 304 aa, Bordetella pertussis Tohama I
MTTGAAPRPLPAAFAGRSNVFELRNLADVQRLQPAFLAGRRLLVLGGGYIGLETAAVAAQAGLSVQVVERASRVLERVACPATAAAIRALHQRHGVLIHEGRTVAGTEGDEALTGVELDNGLRIACDLVVAGVGVAPQTALAEAAGIDCDDGILVDAYGRTSAPDVWAAGDCARFVLGGEPARLESVQNAIDQAEAVADDMLGQGRPYQPVPWFWSDQYDMKLQIVGLNRGYDAVVSHASAKGESHWYFRADRLISVDALNDGRAYMVGKKLLEAGRAVGRGEVERPGFEPMQLLRDQAEGRLR

SEQ ID NO: 21251 - protein, 430 aa, Bordetella pertussis Tohama I
MLEKLFQLRDHATTVRTEIVAGLTTFLTMSYIIFLNPDILSSTGMDRNAVFVATCLAAALGSLIMALVANWPIGMAPGMGLNAFFAFTVVKTMGYTWEQALGAVFISGVIFLFLTISGIRAWLIRGIPHSLRSAIAAGIGLFLAIIALSNANIVVAHPATKVTLGDLREPGPLFAILGFFIIAALDALRVRGAILIGILSVTVLSMLLGYNQFNGIFSSPPSLAPTFMQLDILGALHTGFVHVILVFVLVEVFDATGTLMGIAKRAGLVPEDRPNRLGRALFADSTAIVAGSMLGTSSTTAYVESASGVQAGGRTGLTALVVALLFLAALFIAPLAGSVPAYATAPALLYVAGLMMRELIDIDWNDVSEATPAALTALVMPFTYSIANGLAFGFISYVVLKTCTGRIREVHPATWLVAILFIVRYAFFPE

SEQ ID NO: 21252 - protein, 471 aa, Bordetella pertussis Tohama I
MKTLHTDVAIIGAGTAGLAAHRAARAAGKRALLIEGGQYGTTCARVGCMPSKLLIAAAEAAHAAAHGGPFGVHIDGAVRIDGAQVMARVKSERDRFVGFVLEGVENIPAEDKLRGMARFVEDTVLRVDGHTEVRAGSVVIASGSRPAVPPPFLALGDRLVVNDDVFAWDTLPARVAVFGPGVIGLELGQALARLGVQVRVFGVSGSLGGITDPRVRQSARKAFQQEFYLDPDARVLETKRVGDEVEVRYVALDNTERTERFDYALVATGRRPNVDGLDLHNTSLALDARGVPHFDRHTMQAGQAPVFIAGDANADAPLLHEAADEGRIAGENAARYPDVAPGLRRAALGVVFSDPQIALVGTPFARLESGTFVAGEVDFGDQGRSRVMLRNRGMLRVYADIESGRFVGAEMVGPSAEHIGHLLAWAAQQSLTVAQMLEMPFYHPVVEEGLRTALRDAAARLAQARPQRLAA

SEQ ID NO: 21253 - protein, 222 aa, Bordetella pertussis Tohama I
MLNKTCESADEAVSVVESGATILISGFGDIGLPFELLHALARTSVKDLTIVSNNAGTGELGLSRLFRNRQVSRLIASFPSQPDSHHYFAAYQEGLVDLELVPQGTLAERIRAAGAGLAGFFTPTGYGTELAQGKECRMFKGKGYVFEEALPGDFAFIKAHVADAYGNFRYRRASRTFNPIMAMAARTTIAEAKQMVPVGSIDPDDVHTPGVFVDRIVEVRDE

SEQ ID NO: 21254 - protein, 170 aa, Bordetella pertussis Tohama I
MAADDHFSLFGLPTRFALDPVQLEQAWRAVAARVHPDRYATASAAERRVAMQWAARANEAYRQLRDPMLRARYLCEQAGVDLQTESNTAMDPAFLMQQMEWREMLDDARRDPAAFAALRAELEQARLRMQQTLSELIDERGDYQQAGTKVREWMFVEKLAQELSAAQPMQ

SEQ ID NO: 21255 - protein, 342 aa, Bordetella pertussis Tohama I
MNLLSPIDIAGIALRNRIAVAPMSRTQADAHGHPAAETAAYYARYARHGAGLVITEALYTAGPAARAYFNQPGLASEAQAEHWRAAVRAVHQEGGRVIAQLQHAGKLAEPGLHARPLGLVDGAAQGLSWQTQQPNAPAHAATAEEIERIIEGFALSARLAHYAGFDGVEIHGARGYLVNDFLSAYNVRDDEWGADRARIAEAVLRAVRQACPLPIGFNYSIYKMDEYRYQPPGGGAEIAALLARLCQAGADILHISSRRVLKPEPWGGLLAQLARAAAPKALMVNGGLATLQDCETVLAATQADLVSLARPFLANPDWLARSLAGEPLRAYEPGMEQRPLLD

SEQ ID NO: 21256 - protein, 370 aa, Bordetella pertussis Tohama I
MSTLFQPLNAGKLRLANRIVMAPLTRNRSPNAVPPPLTATYYAQRASAGLIITEATAISHQGQGYADVPGLYAPEQLAGWRRVTDAVHAAGGTIVVQLWHVGRISHTTLQPGQGAPVAPSAIRAQARTYLVDAQGKGQFADTSEPRALALDELPGIVEDYRRAARAAIDHGFDGVELHAANGYLLDQFLRSGSNHRDDAYGGSIENRARLLLRALDAVCAEVGADRVGIRLSPVTPANDAHDDQPQPLFEYVLRELARRGLAYVHVIEGATGGDRAYQQGPAPFDYAALKAAYRAAGGAGAWMVNNGYDISLAEQKLSSGQADLVAFGKPFIANPDLVARLRQGAALNEGDRDTFYGGGERGYTDYPALA

SEQ ID NO: 21257 - protein, 489 aa, Bordetella pertussis Tohama I
MTQLTQPLSRAELLRDACYIDGKWVGAGNGPSIPVDNPSTGKTIISVPKLGRKEAEQAIDAAEAALPAWSARTGKERAAILLKWAQLMMENQQDLAVIMTSEQGKPVPEAAGEIAYAASFLEWFAEEAKRIDGDILQSPKGGQRLMVLKQPIGVTAAITPWNFPAAMITRKVGPALAAGCTMVVKPAQQTPLTALALAVLAVLAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGEPHALGGSFFQPTVVRDVTQSMRFAVEETFGPVAPLFKFDSEDEVIGMANNTIFGLAAYFYTRDYARIWRVSEALEYGIVGINTGIISNEVGPFGGVKQSGLGREGSKYGIEDYLELKYLCVDLGA

SEQ ID NO: 21258 - protein, 421 aa, Bordetella pertussis Tohama I
MKNRDLNTRRTLATPRGVGVMCDFYAVRAENSTLWDAEGKEYIDFAGGIAVLNTGHRHPKVKAAIAAQLDNFTHTAYQIVPYEGYVSLAERINAVAPIEGLKKTAFFTTGVEAVENAVKIARAYTGRSGVVAFSGAFHGRTMMGMALTGKVAPYKLAFGPMPGDVFHVPFPNATQAISVADSLKALDLLFKVDIDPKRVAAIIIEPVQGEGGFNVTPPELMQALRKVCDEHGILLIADEVQTGFARTGKLFAMQHHSVQADLITMAKSLGGGMPISGVVGRAEVMDGPAAGGLGGTYAGNPLAVAAAHAVLDVIAEEKLCERAVELGKRLMDRLEGLRAKCPAIADVRGLGSMVALELNDPATGKPDAEAVKRIQQQAIERGLILLSCGVYGNVLRFLYPLTIPDDQFARALDILAEIIAA

SEQ ID NO: 21259 - protein, 450 aa, Bordetella pertussis Tohama I
MAFDFDLYVIGAGSGGVRAARFAAGYGARVAVAESRYLGGTCVNVGCVPKKLLVYGAHFHEDFEQAAGFGWNPGRPEFDWPTLIANKNREIERLNGIYRNLLVNSGVALHEGHARIVDPHTVEINGQRHSAQHILVATGGWPFVPDIPGKEHAITSNDAFFLPELPRRVLVVGGGYIAVEFASIFDGLGAQTVQVYRRELFLRGFDGSVREHLRDELVKKGLDLRFNTDVERIDKRADGVLAVTLSDGSVLETDCVFYATGRRAMLDDLGLENTGVRLAESGYIEVDDEYRTSEPSILAIGDVIGRVPLTPVALAEGMAVARRLFRPQEYRKVDYDLIPTAVFSLPNIGTVGLTTEQALERGFRVTRYESRFRPMKLTLTQSQEKTLMKLVVDADSQKVLGCHMVGPDAGEIVQGLAVALKAGATKQVFDDTIGIHPTAAEEFVTMRTAT

SEQ ID NO: 21260 - protein, 506 aa, Bordetella pertussis Tohama I
MDLSDLKKLGLDVAYPFKEQYENYIGGQWVAPAGGEYFDNLSPITGQPFCRVPRSGAADVELALDAAHRACAAWARTSPAERANILLRIADRIEGQLPMLAVAESIDNGKPLRETTAADLPLAIDHFRYFAGCIRAQEGAISEIDANTVAYHFHEPIGVVGQIIPWNFPLLMVAWKLAPALAAGCVVVLKPAEQTPASILVLAELIGDLLPPGVLNVVNGYGKEAGQALATSKRIAKIAFTGSTPVGKHILHAAADNLIPATVELGGKSPNIFFDDVMDHDDEFLDKALEGLAMFALNQGEVCTCPSRILIQESIYERFIEKAIARVQSIKTGHPLDAGTMVGAQVSQVQMDKILSYIDIGRQEGAQCLTGGARNDMLPGGLDQGFYVQPTMLLGKNSMRIFQEEIFGPVAAVATFKDEEEAIAMANDTFYGLGAGVWSRDGARAYRVGRGIEAGRVWTNCYHLYPAHAAFGGYKQSGIGREAALSNYQQTKCLLVSYSAKALGFF

SEQ ID NO: 21261 - protein, 446 aa, Bordetella pertussis Tohama I
MSTTHVLHRSLRHTPPVAVRGEGVWLYDQAGRAYLDGSGGAAVSCLGHNHPDVRAAMHAQIDALAYAHTGFFSTEIAERLADRLVADAPAGTSHAYFVSGGSEAIEAALKMARQYFVEIGQPQHRHLVARRQSYHGNTLGALAVGGNEWRRAQFAPLLIDVAHVAPCYAYRDQREDESAEQYGERLARELEDTFQRLGPDTVIAFVAEPVVGATAGALTAVPGYFRRIREICDRYGILMIADEVMCGMGRTGTLYAVEQEEIVPDLITIAKGLGGGYQPIGAVMAQGRIVDAMSKGSGFFQHGHTYLGHATACAASLAVQEVIRRDGLLARVRQQGDGLRQRLMQALGAHPHVGDIRGRGLFLGVELVRDRATKATFDPELALHARVKREAMARGLMVYPMGGTIDGRHGDHVLVAPPFIIADDELDQLVERLAGAIDAAIAQTRA

SEQ ID NO: 21262 - protein, 358 aa, Bordetella pertussis Tohama I
MSRGSDAFLSIRNLVKHYGAHRALADVSLDIGAGELVCLLGPSGCGKTTLLRAIAGLERQDGGAIVLGGRDISNEPPQARDYGILFQSYALFPNLTVAQNVAYGLSGRRGDRERVAARVDEMLALVGLSGAARKYPGQISGGQQQRVALARALAPAPSLLLLDEPMSALDARVRDRLRGELRALQRRLSITTLMVTHDQEEAMVMADRIAVMNGGVIEQYGTPRELYRDPRSAFIADFVGEANWLRYQRIDAHRARVGQLELDVEQPLEADSGRLFVRPEAVRLSASGTPASANTVLADVLDGVFLGRGYRISLRLEGIPGATVQSVVSAETGDALLGAHAAGRCWVELPRHALSAYA

SEQ ID NO: 21263 - protein, 424 aa, Bordetella pertussis Tohama I
MDNAELTRRKEAATPRGVGVMCNFYADRAENAELWDTEGRRYIDFAGGIAVLNTGHRHPQLMQALQAQMSRFTHTAYQIVPYASYIQLAERINQLAPGDFAKKTALFTTGAEAVENAVKIARTATGRPAVVAFGAAFHGRTLLGMALTGKVVPYKVGFGPFPADIYHVPYPNALHGVSTDDALAALGTLFKTDVDPRRVAAIIIEPVQGEGGFNICPPAFMQALRALCDDHGILLIADEVQTGFGRTGKLFAMEHYGVAADLTAMAKSLAGGMPLSAVCGRAEVMDAPPPGGLGGTYAGNPLAVAAALEVIRIIETEDLLARGTRLGHQLRDHLEAQRHDAPEIAEVRALGAMVAVEFRQPGSDAPSPEFARQVQARALEQGLLLLTCGSDGNVIRFLFPLTIPEAVMREALDILARTLRGQNA

SEQ ID NO: 21264 - protein, 344 aa, Bordetella pertussis Tohama I
MHVPEQFMRLGRISAPTDVPARAETLRAMLASRGVTVDSPPDYGREPLEGIHSHEYLDYLEHAYTRWQAMRANGADPGPEVLPNLSPYYNGRVEHAARGPCPSTSIVAETGYYLSDLSCPVGPHTWRSALRSTHCAVAAADWALQNQALAYALCRPSRHHAHRDRAGGFCYLNSSAAAAQRLAQRCERVVVLDVDAHHGDGTQNIFYQRSDVMTISLHADPSGYYPFYTGYAHERGYGSGHGYNLNFPLPHGARNAIFLETLDSALTALRDYRPRALVLALGFDTYKDDPISVLKLDMDAYRQIGERINGLGLPTVVVQEGGYMVPAIGPALEAFLQGMAPATV

SEQ ID NO: 21265 - protein, 497 aa, Bordetella pertussis Tohama I
MSTLPPLSHWESLAAGLTLRNQAFIDGRWHDGQAGPLAAINPATGQLLAEVTACSQADIDQAVAAARRAFESGVWSRMPRRERKQCMLRLAALIREHAEELALIETLNMGKPIGDTMAFDIPETAHTYAWYAETIDKQYDEIAPTDADALATITREPLGVVAAVVPWNYPLLMASWKVAPALAAGNSVILKPAEQSSLSALRLAELALQAGIPAGVLNVVPGAGPVAGRALGLHMDVDCLAFTGSTATGKRFMEYSGQSNLKQVWLECGGKSPHIIFDDCPDLDRAALAAAIGIFNNQGEVCIAGSRLYVQAGIYDTFVSKVEACARAMQPGNPLDPASPMGAMVDERQMARVLEYVESGRREGARLRMGGERVRADSGGYYIEPTIFECARPDLTIVREEIFGPVLAVTRFDGEDEVVAQANASAYGLGSGLWTADLSRAHRVSRRLRAGLVWVNCYFDGDVTVPFGGVKQSGFGRDKSLHALDKYTSLKTTWIRL

SEQ ID NO: 21266 - protein, 429 aa, Bordetella pertussis Tohama I
MGPRIITHGEGVYVFDDQGNRYLEGMAGLWSVAVGFGEQRLVEAAARQFQELPYYHTFTHKSHPSVIALAERLIGYTDGRMAQAFFTNSGSEANDTVVKLVWYYNNALGRRDKKKIIARQRGYHGVTVASASLTGLPGNHKDFDLPLPQIRHTACPHYYRYGLPGETEEDFATRMAGELEAMILREGPDTVAAFIGEPVMGAGGVIVPPRTYWQKIQAVCRKYDILVIADEVITGFGRLGQRFGSQVFDIEPDIMVLSKQITSSYQPLGAVLLNTRVADVVAEHSGRLGTFGHGYTASGHPVATAVALENLRLIDERGLIEHAAEMGALLHQELQALSSHPLVGEVRGVGLIAGVELVADKATRQPFDPLGKAGGYAYERAHDHGLIVRGIQDTVAFCPPLIITAEQVRDMVARFARTLDDVAAHVAQG

SEQ ID NO: 21267 - protein, 300 aa, Bordetella pertussis Tohama I
MNRRPAGAARGSDAIGIARAVAGPAALTATQSPAMAARTAYLGPAGSWTHQACLDLYGADGLVPLSREALFAAYADGKVERACVPVATSVVGLTPYMEDVLALPRVVVVAEYPKMLGYSLLARPGTRREDIKEVHAHPVAFEEVRPWLEREMPGARRVPAASGGAAAQAVAASATQDKASFGPRVGASVYQLVSLADGIEEGPHNVTRWWVLGRDMPAPTGKDKTSLLACIPDARLAPLLADFAQAGVPILTIYERPARKTLDAHRYVVEVAGHVRDDALAGLLARQSELRVLGSYPRRY

SEQ ID NO: 21268 - protein, 385 aa, Bordetella pertussis Tohama I
MAKRDYYEVLGVAKNASDEDLKKAYRKLAMKYHPDRNPDSKEAEEKFKEAKEAYEVLGDEQKRAAYDRYGHAGVDPNAAGMGGGMGGGMGGGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 21269 - protein, 354 aa, Bordetella pertussis Tohama I
MKAIRIQGLTKHYGAHQVLRGIDLELAQGELLALLGPSGCGKSTTLQMLAGFDQPTDGQIWIGDRQVSGAGVMVPPERRNISLVFQNYAVWPHMTVFENVAYGLQVRKVARTELAQRVKRALDTVRLTALAQRYPSELSGGQQQRVALARALVVEPDILLLDEPLSNLDAHLREEMRYEIRQVHDLLGLTTVYVTHDQGKALVTADKIAVMQSGQVQQFDSPVNVFSRPANTFVASFIGTNNELHGQLAEPGALRVGDRVLHGDDRSQAGAGGAACLCIRPSAVKLGAAPGANTLSGTVTRVAYLGEYRDVQVELAAGQFVRAYVDPSSTLEPGQRVEVHLPIEHCQILSVTTS

SEQ ID NO: 21270 - protein, 343 aa, Bordetella pertussis Tohama I
MKETYRAMQASRPGVLELVERRTPRPAAAEVLIRVEACGMCGADIADIEKAGPTVPPRVPGHEVVGRIVALGGQVPPIWRLGQRVGVGRLGGHCNECDQCRQGRFQLCESQPIVGASCDGGYAEMMLARATGLVSIPDELDAQEAAPILCAGVATFNALRKCGAQPGDLVAVVGIGGLGHMALQYARRMGFRVVAIGRGADIATDAMALGAHAYIDNLEQNVVATLRRMGGAQAVLTTIDQAEAVSALLGALAPEGRLVVLNPGKSALQVSAGLLVGGQRSIVGSLTGTPHDNEKALNFSVLVDARPSIEVWPLARADEAYRQLQSGAPRFRLVLAMGNTDQD

SEQ ID NO: 21271 - protein, 228 aa, Bordetella pertussis Tohama I
MDIERVEQVRAVERLAHRRGLALMPRAGLAAADFVAARLPAGAQVLALAGPGNNGGDALVAATLLQARGYRVAVVMPAGPARLPDDARRAWQDWCAAGGQASADLPAHAPALVIDGLFGIGLARPLDGAWQGLIDQVNAWRVPVLALDVPSGLSAASGQPLGDPPGRPVRATWTLSFIGVPAALRAPGAAAWCGEQYLSLLGLTPAFLAEAVGPCGQATATAARRSGP

SEQ ID NO: 21272 - protein, 1273 aa, Bordetella pertussis Tohama I
MASTTLGVKVDDALRDRLKAAAQKLNCTPHWLHKQAILSYLDRIERGHLPAEMAHLGRDERGEDEDAGASADAMPPFFEFGQDVQPQSVLRAAITAAYRRPEPECVPLLLGQARVAGPEKVHAMASKLVHALWAKRSGGGVEGLIQEFSLSSQEGVALMCLAEALLRIPDRATRDALIRDKIVHGDWRSHMGGSQSLFVNAATWGLMITGKLVAVSSEQSLSKALTRLIGKGGEPLVRKGVNMAMRMMGEQFVSGQTISEALANNRKMEARGFRYSYDMLGEAATTAADAERYYAAYEQAIHAIGKAAAGRGIYEGPGISIKLSALHPRYARAQRDRVMAELLPRVKALTLLARQYDIGLNIDAEEADRLEISLDLLEALCFVPELDDWNGIGFVIQAYQKRAPFVIDYVIDLAKRSRHRLMVRLVKGAYWDTEIKRAQVDGLEGYPVYTRKVYTDVAYLACARRLLAAPEATYPQFATHNAYTLSAIYQMAGQNYYPGQYEFQCLHGMGEPLYEEVVGPLAQGKLNRPCRIYAPVGTHETLLAYLVRRLLENGANTSFVNLIGDDSITVEQLVADPVEAASRIVPLGAPHEKIPLPRELYGSVQQGARANSAGLDLTNEHRLGSLSAALLASAATDWRAWPMLGEGDPGWDPASAVEVANPANLRDIVGHVMQATPQHVEQALRDAANAAPIWQSTPVPERAQCLRRAAQLLEEQMQTLLGLIVREAGKSLPNAIAEVREAVDFLRYYADQAEREFDNDTHRPLGQVLCISPWNFPLAIFTGQVAAALAAGNTVLAKPAEQTSLIAGQAVAILRAAGVPAGAVQLLPGRGETVGAQLVASPQVRGVMFTGSTEVARIIAGALAERLDDQGHTIPLIAETGGQNAMVIDSSALAEQVVFDVLTSAFDSAGQRCSALRVLCLQEDSADHVLTMLRGAMRELRVGNPDRLSVDVGPVIDAEARNGIQGHIEAMRSSGRPVDQVELAGECRYGTFVPPTLIEIDHIGELTREVFGPVLHVLRYRRDDLDGLIEQINATGYGLTFGVHTRIDETIARVTEQVHAGNLYVNRNIVGAVVGVQPFGGEGLSGTGPKAGGPLYMYRLLATRPAGLPPALDPAAPMPQALALPGPTGETNTYRVEPRGAVYCVAATEAGARAQWAVVSQTGNHAWFADTPAARAWIDGLDARLREQAALLEDSEFDEADFQAVLFEGDGDALRALNMRIAQRPGPLVSVHGLSADALAAGASYAPDRLLAERSISVNTAAAGGNASLMTIG

SEQ ID NO: 21273 - protein, 395 aa, Bordetella pertussis Tohama I
MRKFSRIERLPPYVFNITGELKMAARRRGEDIIDMSMGNPDGATPQHIVDKLVEASTRPDTHGYSVSKGIPRLRKAICDWYMRRYAVEFDPDSEAIVTIGSKEGLAHLMLATLDRGDTVLVPNPSYPIHIYGAVIAGANIRSVRMTPGIDFFEELERAVRESIPKPKMMILGFPSNPTAQCVDLSFFERVVALAKEHDILVVHDLAYADVCFDGYVAPSIMQVPGARDVAVEFFTMSKSYNMAGWRIGYMVGNRELVGALARIKSYHDYGTFTPIQVASIAALDGPQDCVNEIVAQYQRRRDVLARGLHEAGWNVEIPKASMYIWAQIPEPYRAMGSLEFAKRVLSDAKVAVSPGIGFGEYGDEYVRFALIENEQRTRQAVRGIKDMFRKDGLLK

SEQ ID NO: 21274 - protein, 277 aa, Bordetella pertussis Tohama I
MGLPMAGHLARAGHQVTVYNRTAAKAQAWAAEFGGKAAATPREAAAGAQIVFCCVGNDDDLRSVVLGADGAFAGMQAGAVFVDHTTASADVARELYAAARELNLQFIDAPVSGGQAGAVNGALTIMCGGDSATFEDIKPVAHAFGRAVTLVGPPGAGQLAKMVNQVCIAGVVQGLSEAIAFGQTAGLDMKLVLDVISKGAAQSWQMENRGATMVDDQFDFGFAVDWMRKDLGLVLAEARNNGARLPLTALVDQFYGDVQKMGGNRWDTSSLIKRLRD

SEQ ID NO: 21275 - protein, 339 aa, Bordetella pertussis Tohama I
MKAFYHPDQKLHHPQTYFSRGKMRTPQEVPARLDALAEAARKLKFDVREPVDAGAGAIGAVHSLDYLRFLREAHARWKQLPDDWGDEVVSNVFVREPNALRGVLAQAARYLADGSCPVGPHTWQSAYWAAQCAISGAQTLLDGERHAYALCRPPGHHARRDAAGGFCYLNNAAIAAQMLTQRYKRVAILDTDMHHGQGIQEIFYERSDVLYVSIHGDPENFYPVVAGFENERGAGEGYGYNVNLPMPHGSPEPVFFDRLQQAQRAIELFQPDALVLSLGFDVFEKDPQAMVAVSANGFERLGQAIGAFKLPTLIVQEGGYYIEGLEDNAERFFAGLAKA

SEQ ID NO: 21276 - protein, 287 aa, Bordetella pertussis Tohama I
MDTPTSSSLPAIERQHLPALFAARPTDAHKGSCGTLGVIGGGPGMVGAALLAARAGLKVGAGKVLVGLVADTPPLPCDPMQPELMLRDFRGLLEAGLGIDAWTAGCGCGMDALAANALSELFQLRGDAALVLDADGLNLLAAGAVQARWGDAPVVLTPHPAEAGRLLGLSTEAVQADRPGAARALAARYGAWIVLKGAGSIVCDPAGACRINRTGNPGLATAGTGDVLAGILGSLLAQRIAPEQAVPGAVWLHGAAADALVTHGVGPIGLTAGELADSARRLRNSRA

SEQ ID NO: 21277 - protein, 488 aa, Bordetella pertussis Tohama I
MFSSERAYMPVLRRTKIVATLGPATSTPERLDGLIRAGMDVARLNFSHGSAQDHRERVRLVRELAAEQGRFVALMGDLQGPKIRIARFTDQQVTLQAGQPFTLSRSHSKEAGDATIVGIDYPELVQDCRPGDELLLDDGRVVLVVDSVGAEEVHTTVTVGGPLSNNKGINRRGGGLSAPSLTDKDRTDIKLAAEMELDYVAVSFPRYGADIDEARALLRAAGSQAWIIAKIERAEAVADDDALDALIRASDGVMVARGDLGVEVGDAELVGIQKRIIQHARTLNKVVITATQMMESMVASPMPTRAEVSDVANAVLDYTDAVMLSAESASGQYPIEAVAAMARVCLGAEKHPTTTHSHHRLGETFTRCDETIALAAMYAANHFPGVKAIIALTESGHTPLIMSRIRSGVPIYCYSPHGPTQRRAALFRGVYTVPFAPAEYDPADLSNAAIDELKKRGRVAAGDWVILTKGDFYRDSGGTNGLKILKVE

SEQ ID NO: 21278 - protein, 190 aa, Bordetella pertussis Tohama I
MLDREGYRPNVGIILVNGKNEVFWGKRIREHAWQFPQGGIKYGESPVQAMYRELHEEVGLKPEHVRILGRTRDWLRYNVPDHFVRREWRGHYKGQKQIWFLLRLVGRDSDVCLRATQHPEFDAWRWSQYWVPLDAVIEFKRDVYTQALNELAVILFRRHHETRYLRQRVHGPRSTDSPSSETDGHAHIAG

SEQ ID NO: 21279 - protein, 414 aa, Bordetella pertussis Tohama I
MHQNGFTTTIVHSDRDQSAEHGAVHKPMHPSSEYVYEDARELAAVFQGKAGFTYARQGTPTTTALEARITRMEAGKSTVSFATGMAALAAIFTTLLRRGDHLVSSQYVFGNTNSLLNTLMELGVEVTMVDATDVRQVRDALRPNTRMVFTETIANPGTQIANLAGMGALCRERGLVYVVDNTLTSPWMFRPVEVGASLVMNSLSKYIAGHGHALGGAVTDTGLYDWSGYANIYESYRKGAPTGWGLTQIKKKGLRDMGGTLAAEPAHRIAIGTETLALRMARHCSNALALATFLQGHPGVARVHYPGLSSHAQHQRASELFDGRYGGLLGVELAEGIDCFDFLNRLRIVLMATHLGDTRSLALPAAHTIYYEMGAEKRAQMGIADSLIRVSVGIEDEADLLFDFDQALRGCLQS

SEQ ID NO: 21280 - protein, 393 aa, Bordetella pertussis Tohama I
MSSALANIYARLPVSFTHGRGVWLWDTGERRYLDALAGIGVSCLGHGHPGLVAAISEQAARLIHTSNIYEVPQQAALARRLAELSGMSEVLFNNSGSEANEAAIKLARYYGYKQGNTHAHIITMDSSWHGRTLATLAATGSDKARQGFGPMPSGFIQVPYNDLPAIRAAGEAEPRVTAVLLEVLQGEGGIRPSDMAFLQGVRQLCTERGWLLMIDEVQSGIGRTGKWFAHQWADIRPDVMTLAKGLAGGVPIGAMLAAGPAAGVFAPGSHGTTFGGGPLACAAGLAVIDAIEQEGLLGNAHEVGAHLHAALASELAGAPGVIEVRGRGLMLGIELDRPCGILATRAMEAGLLINVTRERVVRLLPPLILSGEEADQIVRILVPLIKQFLAQQQ

SEQ ID NO: 21281 - protein, 285 aa, Bordetella pertussis Tohama I
MTTTDRIAAAFARVSEAGRAAALIPYIAAGDPSPQATVPLMHALVRAGADLVELGVPFSDPMADGPVVQRAAERAIAQGVGLRRVLELVADFRRDDSVTPVVLMGYANPIERMGQRAFAQAAQAAGVDGVLVVDYPPEEVDEFAVMLAEAGVAPIFLLAPTSTEARIEAIGRVARGYVYYVSLKGVTGAGSLDTDDVARKLALIRRHVHIPVGVGFGIRDAASAQRIAAHADAVVIGSKLIETMEQAGAQAGADQKNEAAIAAAQQWLHTIRLALDDVKRENAPA

SEQ ID NO: 21282 - protein, 475 aa, Bordetella pertussis Tohama I
MYEQLALYIDGEFLTGDGRRTQDVVNPATLEVLGQLPHASEADLDRALAAAQRAFETWKRTSPMERAAILRKVGQLSRDRAQEIGRNMTLDQGKPLAEAVGEVASCSEHADWHAEECRRIYGRVIPPRNPDVRQFVVREPIGVCAAFTPWNFPYNQAIRKIAAALGAGCTVVLKGPEDSPSAVMAIARMFHEAGLPKGCLNIVWGEPAKISDYLIRSPIVRKVSFTGSVPVGKQLAALAGAHMKRVTMELGGHSPVLVFDDADVDRAAEMLARFKVRNAGQVCVSPTRFYVQNGAYEQFLARFTEVLKNIKVGDGLEKGTDMGPLAHERRVPAMSTFVDDALKHGGKVVLGGDAPDRKGYFFSPTVVTELPDNAMLMTEEPFGPLAPVVRFTDTDEVLRRANSLPFGLSSYVFTNSLKTATKVSNALEAGMVNINHFGSALAETPFGGIKDSGIGSEGGLETFDGYLVTKYITHI

SEQ ID NO: 21283 - protein, 492 aa, Bordetella pertussis Tohama I
MRISMGKITGFMEFQRLQEAAEAPQKRLKHWREFVLHLNDEQAKQQAARCMDCGIPFCSNGCPVNNIIPDWNDLVYRQDWRRALDVLHSTNNFPEFTGRICPAPCEAACTLNINSDAVGIKSIEHAIIDKGWAEGWVTPQVPVRKTGKKVAVVGSGPAGLACSQQLARAGHSVTLFEKSDRIGGLLRYGIPDFKLEKSQIDRRIAQMEAEGVEFAPSTYIGNPDDAAADGLTVRTPQSLLADFDAVVMTGGSETPRDLPVPGRELSGVYYAMDFLRQQNKAVAGDRLSGQTLAKDKHVVVIGGGDTGSDCVGTSNRHGAASVTQFELLPQPPECEDKPMVWPYWPLKLRTSSSHDEGCERDWSVATKALAGSDGQVEKLVGVRVEWFKDEATGQMKMREIEDSEFEIPADLVLLAMGFVSPVATVLDAFGVDRDARGNVRANTDDYRTNVDKVFAAGDMRRGQSLVVWAIREGRQCARSVDEYLMGASELPR

SEQ ID NO: 21284 - protein, 278 aa, Bordetella pertussis Tohama I
MPVHTRNSSELALSLEDVALGYGDFTVLDGISMQVHAGQVVAVMGGSGSGKTTLLRAATGQIVAQRGSVQAFGTDVGSVSQDGLQSLRKRMGVLFQQGALFTDLNVFENVAFPLREHTALDEAELTARVLDKLDAVGLRTAAHLRVAEISGGMARRVALARAVVLEPELILYDEPFAGLDPISMGITARLIRSLADRLGCATVLITHDVQESFAIADQVYLVGQGRLAAAGTPQQLAASQDPYVKQFLNGEPDGPVAFQYPETPAFRAWLAQQEGRKP

SEQ ID NO: 21285 - protein, 134 aa, Bordetella pertussis Tohama I
MNTEPTWMAEVVFDENGLIPAIAQDAETGQILMVAWMSREALAETAATGRAVYWSRSRQRLWRKGEESGHAQDVHELRLDCDGDVILLKVHQNGGIACHTGRASCFYRRLEGTASQAEWITIDPVLKDPELIYK

SEQ ID NO: 21286 - protein, 396 aa, Bordetella parapertussis 12822
MAKGKFERTKPHVNVGTIGHVDHGKTTLTAAITTVLSNKFGGEARGYDQIDAAPEEKARGITINTSHVEYETETRHYAHVDCPGHADYVKNMITGAAQMDGAILVVSAADGPMPQTREHILLSRQVGVPYIIVFLNKADMVDDAELLELVEMEVRELLSKYDFPGDDTPIVKGSAKLALEGDKGELGEQAILSLAQALDTYIPTPERAVDGAFLMPVEDVFSISGRGTVVTGRIERGVVKVGEEIEIVGIKPTVKTTCTGVEMFRKLLDQGQAGDNVGILLRGTKREDVERGQVLAKPGSINPHTDFTAEVYILSKEEGGRHTPFFNGYRPQFYFRTTDVTGTIDLPADKEMVLPGDNVSMTVKLLAPIAMEEGLRFAIREGGRTVGAGVVAKIIK

SEQ ID NO: 21287 - protein, 475 aa, Bordetella parapertussis 12822
MYEQLALYIDGEFLTGDGRRTQDVVNPATLEVLGQLPHASEADLDRALAAAQRAFETWKRTSPMERAAILRKVGQLSRDRAQEIGRNMTLDQGKPLAEAVGEVASCSEHADWHAEECRRIYGRVIPPRNPDVRQFVVREPIGVCAAFTPWNFPYNQAIRKIAAALGAGCTVVLKGPEDSPSAVMAIARMFHEAGLPKGCLNIVWGEPAKISDYLIRSPIVRKVSFTGSVPVGKQLAALAGAHMKRVTMELGGHSPVLVFDDADVDRAAEMLERFKVRNAGQVCVSPTRFYVQNGAYEQFLARFTEVLKNIKVGDGLEKGTDMGPLAHERRVPAMSTFVDDALKHGGKVVLGGDAPDRKGYFFSPTVVTELPDNAMLMTEEPFGPLAPVVRFTDTDEVLRRANSLPFGLSSYVFTNSLKTATKVSNALEAGMVNINHFGSALAETPFGGIKDSGIGSEGGLETFDGYLVTKYITHI

SEQ ID NO: 21288 - protein, 263 aa, Bordetella parapertussis 12822
MVAVNDPMISIEGISKSFGSFQALQGVDLKIPRGEFLVVLGASGCGKSTLLNLITGFERPTAGRIVVNGREVVDVDPHCGMVFQQYALFPWLTVAENVAFGLKMKGVAAATRRETAQQFIEMVGLKGFENAYPKALSGGMRQRVSIARVLANDPDVILLDEPFAALDAMTRQVLQEELTRIYEQSGKTIVFITHSIDEALLLSSRMVIMSARPGRVACDMPNDLPYPRNADVQLSPRYIELKSQIWDIVQNEVMRSLQARADQ

SEQ ID NO: 21289 - protein, 279 aa, Bordetella parapertussis 12822
MGSVAQQNLFSATDLAVAPVIAVRGLRTAFGDHVVHDNLDLSVYPGEILALVGGSGTGKTVLLRQIIGLERPAAGTIEVLGRRVQELEPAERRRLSHRWGMLFQAGSLFSSLSVFDNVALPLRELRTVPEDLVCDVVMCRLAMVGLTSKDADKRPADLSGGMVKRVALARALSLDPELLFLDEPTAGLDPLRSDEFVDLVRSLHRQLGFTVVMVTHDLDTLLALATRVAVLADKRVIVCDTVREVLKVDHPFIRSFFLGERGRRALGDLAPKETGNGKP

SEQ ID NO: 21290 - protein, 339 aa, Bordetella parapertussis 12822
MKAFYHPDQKLHHPQTYFSRGKMRTPQEVPARLDALAEAARKLKFDVREPADAGAGAIGAVHSLDYLRFLREAHARWKQLPDDWGDEVVSNVFVREPNALRGVLAQAARYLADGSCPVGPHTWQSAYWAAQCAISGAQTLLDGERHAYALCRPPGHHARRDAAGGFCYLNNAAIAAQMLTQRYKRVAILDTDMHHGQGIQEIFYERSDVLYVSIHGDPENFYPVVAGFENERGAGEGYGYNVNLPMPHGSPEPVFFDRLQQAQRAIELFQPDALVLSLGFDMFEKDPQAMVAVSANGFERLGQAIGAFKLPTLIVQEGGYYIEGLEDNAERFFAGLAKA

SEQ ID NO: 21291 - protein, 420 aa, Bordetella parapertussis 12822
MDEIQSIVIVGAGQADAVAAASLRQLGYRGGLTLIGQEAHPPYERPPLSKAVLQGTATHAEAAVHPAGFYAENDIALLTETAVAALDPIARTVRLADGRTLPYDRCLLATGGHARELPALPRGRAGVHYIRTLNDALDLRAALRPGVRAAVIGGGFLGLEVASTARELGAEVTVIENGSRLLERALPAIVSDWLAERVRASGVDLRLGGAIAAIGDGPPYAITLADGTQVNADLIVVSIGLAPEVTLARQAGLPLDDNGGICVDAQARTADPHVYAAGDCASQPRACLGTAARFESWQNANEQARAAATAMLGLAPAAEPYPWFWTDQYGCNIQILGLPQPGLRYVCRPQTDPQAAPRVLWIGLRDGVPCHGIAVNAGGDLRQLRVLFERGIPVDPHRLADPAEALKPLVKAWQAAVAVA

SEQ ID NO: 21292 - protein, 250 aa, Bordetella parapertussis 12822
MYKLVLIRHGESQWNLENRFTGWTDVDLTETGREQARKAGELLKREGYAFDLAYTSVLKRAIRTLWIALDALDAMYTPVGINWRLNERHYGQLQGLNKAETAAKYGDEQVLIWRRAYAIAPEPLDLEDPRHPRFDGRYAKIPADQLPATECLKDTVARVLPFWNESIAPAIRAGRRVLVAAHGNSLRALIKHLDNVSDDDIVGVNIPTGQPLVYELDEDLKPIRHYYLGDAAEIEAAMAAVAAQGKAKKD

SEQ ID NO: 21293 - protein, 493 aa, Bordetella parapertussis 12822
MSLSVGNAALLPGRNLIGSEWREAALGARFAVADPATGKVIAHVPDSGARDAGAAVTAAHQAFADWRRTPAKVRAQIIKRWNALLHENAEDLARLISSEQGKPLAEARGEVSYAASYVEWFAEEATRADGDLIPSPAQGRRMFALREPVGVVAAITPWNFPAAMIARKIAPALAAGCTVVCKPAEDTPLTSLALTALAQQAGVPPGVLNIVTASRGRAAEVADAWLDDPRVRKITFTGSTPVGKHLARRSADTLKRVSLELGGNAPFIVFDDADLDAAVEGLMVSKFRNGGQTCVCPNRIFVQAGVHDAFVRKLAARVEGLVVGPASDPASQIGPMINARAVEKIEHHVADALERGARLAVGGKRIHSARCAGDHYYAPTVLTGVDETMACFREETFGPVAPITVFASEADVVAAANATAFGLAAYFYSTDVRRIWRLADALETGIVGVNEGALAAEAAPFGGVKDSGYGREGSRHGLAEYMQIKYVCQGQLD

SEQ ID NO: 21294 - protein, 247 aa, Bordetella parapertussis 12822
MEWLSMIEIERLGKCYGDLPVLKDCSLAVARGEVVVVCGPSGSGKSTLIKCVNRLEPFESGRIVVDGTDVGAPGTDLPALRARVGMVFQHFELFPHLSVLENVCLGQMSVLGRSRAQARAKADALLERVGVAAHRDKHPGQLSGGQQQRVAIARALAMDPVVMLFDEPTSALDPEMIGEVLDVMTGLARDGMTMMVVTHEMGFARRVADRIVFMEAGEIIDDVASAEFFGSAASPRSREFLSRIISH

SEQ ID NO: 21295 - protein, 335 aa, Bordetella parapertussis 12822
MKAVVIHGHGGPEVLQYDTAFPDPKAGEGDVILRVKATSINYHDVFTRRGMPGIKLDFPVIMGLDVAGEIVEVGPGVQGWKAGDRVLVDPINRAEGGLMGETVHGGLAELCKAREHQLIRIPDGVSYEQAAALPVAFGTAYRMMNTIGQVQAGEKVLVLGASGGVGVGCVMLAKIAGAQVIACASSEAKMQRLRELGADHVINYADTDFAKAIYELYGKPHRRKFDGGVDVAVNFTGGNTWVKSMRCLRRGGRLLTCGATAGYDPQTDLRFIWTFELNIRGSNGWMREDLDALLGLVQSGKMQVPIDRVLSLQDAGEALRLIEDREVMGKVVVTP

SEQ ID NO: 21296 - protein, 234 aa, Bordetella parapertussis 12822
MTKIFEDAAAALSGVIKDGQTIAVGGFGLCGIPSTLIEGLRDSGVANLTCISNNAGVDDFGLGLLLQTRQIKRMIASYVGENKEFERQYLNGELELEFNPQGTLVERLRAGGAGIAAFFTRTGVGTVVEENKETRDFGGDTYVMEQALKADVSLVKAQRADTSGNLVFSRTARNFNPEDAMAGGVTIAEVEELVEAGEMDPDAVHLPGIFVDRIIVVPNPEKRIERKSFRTRGQ

SEQ ID NO: 21297 - protein, 383 aa, Bordetella parapertussis 12822
MNQEAENTKLFAPLSLRGVVLPNRVLISPMSQYSAVDGVVQDWHGYHVAGMARGYPGSVMLEVAAVTRDGRGTPGDLGIWSDEQIAGLAELARIIEAHGVVPAIQIGHAGRKASMQRPWEGGRPLALDSSDEAWQAVGASALPIQDGWPAPRQLAQRELAGLVDSFRAAAARAVQAGYRFVEVHAAHGYLLHSFLSPISNQREDLYGGSLENRMRFPLEVVAAVRAALPDEVPLSVRISAVDGVEHGWQLADSIVFARELKALGVDLVDCSSGGIQGSATAGKGPQAVKRGPGFQVPFAHAVRQEAGIATIAVGLIVEPAQAEAILRQEQADLIAIGREALQNPNWPLHARQALGADRDYSAWPAQYGWWLQRRPKVAWEEGR

SEQ ID NO: 21298 - protein, 228 aa, Bordetella parapertussis 12822
MISKLVATAADALADVPDGATVMIGGFGTAGQPMELIDALLEQGAKDLVIINNNAGNGTTGLAALLGAGRVRKIICSFPRQVDSQIFDGLYRAGKLELELVPQGNLAERIRAAGAGIGAFFTPTGYGTPLADGKETREINGRQYVLEYPLHANYALIQAERGDRWGNLVYRKTARNFGPIMASAARVAVAQVRQVVELGQLDPEAVVTPGIFVKRVVQIDAPRGAKEQ

SEQ ID NO: 21299 - protein, 334 aa, Bordetella parapertussis 12822
MTTAALPYPLDPQIQRFVERMQADSAAHPRRDLVPVEQARAISEAVRRPWAEGGPQMARTREIHAPTPHGPVRLRVYTPRAARPGPAMLYVHGGGWVLFSLDTHDRLMREYAERAGLTVIGVDYTRAPEARYPRAIEEIVGVIDWLDANGAELEVDRARLCIGGDSAGANLSVAACLTLRERGAAPLAGMVLNYGVYDANLFRDSTVKYGGGEYLLSTQQMVWFYWNYLRAGDDPRDPRISPVHADLRGLPPAFMAITELDLLHDANQDMAARLREAGVDVQAKVYPGTVHSFLEAVSLAQVSVAAFDDTAAWLRAVLRPAAAAAAIHTGEHQP

SEQ ID NO: 21300 - protein, 485 aa, Bordetella parapertussis 12822
MTSSPDIGAYAYIGGRWAQTPAARTFRTALPHDTRQSGREFGCATPADAEAAVARATAAAAPWAAVPALQRAEPLRKAAALLLERLDELTRLLALEAGKPLQEARGEVSAAAGFLHAYAGWPAWGGQGAVKRNGALRIVQEKFPRGVAAIITPWNYPLSNPCQKIGAALIGGNPVIWRPSVSTPAVSLALIEIMHQAGFPDGVFNALIEDGDAVSRALVASEAVAAVSFTGSTRVGLQVAAAAAGRGAAVQCEMGGKNAAVVMPDADLDLAAERIAFGAFGFAGQKCTAVSRVLVHRHVADAFLKRLLDIVRDLRPGLPHQEESCLAPLISARQHDLLVDAIAQARERGARLIEGGAPIEQAPYAHGNYLSPALIQVHDLDDPLWTDEYFGPVLALRVCDDLDQAIAEVNATRYGLGAALFSHDARAIGRFTDQVQAGVVKINDVPPGLYPHVSTGGWKASGLGPNELSEDGVDFFLHKKSVYLA

SEQ ID NO: 21301 - protein, 502 aa, Bordetella parapertussis 12822
MITDRLYALAESQPDAIALVFETRQYRYRELADMVSAMAARLHRAGVRPGDHIALMCGNRPAFLACWFALGELGAVCVPLNTGLVGEGFCYSLAKSESRLLIVEPELLAPRRDTLAAMEGAPPVLEIDAAMDLPPAEPPARWAGPPCAARDLNSILFTSGTTGLPKGVTLPHGAYVAASDDMVQSLALTRADRILVFLPLFHANPQMYAVASVLGCGATLVLLRNFSASRFFDEAVAHGATGFTYVGTVLSILDKHYPEPRRDHALRWCVGGGAPARVWEAVESRFGISVRELYGMTETGGWVSMNTPQRARFGSVGHARAGIELAVVDEAGAPVAIRAKGEIVARSERPHVFFSEYWRNPEATAGTLKQGWLHTGDRGYLDEDGFLYFDGRQKELIRRGGEMIAPTEVEQQLLKHEQVRDCAVVGVPDDIMGEEVHAYVVLQGEPDAGALQAFLKARLPAYMAPRYFSFVPAIPKTETQKIKRHLLADLPAQVVDLAVARR

SEQ ID NO: 21302 - protein, 408 aa, Bordetella parapertussis 12822
MDTQTSSPDTKQHYQPFVWEDPFLLHEQLTEDERMIQATAHAYGQEQLLPRIVHAHRTETFDRKIILELGQLGFLGATLEGYGCAGVNHVSYGLIGREMERVDSAYRSSVSVQSSLVMYPIHTFGSEEQRQTYLPGLASGELVGCFGLTEPDHGSDPGGMATRARGVAGGYRLSGAKSWITNSPIADVFLIWAKDDAGDIRGFILDRGMQGLSTERIDGKFSLRASITGTIAMDEVFVPQDRMLPHVKGLRGPFSCLNKARLGISWGALGAAEACLHQARDYVLARTQFGRPLASNQLVQKKLADMETEIAIGLQASLQVARLMDQGRVSTEAISIIKRNNCGKALEISRVARDMLGANGVSDEYHIIRHMINLEAVNTYEGTHDIHALIVGRAITGIQAFYDSGSTQ

SEQ ID NO: 21303 - protein, 387 aa, Bordetella parapertussis 12822
MKPDTRLVHLGRDPERFEGLVNIPPCRTSTFLHASVADYQAAASRKQDSLYYGRFGSQTSRALEAACTELDGGHGAMLFPCGLAAITRVLGSLLEPGQYLLMADTVYGPARAFCEQELARLGVETTWYAPDADLDALVRPATRVIYGEAPGSLTFEMQDLRALAEVARRHGLVSVVDNTWATSWFCQPLALGIDISIQSASKYIVGHSDAMLGVAVANEAQFPALRRAAAQYGNAVSPDDCYMALRGLRTLGVRLERHQASALRVAQWLRTRAEVEQVLHPALPDSPGHALWRRDFSGASGLFGVAFRAGDDAALARFVDDLRLFGIGVSWGGFESLALPSHPVRNTSAAALGGRPLVRLHIGLEDPDDLIADLARALDRHMAAARG

SEQ ID NO: 21304 - protein, 427 aa, Bordetella parapertussis 12822
MVCRPGRTIPQETAMNMPAPAATRRDRIEDELGAHNYQPLDVVLARGSGVWLYDTAGRRYLDCLSAYSAVNQGHCHPRILAAMVEQAQRLTLTSRAFRHDQLAPLYEDLARLTGAHKVLPMNSGAEAVETALKAVRKWGYEARGVPAGQAEIIVCANNFHGRTLGIVGFSTDPDARGGYGPFAPGFTVVPFGDFAALQAAVTPRTVAFLVEPIQGEAGVILPPPGYFRQVRKLCSERDIVLILDEIQTGLGRTGAFLAEAHEGIEADVTLIGKALSGGFYPVSAVLSNQAVLGIFQPGQHGSTFGGNPLACAVARAALRVLHDEGMIDNAREQGAYFMQRLRALPGPVREVRGRGLMLALELEPDAGPARAYCERLMARGMLVKDTHGQTLRLSPPLIVTREQIDWACAQLAHVLAHSAPGSSGGPS

SEQ ID NO: 21305 - protein, 372 aa, Bordetella parapertussis 12822
MKARQDYSIELRDLTLAYGERDIIRGLNLDVRRGEILSLLGPSGCGKTTTLHAIAGLIVPRKGSVVIDGVDQTDVAINRRNVGMVFQGYALFPHMTVFDNVSYGLRIKSVAKAEVRERTMRALALVGMEQYAQRKPRQLSGGQQQRVAIARTMVMEPRVLLLDEPLSNLDAKLRHEIRGDLKRILRELSITSVFVTHDQEEAMFLSDRIVLMKDGAIAQLSSPREIYNNPANSFAAAFLGNTNFIAATLLSQTPDHTGCEVSATETGQVLKGRSALRFDAQQPGFLSVKHDRVSYTLSHEEFLALRDRPGISTMQCRVADVHFLGHVTKVECQAGDQTMTVLRSSACVPPDLAAGAAIYLYWPEEESLVLSL

SEQ ID NO: 21306 - protein, 360 aa, Bordetella parapertussis 12822
MSALFSALQIGALELPNRIVVSPMCQYSAREGQANEWHMQHLMQLALSGAGLVMVEATAVEPRGRISHGCLGLYSDATEAALARVLAAARAVAAPQARLGIQLAHAGRKGAADAPWLGGRPLAPQAGAWRCVAPSATPFAEGWPTPQALDEEGIAGVIEAFGAAARRAARLGFDVVELHAGHGYLLHQFQSPLANARTDAWGGTAAGRQRLALAVARRMREALPAGCVLGARITGTDWLPGGLDIEDAVSLAGQLRQAGVDYVCVTSGFVVRGARIPFGPGYQAGLAEQVRRRTGMPVRAVGGIADPRQAQAIIETGQADQVALARAFLADPRWVWRAAETLGAPAYYAPQYRLGAGLRA

SEQ ID NO: 21307 - protein, 475 aa, Bordetella parapertussis 12822
MSTQYRSFVAGQWQDGGEPVALYNPSDLQEEAGVYMHAPVEMVNQAVRAAEEALDAWRGLHAMARSRLLDGIADGLVGRRDELAMAIAREQGKPLRDALAEATRAADIFRYFASETIRQKGYTYASIRPGVRVEVQRNPVGVVALVTPWNFPVVIPAWKAAAALAYGNTVVMKPSEIAPCGAWILADVMREAGLPAGVFNLVLGAGQAGAALVAHEAVAAVSFTGSVATGKRIAAAAAGKRIQLEMGGKNPLIVLDDADLDTAVACAIDGAFLYAGQRCTASSRIIVTEGIHAAFVKRLLAQTASLAVGHALDEATVIGPVVNAEQFEKNRRYADLARQEGGTVAGGRALSRPTRGHYFEPCLVTGLDNSATVCREEVFGPFACVLTARDYEHALAIANDTPFGLSSGLCTTSMKHAQHFKAHTKSGLASINTSTSGVDFHVPFGGNGASSYGPREQGEFAIEFFTTLRTVYIGD

SEQ ID NO: 21308 - protein, 209 aa, Bordetella parapertussis 12822
MSVSPARDLSTTLLADAGARVMSAGIKPLRAGWHVHGRALTVSVDAGDNLAIHAALAQARPGEVLVIDAQGYLDRAVMGGIMCAQAAAVGLAGVIIDGAMRDLAELRAGTLPAYALGGSPAGPTKRGGGTVRRAIRCGGVDVRPGDWIMADDDGVVVYRDDEAEAVLAAALAKQQAEAARMAAIARGELRPAWLDDALARAPIDTGESA

SEQ ID NO: 21309 - protein, 425 aa, Bordetella parapertussis 12822
MVFPSRGNGSGPFRRQAPDAIHTGTEYSMSNVNTLSALAKSGALSGKRVFIRADLNVPFDDAGRISEDTRIRASVPGIRLALDAGEAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRPLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 21310 - protein, 312 aa, Bordetella parapertussis 12822
MEFKDYYKILGVQSDAPEDEIRRAYRKLARKYHPDVSKESDAETRMRDVNEAYDVLGNQEKRQAYDNLAAGVALDGGFQPPPGWDQGFEFHYARDGEGDQQFSDFFSSLFGGQARRRAAQQDFRARGEDHHAAIEVDLEDALRGATRDISLRSMQPDEHGQPQVRTRTLSVRIPAGVREGQYIRLAGQGMPGYGGAENGDLYLEVRFKPHPRYRAEGRDLYMNLPVAPWEAALGAQVEAPTPGGAVEVAVPPGSRNGRKLRLRGRGIPGDPPGDLYLVLDLVLPPADSEAAREAYRKMAQDLAFDPRRNLGV

SEQ ID NO: 21311 - protein, 301 aa, Bordetella parapertussis 12822
MGVPARRPAGEAALACVLGIPFDCGTHPFRVGARQGPDAIREQSRLLRPYDLARRAGVDNPVEFLRLLDLGNVACVPGDPQASYPAIEQAVAQVLQAGAIPITMGGDGAVTLPQLRAVARRWPGVAVLHFDSHTDTYPIAGYNTATTFTRAAEEGLIDLSHSFHVGTRGNSFMGGVIEYGREVGYTVIPYDDFDRDQAGTLARLRGQLGDRPVYLCFDMDIFDPSCAPGVCTPEWGGLSPKEGLNLLRALSGLNFVAFDVNTVSPPQDVGGATAFLAASVMQEFCALAAAAVQAYPQGRPD

SEQ ID NO: 21312 - protein, 418 aa, Bordetella parapertussis 12822
MPRPHIHDPDLSFSYLHWSTRMSSTPSFHWQDPLLLDQQLTEEERMVRDAAVAYSQDKLAPRVLEAFRHEKTDPAIFAEMGELGLLGATIPTEYGGAGLNYVCYGLIAREVERVDSGYRSMMSVQSSLVMVPINEFGSEAQKRKYLPKLAAGEWIGCFGLTEPNHGSDPGGMETRATKTPDGYKLTGNKMWITNSPIADVFVVWAKCVGGDFDGKIRGFILEKGMKGLSAPAIHGKVGLRASITGEIVMDEVEVSEEQMMPGVSGLKGPFTCLNSARYGIAWGALGAAEACWHTARQYTMDRKQFGRPLAANQLIQKKLADMQTEITLGLQGCLRLGRMKDESTAAVEITSIMKRNSCGKALDIARLARDMLGGNGISDEFGVARHLVNLEVVNTYEGTHDVHALILGRAQTGLQAFY

SEQ ID NO: 21313 - protein, 486 aa, Bordetella parapertussis 12822
MRLVQKALTFDDVLLVPAYSEVLPRDTSLTTRLTRNITLNIPLVSAAMDTVTEARLAIAMAQEGGIGIIHKNLSADDQAKEVARVKRHEFGIVIDPVTVTPDMKVRDAIALQRQHGISGLPVVEGRKLVGIVTNRDLRFEDRLDQPLRNIMTPQDRLVTMKEGATLDEAQALMHKHRLERVLIVNDAFELRGLATVKDIVKNTEHPYACKDSQGQLRVGAAVGVGAGTEERVEKLVAAGVDVIIVDTAHGHSAGVLERVRWVKQNYPKVEVIGGNIATAAAARALVEAGADGVKVGIGPGSICTTRIVAGVGVPQISAISDVAKALEGTGVPLIADGGIRYSGDVAKALAAGAFACMMGGMFAGTEEAPGEVVLFQGRSYKSYRGMGSLGAMADGSADRYFQDPANNADKLVPEGIEGRVPYKGSVLAIIYQLVGGIRASMGYCGCASIDDMRTKTQFVEITSAGVRESHVHDVQITKEAPNYRAD

SEQ ID NO: 21314 - protein, 490 aa, Bordetella parapertussis 12822
MTISPLQLLNDPSLLRTDALVDGRWIAASQRFAVHDPATGRKLADVANLDAAHAREAIAAAQAAWPAWRARTVKERSAILRKWFDLLLANQDDLARLLTAEQGKPFGEARGEIAYAASFVEWFAEEAKRINGETLPAFDNNRRLLVLREPIGVCAAITPWNFPLAMITRKVAPALAAGCPVIVKPAEHTPLTALAAAQLAVRAGVPAGVLGVLPADGANSIAIGKELCANDAVRHLSFTGSTEVGRILMAQSAATVKKLSLELGGNAPFIVFDDADLDSAVEGAMQSKYRNAGQTCVCANRIYVQDGVYDAFVEKLADAVRALKVGPGFDEGVTQGPLIEPEAVDKIERHIEDAVSKGGRVVAGGRRLGGLFFEPTVLVDATSQMLCAREETFGPLAPVFRFHADEDAIAAANATEFGLASYLYSRDVGRIFRAAEALESGMVGVNVGILATEHVPFGGVKQSGLGREGGRHGIDDYVEIKYMCVGDILK

SEQ ID NO: 21315 - protein, 450 aa, Bordetella parapertussis 12822
MAFDFDLYVIGAGSGGVRAARFAAGYGARVAVAESRYLGGTCVNVGCVPKKLLVYGAHFHEDFEQAAGFGWNPGRPEFDWPTLIANKNREIERLNGIYRNLLVNSGVALHEGHARIVDPHTVEINGQRHSAQHILVATGGWPFVPDIPGKEHAITSNDAFFLPELPRRVLVVGGGYIAVEFASIFNGLGAQTVQVYRRELFLRGFDGSVREHLRDELVKKGLDLRFNTDVERIDKRADGVLAVTLSDGSVLETDCVFYATGRRAMLDDLGLENTGVRLAESGYIEVDDEYRTSEPSILAIGDVIGRVPLTPVALAEGMAVARRLFRPQEYRKVDYDLIPTAVFSLPNIGTVGLTTEQALEHGFRVTRYESRFRPMKLTLTQSQKKTLMKLVVDADSQKVLGCHMVGPDAGEIVQGLAVALKAGATKQVFDDTIGIHPTAAEEFVTMRTAT

SEQ ID NO: 21316 - protein, 460 aa, Bordetella parapertussis 12822
MPRSTARAAWKRELAATLALGLPLVLTNLAQMAMTVTDVIFIGRLGSQALAASALGANLFTAIEFFGLGLVAATAPMVAHALGRRGNTVRDVRRTVRQGLWTAVIYSVPGCLLLWHGEAILLAIDQPPELAAQAGAYLRALMWAMPPFLGFLVLRSFVTALQRPRSAFLIALAAIVLNVFGNWVLVFGNLGAPALGLVGAGLASALATLGLFLGMVGVVCLDRRFRRYHLFGDVWQPDWQRLAEFWKLGLPIGAATAFEVTIFNAAAFLMGWLGEPELAAHAIAIQIASVTFMIPYGIAQAATVRVGHAYGARQPDQVARAGWCAFSLGIGSMAIAAALMLLAPGLLVSAFLDIGDPANAQVLRLATAYLAVAALFQIVDGAQVLGAGMLRGLHDTRVPMLYAALGYWGVGLPSGAALAFWAGWRGVGVWSGLAIGLALVAVLMMQRWLRRDRVGLLRRA

SEQ ID NO: 21317 - protein, 298 aa, Bordetella parapertussis 12822
MSATLAFCGAGLMGAPMIRRLLAAGHRVRVWNRSAAKAQALAADGAVVCATPAEAAAGAQAVLLCLTDLAAVQATVFGPHGVADVAGGLLVDHSSIEPDATRALAARLLAASGRVWIDAPVSGGVAGAQAGTLSILAGGPAAAIEAAQPWLRAYAGRVTRLGDTGAGQIGKLCNQTIVATTVNAIAEAVALARRNGIDVAALDTALAGGWADSVLLRIFVPRMTAPVDQPLGALQTMLKNLENVAALAAASGTQLRGLQGVLDSYRTAAARGLGPGDLSDIVRVAWPERPAAPTREPA

SEQ ID NO: 21318 - protein, 273 aa, Bordetella parapertussis 12822
MSATPASDVRIRFEDVCVDYPTADGPMRVLDGINYEIRQGEFVSVIGPSGCGKTTMMGLVGGFVQPTAGRVLLDGQPVGGPGPDRGVIFQEYGVFPWLTVRENIAFGLNLRSNRVAAGERAQICQRYMTLMGLSDFAHHYPKHLSGGMRQRLALARAYAVKPQFLLMDEPFGALDAQTRSAMQDLLLQVQMTEGKTVMLITHSVEEAIYLSSRIVVVTARPARIRTIIDVPFGYPRAENLHEDPRFGELRSHIRALVMEEYAKQARQTVRLSD

SEQ ID NO: 21319 - protein, 297 aa, Bordetella parapertussis 12822
MSSIAFIGLGNMGAPMALNLVKAGHDLTVFDLVPAAVKTLTDAGARAAGSAAEAVQGAELVISMLPASKHVEGLYLGQDLLASIGASALVIECSTIAPDSARKVAAAAQARGIAMIDAPVSGGTGGAAAGTLTFIVGGEAPALERARPVLASMGKNIFHAGGAGAGQVAKICNNMLLGILMAGTSEALALGVANGLDPKVLSDIISKSSGRNWATELYNPWPGVMEHAPASKGYAGGFGVDLMLKDLGLAAEAALGTRSSILLGELARNLYSLHSQGGSGGLDFSSIVNLYSPGERN

SEQ ID NO: 21320 - protein, 257 aa, Bordetella parapertussis 12822
MSTQEMIRIRGLRKAYGEHEVLRGIDFNVEASQVVVVIGPSGSGKSTLLRCCNGLEVAQGGTIDICGHNLLKDGRLLPEAELNRLRMQVGMVFQGFNLFPHLSVLDNVTVGPRTLRGMSRAQAEELGGDLLAKVGLREKMAAMPGSLSGGQKQRVAIARALAMQPRVMLFDEPTSALDPELVGEVLQVMKLLAREGMTMMVVTHEMGFAREVADVVAVMDGGSIVESGPPELIFSQPREARTRAFLQAVLSASQGAA

SEQ ID NO: 21321 - protein, 498 aa, Bordetella parapertussis 12822
MTLHDSAYWRAQAAALAPEGRAYIDGAYCDAADGATFAAHSPIDGRKLADIAACGAADVDRAVAAARRAFEAGVWSGLAPRERKHRLLRLAALITEHQEELALLETLDMGKPIRDALAFDLPETARCYAWYGEAIDKRYDEIAPTGADALATITREPLGVVAAVVPWNYPLMMAAWKVAPALAVGNSVILKPAEQASLSALRLAALAEQAGIPPGVFSVVPGLGAQAGQALGLHPDVDCIAFTGSTATGKRFMTYSGQSNLKRVWLECGGKSPHIVFADCPDLDRAAQVAALAIFSNQGEVCIAGSRLYVQHGIYDAFMEKVAAFAATLRPGNPLDPDSALGAMVDERQTQAVMARIAAGAQEGARLRLGGRQVLTDSGGYYIEPTIFDCPGQDNSLVREEIFGPVLAAQGFADEDEAVALANDSIYGLGAGLWTADLGRAHRLSRRLRAGLVWVNCYADGDITVPFGGVKQSGFGRDKSLHAMDKYSDLKTTWISLR

SEQ ID NO: 21322 - protein, 305 aa, Bordetella parapertussis 12822
MMQTLGFVGLGMMGLPMLENLAGDERWQILAYDRSPAPFERLAGHPAWGKRLRAAAGLQELAACDAVITMLPNSAITNAVVLGGDGQPGLIDLLESGAAIVDMGSSNPADTRLLSEQLAARGLTLIDAPVSGAVAKASTGTLAIMAGAAEADLRRVRPILERMGAAIIHTGAVGSAHAMKALNNYVYAAGLLAVSEAMVIARRMELDLEVFTDVLNASSGRNVASETKLRQFIIPGTYNGGFALALMAKDLGTAQSLQALTGVQADQLALCAELWRQALAQLPGGADNTEIHRFLAQRTPATEPA

SEQ ID NO: 21323 - protein, 354 aa, Bordetella parapertussis 12822
MSIEVRGLSKRFGAFRALDEVSLHIETGELVALLGPSGCGKTTLLRIIAGLESADAGSVLFAGEDATEVDVRQRQVGFVFQHYALFKHMTVFENVAFGLRVRHRSQRPSEARIRAKVLDLLGLVQLDWLADRYPAQLSGGQRQRIALARALAVEPRVLLLDEPFGALDAKVRKELRRWLRRLHDELHVASVFVTHDQEEALEVADRVVLMNAGRIEQVGSPREVWERPATPFVYGFLGDVNQLHGHATRGVWRLGEVALPAPDLPEADNQRAIAYVRPHDIDLARAGTAAPGIPVRLNHVYLAGPSAYLELARQDDQAIIEAQVPEPLFRSLGLKEGEALLAQPRRARVFAVQP

SEQ ID NO: 21324 - protein, 228 aa, Bordetella parapertussis 12822
MDIERVEQVRAVERLAHRRGLALMPRAGLAAADFVAARLPAGAQVLALAGPGNNGGDVLVAATLLQARGYRVAVVMPAGPARLPDDARRAWQDWCAAGGQASADLPAHAPALVIDGLFGIGLARPLGGAWQGLIDQVNAWRVPVLALDVPSGLSAASGQPLGDPPGRPVRATWTLSFIGVPAALRAPGAAAWCGEQYLSLLGLTPAFLAEAVGPCGQATATAARRSGP

SEQ ID NO: 21325 - protein, 300 aa, Bordetella parapertussis 12822
MSRRPAGAARGSDAIGIARAVAGPAALTATQSPAMAARTAYLGPAGSWTHQACLDLYGADGLVPLSREALFAAYADGKVERACVPVATSVVGLTPYMEDVLALPRVVVVAEYPKMLGYSLLARPGTRREDIKEVHAHPVAFEEVRPWLEREMPGARRVPAASGGAAAQAVAASATQDKASFGPRVGASVYQLVSLADGIEEGPHNVTRWWVLGRDMPAPTGKDKTSLLACIPDARLAPLLADFAQAGVPILTIYERPARKTLDAHRYVVEVAGHVRDDALAGLLARQGELRVLGSYPRRY

SEQ ID NO: 21326 - protein, 226 aa, Bordetella parapertussis 12822
MSSIGFRILPLPEPPAADEVLAGFAQIGTAQISDCMGRLYGVQGLRPLHAGAARIVGRAITVKTRPGDNLMIHKAISLAGPGDVIVVDGAGETANALVGELMMMDAQSRGVAAFVIDGAVRDLDVFQQGAFGCFARAVSHKGPYKDGPGEINVPVSIGGQVVAAGDVIVGDADGVVAVPLAQAGAVLAAARRKEDAELAAKEKLRAGTYAKPWVDRIIAEKTGDAQ

SEQ ID NO: 21327 - protein, 459 aa, Bordetella parapertussis 12822
MPLPPHPRPVAAAGLVLAWLLLCLWAWRQARMRAASQARALRALEARPGPQTVLVAYASQTGFAAELAEHTAAALASGGLQARVAELGQIDAATLGHYARALFIVSTYGEGDPPDAAAPFADTAMQSGAGLGALRYAVLALGDSSYAHFCGFGHRLDDWLRANGAAPLFDLVEVDAGDAAALRHWQRHLGVVTGCTDLPDWQAPAYQSWRLARRTLLNPGSQGAPCYFIELTPPHGTAPQWQAGDIAEIGPRDAPDSPLHAHREYSIASLPADGAVHLLVRQMRSADGALGLGSGWLTHIAQTGQAIDLRVRANRNFHPPADARPLILVGNGTGLAGLRALLKARRSAGHGRNWLVFGERSAAHDWFCRDELAQWRGEGWLEYVDAVFSRDAPQRRYVQDLLRERAERVRDWIREGAAVYVCGSLHGMAEGVHQALADILGPAQLQALQHAGRYRRDVY

SEQ ID NO: 21328 - protein, 453 aa, Bordetella parapertussis 12822
MAKSRTIYVCAECGGTSLKWQGKCPHCSAWNTLEETVESAASSAGGHRYAPLAAASPVRSLSEIEARETPRQPTGLDEFDRVLGGGLVAGAVVLIGGDPGIGKSTLLLQALASLSATTKVLYVTGEESAEQVALRARRLGLQTGNVDLLAEIRLEAIQAAVSEQKPTVAVIDSIQTLYSGELTAAPGSVSQVRECAAQLTRLAKQTGIAIVMIGHVTKDGALAGPRVLEHIVDTVLYFEGDTHSSFRLVRAFKNRFGAVNELGVFAMTDRGLRGVANPSALFLSQHQQQVAGSCVLATQEGTRPLLVEVQALVDTSHAPNPRRLTVGLEGNRLAMLLAVMHRHAGVSTYDQDVFVNAVGGVRITEPAADLPVLLAIMSSLRDKPLPAGLVAFGEIGLAGEIRPAPRGQERLREAAKLGFSVALIPKANAPRQPIEGLEIWAVDRLDAALDKLR

SEQ ID NO: 21329 - protein, 446 aa, Bordetella parapertussis 12822
MSTTHVLHRSLRHTPPVAVRGEGVWLYDQAGRAYLDGSGGAAVSCLGHNHPDVRAAMHAQIDALAYAHTGFFSTEIAERLADRLVADAPAGTSHAYFVSGGSEAIEAALKMARQYFVEIGQPQRRHLVARRQSYHGNTLGALAVGGNEWRRAQFAPLLIDVAHVAPCYAYRDQREDESAEQYGERLARELEDTFQRLGPDTVIAFVAEPVVGATAGALTAVPGYFRRIREICDRYGILMIADEVMCGMGRTGTLYAVEQEEIVPDLITIAKGLGGGYQPIGAVMAQGRIVDAMSKGSGFFQHGHTYLGHATACAASLAVQEVIRRDGLLARVRQQGDGLRQRLMQALGAHPHVGDIRGRGLFLGVELVRDRAAKATFDPELALHARIKREAMARGLMVYPMGGTIDGRHGDHVLVAPPFIIADDELDQLVERLAGAIDAAIAQTRA

SEQ ID NO: 21330 - protein, 435 aa, Bordetella parapertussis 12822
MDLKIFDRMESEVRGYIRSFPVIFSQARGSLLIDEEGNEYIDFFSGAGTLNYGHNNPVFKERLLEYLHSDGVVHGLDMATSAKKRFLETVDRVLLKPRNWQYTLQFTGPTGTNAVEAALKLARQVKGRSNIISFTHGFHGVSGGSLAATANAKFRDAAGVSLGNTTFMPYDGYFGPDVDTIAYIERMLDDPSSGLDKPAAVIVETVQGEGGVNVATLRWLKDLQKLCRRHDMLMIVDDIQVGCGRTGSFFSFEAAGIQPDIITLSKSLSGFGLPMSLVLMKPELDVWKPGAHSGTFRGNNLAFVTATQALETYWSSDAFSNEVQRKERLVRDWLENLAHSYPNAGLAVRGRGLIQGLVATAEPELANRIARKAFERGVVIETSGAQDEVLKLLPALTIEDELLTRGLDLIEASVADALSEEQPAAQVLKFGGKRR

SEQ ID NO: 21331 - protein, 236 aa, Bordetella parapertussis 12822
MQPLFKRCGAEFFGTFWLVLGGCGSAVLAAGVPQVGIGYAGVALAFGLTVLTMAYAVGHISGGHFNPAVTVGLAASGRFGWRDVPPYIVAQVVGAIVAAATLASIAQGVAGFDLVASKFAANGYGDHSPGKYSMQAALICEIVLSAGFVFVILGATDKRAPAGFAPIPIGLALTLIHLISIPVTNTSVNPARSTGPALFVGGWALEQLWLFWLAPIAGALVGALAYRLVGTPSAQR

SEQ ID NO: 21332 - protein, 238 aa, Bordetella parapertussis 12822
MTAGTSTHFNQVNGVGMLNKTCESADEAVSVVESGATILISGFGDIGLPFELLHALARTSVKDLTIVSNNAGTGELGLSRLFRNRQVSRLIASFPSQPDSHHYFAAYQEGLVDLELVPQGTLAERIRAAGAGLAGFFTPTGYGTELAQGKECRMFKGKGYVFEEALPGDFAFIKAHVADAYGNLRYRRASRTFNPIMAMAARTTIAEAKQMVPVGSIDPDDVHTPGVFVDRIVEVRDE

SEQ ID NO: 21333 - protein, 170 aa, Bordetella parapertussis 12822
MAADDHFSLFGLPARFALDPVQLEQAWRAVAARVHPDRYATASAAERRVAMQWAARANEAYRQLRDPMLRARYLCEQAGVDLQTESNTAMDPAFLMQQMEWREMLDDARRDPAAFAALRAELEQARLRMQQTLSELIDERGDYQQAGTKVREWMFVEKLAQELSAAQPMQ

SEQ ID NO: 21334 - protein, 361 aa, Bordetella parapertussis 12822
MKKVSVECRNIRLSYGRNEVLKDISIHIEPGEFFALLGPSGSGKSTLLRLIAGFNRQSHGQLLVDGRDIGATPPWDRNIGMVFQNYALWPHMTVWDNVAFGLVERRLPRAEIRDKVAAALELVGLADFGRRRPNQLSGGQQQRVALARTIVIEPQVLLLDEPLSNLDKKLRVQMRQDLLSLQRRLGITTIFVTHDQEEAMTTADRMAVLDHGVVQQIGAPSTLFDYPVNRFVANFVGTMNVLEGEVRERSRGGVVLAVDGVGELHLPVNGDAPQAGRLAASFRPHTVLIEMADGTGDARYVWLPGVVESSEFLGEFTRYQVQVGEQRLTADQHHLAGLSPFPVGAPVAVGLEPTQIRLLAA

SEQ ID NO: 21335 - protein, 262 aa, Bordetella parapertussis 12822
MNLRKLFSKDPVSAIDLDRHPAVEMRKVSKWYGNFHVLREVDLTVGKGERIVVCGPSGSGKSTMIRCINQLERHQEGEIRIGGAEVDDNLERLNAVRMEVGMVFQHFNLFPHLTVLQNCMLAPVWVKRKSEAEARDIAMHYLSRVRIPDQAGKFPGQLSGGQQQRVAIARSLCMAPKIMLFDEPTSALDPEMVKEVLDTMTTLAQDGMTMLCVTHEMGFARKVADRVVFMDAGQIVEVNTPDAFFTRPQHERSVAFLRQIVH

SEQ ID NO: 21336 - protein, 511 aa, Bordetella parapertussis 12822
MSHEELLVDYAARKDHALGMGGPAKLEKRRAEGVLNARERLELLLDPGTFEESGLFAVSHRKEVAERTPADGKIAGYGKVQARKVAVVANDFTVMGASSSVVNGKKIRHMREVATKNGLPLIFLGESTGARMPDRMGAEGRAILGQDPYEYRRLRETPWVSALLGPCYGSSTWYACLSDFVVMRRGATMAVASGRVTSKAIRQEIDSEELGGWRMHTQSTGLVDALAETDEEALEIVKKWLAYFPSNQNEPPPRQAVTPESVPDTGAILQHVPTDSNKVYDVRKAIDCIVDRDSVMELKARFGRSICTMVARLDGHPVGILASNPMFKGGAIDVDACNKAISFLVLCDSFNIPLVFLVDQPGFLIGIEGERRAAPGRIMNWMNAISLVTVPKISVIMRKSYGQAYLNMGGGRNSDEVLAWPSADLGFMAPGVGANVLFGVNEQDDPERYRELVAQLSKDTSAWGLAALYETHAVIDPRETRAHLIRLLDIHRGAQGRRIGQHLLSNWPTTY

SEQ ID NO: 21337 - protein, 410 aa, Bordetella parapertussis 12822
MEQQHTIVIIGAGQAGGWAARTLRAEGYAGRVLLCGDETAPPYERPPLSKEQLAAQAPALPSLMDAAQLAELHIDWLGGAAATRIDRAGRRVLLGDGQALRYDALILCTGGRPRLPPLPGADLPCVHTLRTIDDAARLRAAFDGTPRVAVLGGGWIGLEVAAAARQRGGAVVLLEAADRLCARSGPGLLSETLARLHAGQGVDLRLNARVQRIDAHGRGCRLALADGQGIEADIVVAGVGLVRNDELARQAGLACDHGVIVDGACRTSDPDIYAAGDVAVMARPDGKLAGLESWQNAQDQGIAAARAALGQAVRYAPLPFFWSQQYDTLVQMAGASEPGAALVLRQGGPAQLLCVEMRADGRAAAVLGVNAAREFRQLRKYIAEGARLDARRLADPRSPLAGAVLGEAAA

SEQ ID NO: 21338 - protein, 363 aa, Bordetella parapertussis 12822
MNAAATTPTPLLRVRALNKRFGAFQALRGVDFELGAGEFLTLLGPSGSGKTTTLMSIAGFVAPTSGDILYQGASITGQAPEARGFGMVFQGYALFPHMTVEQNVRFPLAIRGVGREQARRRAQQALEQVQLGSYGARYPRQLSGGQQQRVALARALVYDPRILLLDEPLSALDKKLRADLQWELRKLNKESGASFLYVTHDQEEALSMSDRIAIFNEGGIAQIGSPTELYERPANLFVAGFLGRSNVLAGKVRQAGADGVAVEYEGGVLEVPKPRRQYAPGEAVSLVVRPHQMRLDAAGRQGLAAKVEAISYAGNLMNYLLRTPRGTALFAEAVAGAGAALRQDDLVSVGLDAAAVSLLEAAD

SEQ ID NO: 21339 - protein, 342 aa, Bordetella parapertussis 12822
MNLLSPIDIAGIALRNRIAVAPMSRTQADVHGHPAAETAAYYARYARHGAGLVITEALYTAGPAARAYFNQPGLASEAQAEHWRATVRAVHQEGGRVIAQLQHAGKLAEPGLHARPLGPVDGAAQGLSWQTQQPNAPAHAATAEEIERIIEGFALSARLAHYAGFDGVEIHGARGYLVNDFLSAYNVRDDEWGADRARIAEAVLRAVRQSCPLPIGFNYSIYKMDEYRYQPPGSGAEIAALLARLCQAGADILHISSRRVLKPEPWGGLLAQLARAAAPKALMVNGGLATLQDCETALAATQADLVSLARPFLANPDWLARSLAGEPLRAYEPGMEQRPLLD

SEQ ID NO: 21340 - protein, 370 aa, Bordetella parapertussis 12822
MSTLFQPLNAGKLRLANRIVMAPLTRNRSPNAVPPPLTATYYAQRASAGLIITEATAISHQGQGYADVPGLYAPEQLAGWRRVTDAVHAAGGTIVVQLWHVGRISHTTLQPGQGAPVAPSAIRAQARTYLVDAQGKGQFADTSEPRALALDELPGIVEDYRRAARAAIDHGFDGVELHAANGYLLDQFLRSGSNHRDDAYGGSIENRARLLLQALDAVCAEVGADRVGIRLSPVTPANDAHDDQPQPLFEYVLRELARRGLAYVHVIEGATGGDRAYQQGPAPFDYAALKAAYRAAGGAGAWMVNNGYDASLAEQKLSSGQADLVAFGKPFIANPDLVARLRQGAALNEGDRDTFYGGGERGYTDYPALA

SEQ ID NO: 21341 - protein, 489 aa, Bordetella parapertussis 12822
MTQLTQPLSRAELLRDACYIDGKWVGAGNGPSIPVDNPSTGKTIISVPKLGRKEAEQAIDAAEAALPAWSARTGKERAAILLKWAQLTMENQQDLAVIMTSEQGKPVAEAAGEIAYAASFLEWFAEEAKRIDGDILQSPKGGQRLMVLKQPIGVTAAITPWNFPAAMITRKVGPALAAGCTMVVKPAQQTPLTALALAVLAEQAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGQPHALGGSFFQPTVVRDVTQSMRFAVEETFGPVAPLFKFESEDEVIGMANNTIFGLAAYFYTRDYARIWRVSEALEYGIVGINTGIISNEVGPFGGVKQSGLGREGSKYGIEDYLELKYLCVDLGA

SEQ ID NO: 21342 - protein, 433 aa, Bordetella parapertussis 12822
MHTAFHLPNEPEMKNRDLNTRRTLATPRGVGVMCDFYAVRAENSTLWDAEGKEYIDFAGGIAVLNTGHRHPKVKAAIAAQLDNFTHTAYQIVPYEGYVSLAERINAVAPIEGLKKTAFFTTGVEAVENAVKIARAYTGRSGVVAFSGAFHGRTMMGMALTGKVAPYKLAFGPMPGDVFHVPFPNATQAISVADSLKALDLLFKVDIDPKRVAAIIIEPVQGEGGFNVTPPELMQALRKVCDEHGILLIADEVQTGFARTGKLFAMQHHSVQADLITMAKSLGGGMPISGVVGRAEVMDGPAAGGLGGTYAGNPLAVAAAHAVLDVIAEEKLCERAAELGKRLMDRLEGLRAKCPAIADVRGLGSMVALELNDPATGKPDAEAVKRIQQQAIERGLILLSCGVYGNVLRFLYPLTIPDDQFARALDILAETIAA

SEQ ID NO: 21343 - protein, 352 aa, Bordetella parapertussis 12822
MFFTGPPPARQCRRAPAPAGHASRNHHAMQAIARLSRFVGNTFAIWVLLFAALAYYSPEHFKWLGQYIVPLLGLIMFGMGLTLSKDDFREVLHRPRDVLIGVLGQFIIMPSLAWLLTAVLDLPPEVAVGVILVGCCPGGTASNVMTFLARGDVALSVAITSVTTLLAPIVTPALIYLLASQWIEVSAAAMFWSIVQVVILPIVLGVLAQYLLREKVKVCVDALPLVSVAAIVAIVAAVVAGNQARIATSGLMIFAVVVLHNGLGLLIGYLLGRACGLGVAKRKTLSIEVGMQNSGLGVALATAHFSPLAAVPSAIFSVWHNISGPLAATLLRRFKDDEADAPAPATSAAAAR

SEQ ID NO: 21344 - protein, 456 aa, Bordetella parapertussis 12822
MTTLSSAQQQDIQYQLHSYTNAVKHRDVGPRIITHGEGVYVFDDQGNRYLEGMAGLWSVAVGFGEQRLVEAAARQFQELPYYHTFTHKSHPSVIALAERLIGYTDGRMAQAFFTNSGSEANDTVVKLVWYYNNALGRRDKKKIIARQRGYHGVTVASTSLTGLPGNHKDFDLPLPQIRHTACPHYYRYGLPGETEEDFATRMAGELEAMILREGPDTVAAFIGEPVMGAGGVIVPPRTYWQKIQAVCRKYDILVIADEVITGFGRLGQRFGSQVFDIEPDIMVLSKQITSSYQPLGAVLLNARVADVVAEHSGRLGTFGHGYTASGHPVATAVALENLRLIDERGLIEHAAEMGALLHLELQALSSHPLVGEVRGVGLIAGVELVADKATRQPFDPLGKAGGYAYERAHDHGLIVRGIQDTVAFCPPLIITAEQVRDMVARFARTLDDVAAHVAQG

SEQ ID NO: 21345 - protein, 497 aa, Bordetella parapertussis 12822
MSTLPPLSHWESLAAGLTLRNQAFIDGRWHDGRAGPLAAINPATGQLLAEVTACSQADIDQAVAAARRAFESGVWSRMPRRERKQCMLRLAALIREHAEELALIETLDMGKPIGDTMAFDIPETAHTYAWYAETIDKQYDEIAPTDADALATITREPLGVVAAVVPWNYPLLMASWKVAPALAAGNSVILKPAEQSSLSALRLAELALQAGIPAGVLNVVPGAGPVAGRALGLHMDVDCLAFTGSTATGKRFMEYSGQSNLKQIWLECGGKSPHIIFDDCPDLDRAALAAAIGIFNNQGEVCIAGSRLYVQAGIYDTFVSKVEACARAMQPGNPLDPASPMGAMVDERQMARVLEYVESGRREGARLRMGGERVRADSGGYYIEPTIFECARPDLTIVREEIFGPVLAVTRFDGEDEVVAQANASAYGLGSGLWTADLSRAHRVSRRLRAGLVWVNCYFDGDVTVPFGGVKQSGFGRDKSLHALDKYTSLKTTWIRL

SEQ ID NO: 21346 - protein, 354 aa, Bordetella parapertussis 12822
MKAFFSEEQLLHVPEQFMRLGRISAPTDVPTRAETLRAMLASRGVTVDSPPDYGREPLEGIHSHEYLDYLEHAYTRWQAMRANGADPGPEVLPNLSPYYNGRVEHAARGPCPSTSIVAETGYYLSDLSCPVGPHTWRSALRSTHCGVAAADWALQNQALAYALCRPSGHHAHRDRAGGFCYLNSSAAAAQRLAQRCERVVVLDVDAHHGDGTQNIFYQRSDVMTISLHADPSGYYPFYTGYAHERGYGSGHGYNLNFPLPHGARNAIFLETLDSALTALRDYRPRALVLALGFDTYKDDPISVLKLDMDAYRQIGERINGLGLPTVVVQEGGYMVPAIGPALEAFLQGMAPATV

SEQ ID NO: 21347 - protein, 424 aa, Bordetella parapertussis 12822
MDNAELTRRKEAATPRGVGVMCNFYADRAENAELWDTEGRRYIDFAGGIAVLNTGHRHPQLMQALQAQMSRFTHTAYQIVPYASYIQLAERINQLAPGDFAKKTALFTTGAEAVENAVKIARAATGRPAVVAFGAAFHGRTLLGMALTGKVVPYKVGFGPFPADIYHVPYPNALHGVSTDDALAALGTLFKTDVDPRRVAAIIIEPVQGEGGFNICPPAFMQALRALCDDHGILLIADEVQTGFGRTGKLFAMEHYGVAADLTAMAKSLAGGMPLSAVCGRAEVMDAPPPGGLGGTYAGNPLAVAAALEVIRIIEAEDLLARGTRLGHQLRDHLEAQRHDVPEIAEVRALGAMVAVEFRQPGSDAPSPEFARQVQARALEQGLLLLTCGSDGNVIRFLFPLTIPEAVMREALDILARTLRGQNA

SEQ ID NO: 21348 - protein, 358 aa, Bordetella parapertussis 12822
MSRGSDAFLSIRNLVKHYGVHRALADVSLDIGAGELVCLLGPSGCGKTTLLRAIAGLERQDGGAIVLGGRDISNEPPQARDYGILFQSYALFPNLTVAQNVAYGLSGRRGDRERVAARVDEMLALVGLSGAARKYPGQISGGQQQRVALARALAPAPSLLLLDEPMSALDARVRDRLRGELRALQRRLSITTLMVTHDQEEAMVMADRIAVMNGGVIEQYGTPRELYRDPRSAFIADFVGEANWLQYQRIDAHRARVGQLELDVEQPLQADSGRLFVRPEAVRLSASGTPASANTVLADVLDGVFLGRGYRISLRLEGIPGATVQSVVSAETGDALLGAHAAGRCWVELPRHALRAYA

SEQ ID NO: 21349 - protein, 435 aa, Bordetella parapertussis 12822
MPGGRACARLQGFVALQSCGAPAARGLFPPLFLSPFRIPIMRKFSRIERLPPYVFNITGELKMAARRRGEDIIDMSMGNPDGATPQHIVDKLVEASTRPDTHGYSVSKGIPRLRKAICDWYMRRYAVEFDPDSEAIVTIGSKEGLAHLMLATLDRGDTVLVPNPSYPIHIYGAVIAGANIRSVRMTPGIDFFEELERAVRESIPKPKMMILGFPSNPTAQCVDLSFFERVVALAKEHDILVVHDLAYADVCFDGYVAPSIMQVPGARDVAVEFFTMSKSYNMAGWRIGYMVGNRELVGALARIKSYHDYGTFTPIQVASIAALDGPQDCVNEIVAQYQRRRDVLARGLHEAGWNVEIPKASMYIWAQIPEPYRAMGSLEFTKRVLSDAKVAVSPGIGFGEYGDEYVRFALIENEQRTRQAVRGIKDMFRKDGLLK

SEQ ID NO: 21350 - protein, 414 aa, Bordetella parapertussis 12822
MHQNGFTTTIVHSDRDQSAEHGAVHKPMHPSSEYVYEDARELAAVFQGKAGFTYARQGTPTTTALEARITRMEAGKSTVSFATGMAALAAIFTTLLRRGDHLVSSQYVFGNTNSLLNTLMELGVEVTMVDATDVRQVRDALRPNTRMVFTETIANPGTQIADLAGMGALCRERGLVYVVDNTLTSPWMFRPVEVGASLVMNSLSKYIAGHGHALGGAVTDTGLYDWSGYANIYESYRKGAPTGWGLTQIKKKGLRDMGGTLAAEPAHRIAIGTETLALRMARHCSNALALATFLQGHPGVARVHYPGLSSHAQHQRASELFDGRYGGLLGVELAEGIDCFDFLNRLRIVLMATHLGDTRSLALPAAHTIYYEMGAEKRAQMGIADSLIRVSVGIEDEADLLFDFDQALRGCLQS

SEQ ID NO: 21351 - protein, 436 aa, Bordetella parapertussis 12822
MIDLLARARPRAGVGPRPAFRPAHAAGARRPSGSAPFFVENPAMSSALANIYARLPVSFTHGRGVWLWDTGERRYLDALAGIGVSCLGHGHPGLVAAISEQAARLIHTSNIYEVPQQAALARRLAELSGMSEVLFSNSGSEANEAAIKLARYYGYKQGNTHAHIITMDSSWHGRTLATLAATGSDKARQGFGPMPSGFIQVPYNDLPAIRAAGEAEPRVTAVLLEVLQGEGGIRPSDMAFLRGVRQLCTERGWLLMIDEVQSGIGRTGKWFAHQWADIRPDVMTLAKGLAGGVPIGAMLAAGPAAGVFAPGSHGTTFGGGPLACAAGLAVIDAIEQEGLLANAHEVGAHLHAALASELAGVPGIIEVRGHGLMLGIELDRPCGILATRAMEAGLLINVTRERVVRLLPPLILSGEEADQIVRILVPLIKQFLAQQQ

SEQ ID NO: 21352 - protein, 218 aa, Bordetella parapertussis 12822
MRLILLGPPGAGKGTQAAFLTQHYGIPQISTGNMLRAAVKAGTPLGLEAKKVMDAGGLVSDDLIIGLVRDRLTQPDCANGYLFDGFPRTIPQADALKSAGIALDYVVEIEVPESDIIERMSGRRVHPASGRSYHVRFNPPKAEGVDDVTGEPLVQRDDDREETVRHRLNVYQNQTRPLVDYYSSWAQSDAAAAPKYRKISGVGSVDEIKSRLSQALQS

SEQ ID NO: 21353 - protein, 1273 aa, Bordetella parapertussis 12822
MASTTLGVKVDDALRDRLKAAAQKLNCTPHWLHKQAILSYLDRIERGHLPAEMAHLGSDERGEDEDAGASADAMPPFFEFGQDVQPQSVLRAAITAAYRRPEPECVPLLLGQARVAGPEKVHAMASKLVHALRAKRSGGGVEGLIQEFSLSSQEGVALMCLAEALLRIPDRATRDALIRDKIAHGDWRSHMGGSQSLFVNAATWGLMITGKLVAVSSEQSLSKALTRLIGKGGEPLVRKGVNMAMRMMGEQFVSGQTISEALANNRKMEARGFRYSYDMLGEAATTAADAERYYAAYEQAIHAIGKAAAGRGIYEGPGISIKLSALHPRYARAQRDRVMAELLPRVKALTLLARQYDIGLNIDAEEADRLEISLDLLEALCFVPELDGWNGIGFVIQAYQKRAPFVIDYVIDLAKRSRHRLMVRLVKGAYWDTEIKRAQVDGLEGYPVYTRKVYTDVAYLACARRLLAAPEATYPQFATHNAYTLSAIYQMAGQNYYPGQYEFQCLHGMGEPLYEEVVGPLAQGKLNRPCRIYAPVGTHETLLAYLVRRLLENGANTSFVNLIGDDSITVEQLVADPIEAASRIVPLGAPHEKIPLPRELYGSVQQGARANSAGLDLTNEHRLGSLSAALLASAAIDWRAWPMLGEGDPGWDPAGAVEVANPANLRDIVGHVMQATPQHVEQALRDAANAAPIWQSTPVPERAQCLRRAAQLLEEQMQTLLGLIVREAGKSLPNAIAEVREAVDFLRYYADQAEREFDNDTHRPLGQVLCISPWNFPLAIFTGQVAAALAAGNTVLAKPAEQTSLIAGQAVAILRAAGVPAGAVQLLPGRGETVGAQLVASPQVRGVMFTGSTEVARIIAGALAERLDDQGHTIPLIAETGGQNAMVIDSSALAEQVVFDVLTSAFDSAGQRCSALRVLCLQEDSADHVLAMLRGAMRELRVGNPDRLSVDVGPVIDAEARNGIQGHIEAMRSSGRPVDQVELAGECRYGTFVPPTLIEIDHIGELTREVFGPVLHVLRYRRDDLDGLIEQINATGYGLTFGVHTRIDETIARVTEQVHAGNLYVNRNIVGAVVGVQPFGGEGLSGTGPKAGGPLYMYRLLATRPAGLPPALDPAAPMPQALALPGPTGETNTYRVEPRGAVYCVAATEAGARAQWAVVSQTGNHAWFADTPAARAWIDGLDARLREQAALLEDSELDEADFQAVLFEGDGDALRALNMRIAQRPGPLVSVHGLSADALAAGASYAPDRLLAERSISVNTAAAGGNASLMTIG

SEQ ID NO: 21354 - protein, 354 aa, Bordetella parapertussis 12822
MKAIRIQGLTKHYGAHQVLRGIDLELAQGELLALLGPSGCGKSTTLQMLAGFDQPTDGQIWIGDRQVSGAGVMVPPERRNISLVFQNYAVWPHMTVFENVAYGLQVRKVARTELAQRVKRALDTVRLTALAQRYPSELSGGQQQRVALARALVVEPDILLLDEPLSNLDAHLREEMRYEIRQVHDLLGLTTVYVTHDQGEALVTADKIAVMQSGQVQQFDSPVNVFSRPANTFVASFIGTNNELHGQLAEPGALRVGDRVLHGDDRRQAGAGGAACLCIRPSAVKLGAAPGANTLSGTVTRVAYLGEYRDVQVELAAGQFVRAYVDPSSTLEPGQRVEVHLPIEHCQILSVTTS

SEQ ID NO: 21355 - protein, 327 aa, Bordetella parapertussis 12822
MPSPSALHDLCDTPPTFMGVPHRHAIDGARAAILGIPFDCGTHAFRIGARQGPQSIREQSRLMRTFNPELADYNPLQRLGVIDCGNVRVVPSDILDAFERIEQAVGAIVDGGAVPVTMGGDGSVSLPQLRAVGKRHPGLAVIHLDSHTDTNTFVKGKEYNAGTQFTHAALEGRVDTSLAFHIGTRGTTFTQHVFRHARHFGYQIIPLNELLARGMAEVLQDLRARLGERPVYLCLDMDVLDPSCAPGVCAPSWGGLSAREAIAFLRGLAGLNIVAIDVNTVSPPHDVNGTTASLAAALMVEGLVLLCKRLGLDHPDPAPDFAAMYAR

SEQ ID NO: 21356 - protein, 477 aa, Bordetella parapertussis 12822
MRTITSLIDGQWAGGAGDSENINPSDLSAPVCLVAQASAQQAAQAVEAARRAQPGWAATGLAARAQILKDIGRGIVANSQQLAHILASEQGKTLPEARGEVQRAADIFDYYAGEVFRLGGEMFPSIRAGVEVEISREPLGVVALITPWNFPIAIPAWKTAPALACGNAVVLKPSEFTPATAVMLAEIIRAAGVPDGVFNLVLGTGADVGQVLTGHPAVAGVSFTGSSATGRKIAASAVAGHKKLQMEMGGKNPLVVLDDADLEIALACALDGAFHATGQRCTASSRLIVTPGIHDRFVQELAQRVMALNVGHALDERSQIGPVSNGAQFDKDLSYIALARDEAQRVIGGAALQRAQRGYYLQPCLALDVSLDARIAREEVFGPLACVLRAQDYEHALAIANDTEYGLSAGICTQSLKHATHFRRHVQSGLAMVNMPTSGVDFHVPFGGRGASSYGSSEQGHYAREFFTSLKTSYIRP

SEQ ID NO: 21357 - protein, 409 aa, Bordetella parapertussis 12822
MAMDSIAIIGAGQAGAALAARLRQAGFQGGIDVFGAESAPPYQRPPLSKKYLAGDWEQERLWLRPAQFWREQGIALHLGGTVEALDLASRTLRCGGRRHGWRKLALTTGAAPRPLPAAFAGRSNVFELRNLADVQRLQPAFLAGRRLLVLGGGYIGLETAAVAAQAGLSVQVVERASRVLERVACPATAAAIRALHQRHGVLIHEGRTVAGTEGDEALTGVELDNGLRIACDLVVAGVGVAPQTALAEAAGIDCDDGILVDAYGRTSAPDVWAAGDCARFVLGGEPARLESVQNAIDQAEAVADDMLGQGRPYQPVPWFWSDQYDMKLQIVGLNRGYDAVVSHASAKGESHWYFRADRLISVDALNDGRAYMVGKKLLEAGRAVGRGEVERPGFEPMQLLRDQAESRLR

SEQ ID NO: 21358 - protein, 500 aa, Bordetella parapertussis 12822
MYPSLPDRLLPGLPAPLGATSDGLGVNFAVFSANAARIELCLFDARGRKELARLPMPECTDEVWHGYLPDAQPGLVYGYRAHGPYNPRAGHRFNPHKLLLDPYATALTGALRWSDALFGYRMQHPRADLSMDRRDSAAGVPKAVVTEPAFHWGATRRPAAAWAHTVIYEAHVRGVSMLRSDLREPIRGTCAALADPRFIDHLHRLGVTALELMPVHAFLQDRTLVERGLRNYWGYNTLAYFAPEPAYLADGQPHDLRRAIRRLHAAGIEVILDVVYNHTCEGNELGPTLSWRGLDNASYYRLVPGDERRYIDDTGTGNTLNLSHPRVLQMVMDSLRYWAVHYRVDGFRFDLGVTLGREGTGFDAGSGFFDALLQDPVLARVKLISEPWDVGPDGYQLGRHPPGMAEWNDQFRDTARRFWRGDPGMAGALATRLTASRDVFDHRHRRPWSSINFAAAHDGFTLQDVVSFAERHNEANGEDGADGHGENYSSNWGVEGAASS

SEQ ID NO: 21359 - protein, 227 aa, Bordetella parapertussis 12822
MNRPAAMGATVCAPGKIRFRLWAPSAPPALALEIEGRAPIALRPGPDGYAQAIVDGAPGLRYRYRLAVDCAVPDPASRLQDGDVHGHSVVVGPDRYPWRHTGWRGRPWQDSVIYEAHAGLCGGYAGLRRRLPEVARLGVTLLELMPIADFPGPRNWGYDGVLPYAPDTAYGTPDELKALIDAAHGLQMGVMLDVVYNHFGPDGNYLHRYAADFFDARADTPWGAAID

SEQ ID NO: 21360 - protein, 204 aa, Bordetella parapertussis 12822
MRETRARVQRALLATVMLADGTPMLLAGDEFGNSQGGNNNAYCQDGPMGWLDWAVAQSTPGRALTAYAVRLAALRRAHPSLRATRYGDPAHQWQEGLGAIDWFNARGAPMTSADWDAPEGRLLVLRRALPDPAQPGRVDVTLLLCNAAAEPRPCVLPAPTLAWTLALDSASPEAPAAPCGGPEAIVGARAVLLLTASVDGAHTP

SEQ ID NO: 21361 - protein, 166 aa, Bordetella parapertussis 12822
MNTMYDFSAPTITGAERALADFRGQVALVVNVASRCGFTPQYSGLEELYRSYRNEGFVVLGFPCNQFGRQEPGDEAAIAQFCETQYAISFPLFAKIDVNGAHAHPLYRWLKAHKPGLLGTRAIKWNFTKFLVGRDGLPLRRYAPAHTPESLRHDIARACAAPGPTP

SEQ ID NO: 21362 - protein, 470 aa, Bordetella parapertussis 12822
MASPKDVLKQIADNEVKFVDFRFTDTLGREHHVSVPTSAVDEDKLESGQAFDGSSIPGWKGIEASDMLLIPDLDTANLDPFREEPTLILSCDVVEPSDLKGYDRDPRSLAKRAEAYLKSSGLGDTAYFGPEPEFFVFDGVTWNTDMSGTFVKIKSEEAPWSSGLEFEGGNMGHRPGPKGGYFPVPPVDSFQDMRSEMCLLLEQMGVPVEVHHHEVAAPGQLEIGTKFSTLVQRADWNQVMKYVIHNVAHVYGKTATFMPKPIVGDNGSGMHVHQSIWKDGQNLFAGNGYAGLSEFALYYIGGIIKHARALNAITNPGTNSYKRLVPHFEAPVKLAYSARNRSASIRIPYVGNPKARRIETRFPDPLANPYLAFSALMMAGLDGVQNKIHPGDPADKNLYDLPPEEDAKIPTVCASLEEALAALDKDREFLTRGGVFSNDMLDAYIELKMGEVTRLRMTTHPVEFDMYYSL

SEQ ID NO: 21363 - protein, 242 aa, Bordetella parapertussis 12822
MSMVEFHNVTKKFGDSTVLDGITLDIDAGEVVVVVGPSGSGKSTFLRCINVLETINDGDLLVGGQSVKGDAAQVREIRREAGMVFQQFNLFPQMTALENVMFGPVHTRGAARAEARRQAEELLGKVGLAERMNHYPSELSGGQQQRVAIARALAIKPKLMLFDEPTSALDPELRHEVLKVMRDLAEEGMTMIVVTHEMEFARKVGSRLIFIDCGKIAHDGPPAELLSNPPSQRLKDFLQHVS

SEQ ID NO: 21364 - protein, 471 aa, Bordetella parapertussis 12822
MKTLHTDVAIIGAGTAGLAAYRAARAAGKRALLIEGGQYGTTCARVGCMPSKLLIAAAEAAHAAAHGGPFGVHIDGAVRIDGAQVMARVKSERDRFVGFVLEGVENIPAEDKLRGMARFVEDTVLRVDGHTEVRAGSVVIASGSRPAVPPPFLALGDRLVVNDDVFAWDTLPARVAVFGPGVIGLELGQALARLGVQVRVFGVSGSLGGITDPRVRQSARKAFQQEFYLDPDARVLETKRVGDEVEVRYVALDNTECTERFDYALVATGRRPNVDGLDLHNTSLALDARGVPHFDRHTMQAGQAPVFIAGDANADAPLLHEAADEGRIAGENAARYPDVAPGLRRAALGVVFSDPQIALVGTPFARLESGTFVAGEVDFGDQGRSRVMLRNRGMLRVYADIESGRFVGAEMVGPSAEHIGHLLAWAAQQSLTVAQMLEMPFYHPVVEEGLRTALRDAAARLAQARPQRLAA

SEQ ID NO: 21365 - protein, 430 aa, Bordetella parapertussis 12822
MLEKLFQLRDHATTVRTEIVAGLTTFLTMSYIIFLNPDILSSTGMDRNAVFVATCLAAALGSLIMALVANWPIGMAPGMGLNAFFAFTVVKTMGYTWEQALGAVFISGVIFLFLTISGIRAWLIRGIPHSLRSAIAAGIGLFLAIIALSNANIVVAHPATKVTLGDLREPGPLFAILGFFIIAALGALHVRGAILIGILSVTVLSMLLGYNQFNGIFSSPPSLAPTFMQLDILGALHTGFVHVILVFVLVEVFDATGTLMGIAKRAGLVPEDRPNRLGRALFADSTAIVAGSMLGTSSTTAYVESASGVQAGGRTGLTALVVALLFLAALFIAPLAGSVPAYATAPALLYVAGLMMRELIDIDWNDVSEATPAALTALVMPFTYSIANGLAFGFISYVVLKTCTGRIREVHPATWLVAILFIVRYAFFPE

SEQ ID NO: 21366 - protein, 304 aa, Bordetella parapertussis 12822
MYLTHPSCRLHEMGDWHPESPQRLDAISDQLLASGLLPYLQERQAPEASRADILRVHTPAYLDSLRAHQPEHGYYAIDADTSMNRHTYEAALRAAGAGVAAVDAVLGGEAITAFCSVRPPGHHAERDHAMGFCFLNNVAIAARHALDFHGLQRVALVDFDVHHGNGTEHAFAGDPQVLMCSFFQHPFFPSSGADDPAPNMLNVPVAAYTGGASIRTIVREQWLPRLHEHRPELILISAGFDAHREDDMAQMGLVEADYAWITDRLVEVADQHCQGRIVSTLEGGYNLSALGRSVVAHIRSLSKL

SEQ ID NO: 21367 - protein, 303 aa, Bordetella parapertussis 12822
MSTPTYPTIEQTVGNTPLVRLQRIPGAAGQARGNVILAKLEGNNPAGSVKDRPALSMILRAEERGEIHPGDTLIEATSGNTGIALAMTAAMRGYRMVLIMPDNLSLERRAAMTAYGAELILTPAAKGGMEYARDLATAMQAEGKGKVLDQFGNPDNPRAHIEGTGPEIWNQTDGRVTHFVSAMGTTGTIMGVSTYLKSRNAAVQVVGAQPAEGSQIPGIRKWPEAYMPKIFDRSLVDAYESIAQAEAETMARRLAAEEGIFAGISSAGALVAALRVAERVENATIVFIVCDRGDRYLSTGVFN

SEQ ID NO: 21368 - protein, 361 aa, Bordetella parapertussis 12822
MDDSLQDKLRPLRDRIDAIDAQILDLLSQRARTAQEVGSVKHAAHADGPVLRPEREAEVIRRLQHSNPGPFPKAAVAAVWTEIMSACRGLERGMTVAYLGPQGSFSEQAALEHFGHSVQQLPCPSFDEVFRAVEAGQADVGMVPVENSTEGAVNRSLDLLLNTPLTILGERSLVIRHCLMSQSGTMDGIKTISAHPQALAQCQGWLTRHYPDLNRVAAASNSEAARVAAEDPTVAAIAGEVAAPAWNLRVVAAGIQDDPQNRTRFLAVGHIEPLSSGKDKTSLILAVPNRAGAVYDMLAPMAANGVSMTRFESRPARTGQWEYYFYVDVLGHRDDANVARALAALQAQVAFFKVLGSYPAQ

SEQ ID NO: 21369 - protein, 487 aa, Bordetella parapertussis 12822
MIGYGIAQGEHVAMLSPNCPECLLGNLALGKMGAVSIPINTNAKASLLEYYLTHADCVTAIVADACMEAFAAVAPRLAQLRRVLVIGDAANARRMLEGLPLAVEPFPADAASDEAVSNDVRFTDLAYLMFTSGTTGPSKAIMIPHGAAWHWGKHSVHYRYFLPEDVDYVCMPLFHANALLLSCTTAIVAGTSVVLDERFSASRFWERVRAFGVTRFNAIGAIGNFLWSQPASPVDLEHKVRICSLAPPPPFVHDFERRFGLRVIAGYALSDYGFGASLSPDAPPEKSLSLGRTCEDVAIRVVDEDDLTLPAGQVGEIVMRIEQPGAAPLGYYKMPEATLAAWRNLWFHTGDRGYFDADGYLYLTDRKKDMIRRRGENISSYEVESVIALHPAVLQVAVYPLQSEHSEDEVAVTVMLKDGQALDPDELVAFCQQQMAAHMVPRFVEFVDAMPLTPTNKIEKYKIKERAQADRSRLWDREGTPGARPGP

SEQ ID NO: 21370 - protein, 475 aa, Bordetella parapertussis 12822
MSKQFDVVIIGAGPGGYIAAIRAAQLGMSVACIDAWQNGQGGPAPGGTCTNVGCIPSKALLQSSEHYEQANHHFAEHGIEVKGVSLKLDTLIGRKNTVVKQNNDGILYLFKKNKVTYFHGKGAFAGQVDGGWSIKVTGTTDADLVAKHVIVATGSSARELPGLPFDEKNILSNDGALNIGAVPKKLGVIGAGVIGLEMGSVWRRLGAEVTILEAMPEFLAAADQQVAKEALKSFAKQGLDIQTGVKIGEIKAAAKSITVPYVDAKGAEQKLVVDKLIVSIGRVPYTGGLNAEAVGLKLDERGFVAVDEDCKTNLPNVWAVGDVVRGPMLAHKAEEEGVAVAERIAGQHGHVNFATVPWVIYTSPEIAWVGKTEQQLKAEGREYKAGSFPFMANGRARALGDTTGFAKVIADAKTDEVLGVHIIGPMASELISEAVTIMEFRGAAEDIARICHAHPTLSEAVKEAALAVDKRTLNF

SEQ ID NO: 21371 - protein, 428 aa, Bordetella parapertussis 12822
MSAIVDIIGREILDSRGNPTVECDVLLESGAMGRASVPSGASTGSREAIELRDGDKGRYLGKGVLRAVENLNTEISEALMGLDAQEQTFVDRTLIELDGTDSKERLGANAMLAASMAVARAAADESGLSLYRYFGGSGPMSMPVPMMNVINGGAHANNTLDLQELMILPVGAASFREALRWGAEVFHMLKKLIHDQGMSTAVGDEGGFAPNVASHEAAIQLILKAITEAGYEPGTQIALGLDCASSEFYRDGKYTLAGEGGVSLSSQEFANLLATWCDKYPIISIEDGMAENDWDGWKLLTDQLGKKVQLVGDDLFVTNTRILREGIQKGVANSILIKINQIGTLTETFAAIEMAKRAGYTAVVSHRSGETEDSTIADIAVATNAMQIKTGSLSRSDRMAKYNQLLRIEEELAEVASYPGLEAFYNLR

SEQ ID NO: 21372 - protein, 259 aa, Bordetella parapertussis 12822
MRQSKKQRRRDPPGPGLYQIISIGAGAMDKVYASAAEALAGVVKDGQMIAVGGFGLCGIPEALIAALRDSGVKGLTCISNNAGVDGFGLGQLLNTRQISKMIASYVGENKEFERQFLSGELELEFTPQGTLAEKLRAGGAGIPAFFTRTGVGTVVADGKEIREFDGHQYVMERALVPDVSLVKAHIADRSGNLVFRKTARNFNPNVAMAGKMTVVEVEEIVETGTLDPDQVHLPGIYVHRIVVNATPEKRIEQRTTRPA

SEQ ID NO: 21373 - protein, 285 aa, Bordetella parapertussis 12822
MTTTDRIAAAFARVSEAGRAAALIPYIAAGDPSPQATVPLMHALVRAGADLVELGVPFSDPMADGPVVQRAAERAIAQGVGLRRVLELVADFRRDDSVTPVVLMGYANPIERMGQRAFAQAAQAAGVDGVLVVDYPPEEVDEFAAMLAEAGVAPIFLLAPTSTEARIEAIGRVARGYVYYVSLKGVTGAGSLDTDDVARKLALIRRHVHIPVGVGFGIRDAASAQRIAAHADAVVIGSKLIETMEQTGAQAGADQKNEAAIAAAQQWLHTIRLALDDVKRENAPA

SEQ ID NO: 21374 - protein, 413 aa, Bordetella parapertussis 12822
MRGRAFRSCPGGACRAAGRSVRTLSLLQVLMKFDTLLTHGGRDPKAHKGMVNTPVYRTSTVVFESMAEYKATRGAKFDHVRYGRLGTHTVKELENLVAAIEGGHRAVLTPSGVSAIATTLNTLARPGSHILVPDNVYYPCREFCEKVLAPRGVRVEYYAGSEVERLVRPDTSVVYCESPGSLTMEMQDFARIAAAAHAVGAKVVADNTWATPVFLQPFEHGIDVSIHAATKYLVGHSDVMMGTVTAHDPELWLAIRTEAAAQGLSISPDDAYLATRGIRTLGVRMAAHYRNALDVAQWLAGHPRVAQVLYPALPQHPDHALWRRQMRGASGLLTLELEPCSLEQRDAFIDRLTLFAIGASWGGYESLVLPADTAGKRSLAGRDYAGPLVRLHIGLEDVEDLKRDLDQALRRED

SEQ ID NO: 21375 - protein, 248 aa, Bordetella parapertussis 12822
MTTAENRARLVLGNWKMHGNLAENAALLAELRAADAAAHCEMGVCVPFPYLAQTAAALQGSAIGWGAQDVSAHAKGAYTGEVAAPMLAEFGCRWVLVGHSERRTLHAESDQLVADKARAALEAGLTPVVCVGESLQEREGGNTLGVIERQLEPVLALGRDALVRMVLAYEPVWAIGTGRTASPEQAQEVHSAIRVALDGLQASQVRVLYGGSVKGANAASLFAMPDIDGGLVGGASLVAEEFLRIAAA

SEQ ID NO: 21376 - protein, 325 aa, Bordetella parapertussis 12822
MRAVEITRPGGPEVLVPTERSVPEPASGEVLIKVSVAGVNRPDVLQRKGNYAPPPGASDLPGLEVAGEIVGGDAAAGGFAIGDKVCALVAGGGYAEYVVAPAPQCLPIPRGLTEIEAAGLPETYFTVWSNVFDRGRLAAGEALLVHGGASGIGTTAIQLARAMGNKVYATVGSDERARAVEALGAALGINYKTQDYVKEVLDATGGAGVDVVLDMVAGEYIGRNLKCLADDGRIVIIALLGGAHANVDCNQVLRRRLTITGSTLRPRPVEFKGEIARALRERVWPLLENGTLKPVVHATLPLEQAAAAHAMMEAGENIGKIILTV

SEQ ID NO: 21377 - protein, 377 aa, Bordetella parapertussis 12822
MAKRDYYEVLGVAKNASDEDLKKAYRKLAMKYHPDRNPDSKEAEEKFKEAKEAYEVLGDEQKRAAYDRYGHAGVDPNAAGMGGGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 21378 - protein, 304 aa, Bordetella parapertussis 12822
MTTEKHLGFVGIGRMGTPIAERLLEAGYTLTVYDTQAPALQALAAKGAHIADSPKAVADRAETVLVSLPTPDIVLAVALGEDGLARGNAVRTVIDLSTSGSQAARTLADGLAAQNIASIDCPVSGGVTGAKRGTLALMVSGPRERYDALHDMFGVIGKPVYVGERAGMAQTMKVINNLISVTALSITSELMVMGVKAGLDPDIMLQVINSGSGRTNASEDKIPRFVLTRSFDFGFAIGLSAKDVRLCLEESEQLGVPLRVGDAARRLLNDARDKFGNDADLTEIIRYVEDNAGVQVRGKAADAA

SEQ ID NO: 21379 - protein, 480 aa, Bordetella parapertussis 12822
MPVLRRTKIVATLGPATSTPERLDGLIRAGMDVARLNFSHGSAQDHRERVRLVRELAAEQGRFVALMGDLQGPKIRIARFTDQQVTLQAGQPFTLSRSHSKEAGDATIVGIDYPELVQDCRPGDELLLDDGRVVLVVDSVGAEEVHTTVTVGGPLSNNKGINRRGGGLSAPSLTDKDRTDIKLAAEMELDYVAVSFPRYGADIDEARALLRAAGSQAWIIAKIERAEAVADDDALDALIRASDGVMVARGDLGVEVGDAELVGIQKRIIQHARTLNKVVITATQMMESMVASPMPTRAEVSDVANAVLDYTDAVMLSAESASGQYPIEAVAAMARVCLGAEKHPTTTHSHHRLGETFTRCDETIALAAMYAANHFPGVKAIIALTESGHTPLIMSRIRSGVPIYCYSPHGPTQRRAALFRGVYTVPFAPAEYDPADLSNAAIDELKKRGRVAAGDWVILTKGDFYRDSGGTNGLKILKVE

SEQ ID NO: 21380 - protein, 362 aa, Bordetella parapertussis 12822
MIHIENLSKTYATPHGRFEALRGINLHIQQGEVFGIIGPSGAGKSTLVQCINLLERPDQGSIAIGGQALVGLGEAQLRNQRRRIGMVFQGFNLLARRTVYGNVALPLEIAGVARAEIPARVERLLALVGLEHLRDRYPSQISGGQKQRVGIARALANDPDVLLSDEATSALDPETTHNILALLRDINRKTGVTVVMITHQMEVVREICDRVAVLSHGEVVELGSTREVFAAPRHEVTRAMVSAATASDLSEATLAAVKQRIDALAAAEPGRAVRLWRLSLKGVAAGEPLWSDLAREFALDVSLVQARVEDIQGVAVGTLFVLAQGAPHAVKDALAALAAREITVEEIAHEPATDRSAYHVAA

SEQ ID NO: 21381 - protein, 302 aa, Bordetella parapertussis 12822
MATIGSKTYDTTTPRNVAFLGLGVMGLPMAGHLARAGHQVTVYNRTAAKAQAWAAEFGGKAAAATPREAAAGAQIVFCCVGNDDDLRSVVLGADGAFAGMQAGAVFVDHTTASADVARELHAAARELNLQFIDAPVSGGQAGAVNGALTIMCGGDSATFEDIKPVAHAFGRAVTLVGPPGAGQLAKMVNQVCIAGVVQGLSEAIAFGQTAGLDMKLVLDVISKGAAQSWQMENRGATMVDDQFDFGFAVDWMRKDLGLVLAEARNNGARLPLTALVDQFYGDVQKMGGNRWDTSSLIKRLRD

SEQ ID NO: 21382 - protein, 190 aa, Bordetella parapertussis 12822
MLDREGYRPNVGIILVNGKNEVFWGKRIREHAWQFPQGGIKYGESPVQAMYRELHEEVGLKPEHVRILGRTRDWLRYNVPDHFVRREWRGHYKGQKQIWFLLRLVGRDSDVCLRATQHPEFDAWRWSQYWVPLDAVIEFKRDVYTQALNELAVILFRRHHETRYLRQRVHGPRSTDNPSSETDGHAHIAG

SEQ ID NO: 21383 - protein, 484 aa, Bordetella parapertussis 12822
MENLGYPARLELYVAGQWRGVEGRRTQVVVNPSTQQPLGELPLASAEDIDDALAAADQAFGDWARTTAWERADILQRAAALIEARRDRLAVVLTLENGKPLADSHGELDRVVETILWCAEEGKRTYGRVLPARAQRLSQSSLKRPVGPVAAFVPWNFPAALAARKLAAAMAAGCTVVLKPAEETPAICIELVRAFVDAGTPAGVVNLLYGVPAQVSERLIASPIIRKVSFTGSVAVGRLLASMAAGHLKPATMELGGHAPVVVFDDVDADRVAKMCVGFKYRNAGQVCLSPSRFYVHERIADRFAESFVRHAGLLRVGDGMEEGVQMGPLNNVLRLQAAERLVEQAVGAGASLALGGRRIGQRGYFYPPTVLEGVPDAADILAEEPFCPVAPIMRFGSMDEVIGRANHPSLGLAAYAFTNRMATSAEFAERIEAGWIGINNFVPALADAPIGGMKDSGLGYEGGPEGLDAYLHARFVSQLNVEV

SEQ ID NO: 21384 - protein, 427 aa, Bordetella parapertussis 12822
MSTNAELFDRACRSIPGGVNSPVRAFRSVGGTPRFIQRAQGPYVWDAEGKQYIDYVGSWGPAILGHAHPEVVRAVQEAAVHGLSFGAPTEAEVELAEMLIARLPSLEQVRLVSSGTEATMTAIRLARGATGRHKIIKFEGCYHGHSDSLLVKAGSGLLTFGNPSSAGVPPEFVAHTLPLEFNNLAAVDAAFSQHGAEIACVIVEPVAGNMNLIKPAEGFLAGLRELCTRHGAVLIFDEVMTGFRVGPQGVQGLTGVRPDLTTLAKVIGGGMPVGAFGGRADLMAHITPLGGVYQAGTLSGNPVAVAAGLATMRLIGEPGFYERLSAQTARLAQGLQERARAAGVPFSADAIGGMFGLYFGDRVPASFAEVSACDTEAFKRFFHAMLERGIHFAPSAFEAGFVSATHDDAVIDATLEAAEQVFATLRA

SEQ ID NO: 21385 - protein, 246 aa, Bordetella parapertussis 12822
MTDAIIRMQDVNKWYGQFHVLRNINLDVAPGERIVVCGPSGSGKSTMIRCINRLEEHQQGHIIVDGTELTNDLKHIEAIRRDVGMVFQHFNLFPHLTVLENLTLGPTWVLKKSRAEAEATAMKYLERVRIPEQATKYPGQLSGGQQQRVAIARSLCMNPKIMLFDEPTSALDPEMVKEVLDVMVRLAQESGMTMLCVTHEMGFARKVANRVIFMDRGEIIEQNTPDEFFDNPQNERTKLFLSQILH

SEQ ID NO: 21386 - protein, 311 aa, Bordetella parapertussis 12822
MASAQLATLSAQVRQLYAGWDQNPDIARIRRDWDAFFGAVRLPARVTPVDAGGVPCHWIEAPASTRDRVVVFIHGGGYQIGSHRSHHNLMARLSACSGRAVLSIGYRLAPQARCPAALEDVDAAHAWLAGQGWAARQTALCGDSAGGALAVLLLARLRARGAALPAACAVMSPWIDLQARGESYTANAASDPIANRATVLRMARAYLGRDGDPEAPAVSAQHADLRGLPPLLVQAGSAEALLDDARALAARAAASGVAVRLSVWQDMPHVFQLFAARLDAADAAIAELADFINHPLRAARTGAEPHHETST

SEQ ID NO: 21387 - protein, 341 aa, Bordetella parapertussis 12822
MLHLAKFPRIKLGHFPTPLEFMPNLTRHLGGPNLYIKRDDCTGLATGGNKTRKLEFLVAQAVAQGADTLITQGAVQSNHARQTAAAAARVGMKCKILLEERVPHPDDDYSHSGNVMLDGLMDGEIVARLPAGTDMQQAMEDLARELAGRGSKPYVIAGGGSTPVGALGYVACAQELLHQSFETGLRIDHVVHATGSAGTQAGLVVGLRAGNSGIPVYGISVRAPKPRQEENVWKLVQSTVDYMGLPASAVERADVVANSDYVGEGYGISTDAMIEAVHMTAALEAILLDPVYSGKGMAGLIGLIRSGHFKQGENVVFVHTGGAVGLFGYRRAFEGLPPLAA

SEQ ID NO: 21388 - protein, 244 aa, Bordetella parapertussis 12822
MIEIKNVSKWYGTTQVLNDCVTSVASGEVVVVCGPSGSGKSTLIKTVNGLEAFQKGEIIVDGVSVGARDTDLPRLRTRIGMVFQGFELFPHLSVMRNLVLAQVKVLKRSEEEARAHAVALLERVGLQAHQHKFPGQLSGGQQQRVAIARALAMQPIAMLFDEPTSALDPEMVNEVLDVMIDLAREGMTMMVVTHEMGFARKVADRVIFMDAGSIVEDCRNDDFFQNMDQRSPRARHFLSKIISH

SEQ ID NO: 21389 - protein, 284 aa, Bordetella parapertussis 12822
MDTSSLPAIERQHLPALFAARPTDAHKGSCGTLGVIGGGPGMVGAALLAARAGLKVGAGKVLVGLVAETPPLPCDPMQPELMLRDFRGLLEAGLGIDAWTAGCGCGMDALAANALSELFQLRGDAALVLDADGLNLLAAGAVQPRWGDAPVVLTPHPAEAGRLLGLSTEAVQADRPAAARTLAARYGAWVVLKGAGSIVCDPAGACRINRTGNPGLATAGTGDVLAGILGALLAQRIAPEQAVPGAVWLHGAAADALVTHGIGPIGLTAGELADSARRLRNSRA

SEQ ID NO: 21390 - protein, 245 aa, Bordetella parapertussis 12822
MHIMPPEIANTMSTQPASTRIAPSILSADFARLGEEVRNVVAAGADWIHFDVMDNHYVPNLTIGPMVCAAIRPHVQVPIDVHLMVEPVDEIVPQFAKAGANVITFHPEASRHVDRTLALIRDHGCKAGLVFNPATPLHYMDYVMDKLDVVLLMSVNPGFGGQAFIPATLAKLRDARARIDRWRAAGGQPILLEVDGGVKVDNIAEIRAAGADTFVAGSAIFGKPDYAQVIGQLRAEIARGETIAV

SEQ ID NO: 21391 - protein, 486 aa, Bordetella parapertussis 12822
MEDLRNHEFKNYIGGQWVACAAGKTYPNVNPADTDDIVGRFQASQAEDAAAAVAAAQAAFDGWRNLAVSKRAALMQRAADYLEAHAEQFGRELTREEGKALNLAKDEVLRSAQTIRFYAAEGQSFSGETFVNDDPDMVVYSQREPLGVVTVISPWNFPVSIPARKIAPALITGNTVVFKPSSDAPLSGLRLVEAFEQAGLPPGVLNLVTGSASAIGAAITQAPQVRAVSFTGSTAAGEQIHRSVDMTTRTQMELGGKNPLIVMADADLDRAVDLVVKGGFSLSGQACTGTSRVLVDAPVKAAFTEKLLAKVKALKVGNSLEGSFDLGPLATARQLESVMRYIEVGKQEARLLYGGERLDGPGYERGYYLTPAVFADVTQQMRIAREEIFGPVIALIEVNGYEDAIAKANDTEYGLAAAIATTNAQYAHRFARDIQAGTVKINRTTTGNLINAPFGGLKRSSTSTFRESGRIGLEFYTQIKTVYRAG

SEQ ID NO: 21392 - protein, 368 aa, Bordetella parapertussis 12822
MKTKAAIAWKAGAPLTVEDVDLEGPKAGEVLVEIKATGICHTDYYTLSGADPEGIFPAILGHEGAGVVMDVGPGVTTLKKGDHVIPLYTPECRQCKFCLSRKTNLCQAIRTTQGKGLMPDGTSRFSIDGKPLFHYMGTSTFANHIVVPEIALAKVRPDAPFDKICYIGCGVTTGIGAVVFTAKVEAGANVVVFGLGGIGLNVIQGAKMVGADKIIGVDLNPAREAMARKFGMTHFVNPSEVENVVDHIIQMTDGGADYSFECIGNTKVMRQALECCHKGWGQSVIIGVAEAGAEISTRPFQLVTGREWKGSAFGGARGRTDVPKIVDWYMEGKINIDDLITHTLPLDRINEGFDLMKRGESIRSVVVY

SEQ ID NO: 21393 - protein, 492 aa, Bordetella parapertussis 12822
MRISMGKITGFMEFQRLQEAAEAPQKRLKHWREFVLHLNDEQAKQQAARCMDCGIPFCSNGCPVNNIIPDWNDLVYRQDWRRALDVLHSTNNFPEFTGRICPAPCEAACTLNINSDAVGIKSIEHAIIDKGWAEGWVTPQVPVRKTGKKVAVVGSGPAGLACSQQLARAGHSVTLFEKSDRIGGLLRYGIPDFKLEKSQIDRRIAQMEAEGVEFAPSTYIGNPDDAAADGLTVRTPQSLLADFDAVVMTGGSETPRDLPVPGRELSSVYYAMDFLRQQNKAVAGDRLSGQTLAKDKHVVVIGGGDTGSDCVGTSNRHGAASVTQFELLPQPPECEDKPMVWPYWPLKLRTSSSHDEGCERDWSVATKALAGSDGQVEKLVGVRVEWFKDEATGQMKMREVEDSEFEIPADLVLLAIGFVSPVATVLDAFGVDRDARGNVRANTDDYRTNVDKVFAAGDMRRGQSLVVWAIREGRQCARSVDEYLMGASELPR

SEQ ID NO: 21394 - protein, 298 aa, Bordetella parapertussis 12822
MAVSPGAGRPWAAPNLLPLPMPVHTRNSSELALSLEDVALGYGDFTVLDGISMQVHAGQVVAVMGGSGSGKTTLLRAATGQIVAQRGSVQAFGTDVGSVSQDGLQSLRKRMGVLFQQGALFTDLNVFENVAFPLREHTALDEAELTARVLDKLDAVGLRTAAHLRVAEISGGMARRVALARAVVLEPELILYDEPFAGLDPISMGITARLIRSLADRLGCATVLITHDVQESFAIADQVYLVGQGRLAAAGTPQQLAASQDPYVKQFLNGEPDGPVAFQYPETPAFRAWLAQQEGRKP

SEQ ID NO: 21395 - protein, 134 aa, Bordetella parapertussis 12822
MNTEPTWMAEVVFDENGLIPAIAQDAETGQILMVAWMNREALAETAATGRAVYWSRSRQRLWRKGEESGHAQDVHELRLDCDGDVILLKVHQNGGIACHTGRASCFYRRLEGTASQAEWITIDPVLKDPELIYK

SEQ ID NO: 21396 - protein, 397 aa, Bordetella parapertussis 12822
MTDESRHIDTLLQHLGTAPFDPDTGAAPVNLPSMRASTVRFRDLAALEQAQRRKAGGDRAVTYGRMGMDTHAALEHVFKELEAGTHCYLASSGMGAVTMAFLSLLSAGEHALVADCVYGPVYELDNAVLKRMGIELTFFAPGDDLQALVRPNTRLLYVESPGSLLFQMLDLLALAEFARRNQLVLATDNTWGSGYIYRPLELGAQVSVIAGTKYVGGHSDLMLGAVVTNDEAVAQRLNRTQYAMGYSVSADDAWLALRGVRTLPIRMAQHARHAQRVCEFLQGRPEVARIYHPAWPQDPGHALWLRDCSGSNGMLAVELRLSQPAARVFVESLQLFGIGFSWGGFESLVQLVTPGELARHYYWQGGGNALVRLHIGLESPEDVIADLTQALARAASA

SEQ ID NO: 21397 - protein, 396 aa, Bordetella parapertussis 12822
MEFSQFKVNALMEITACPDLVFVRGQGSWLEDHAGKRYLDFVQGWAVNTLGHCAPEMKRALAEQADKLMNPSPAFYNLPSIELAQRLTSASCFDRVFFANSGAEANEGAIKLARKWGRVNRNGAYKIITMNHGFHGRTLATMSASGKPGWDTMFAPQVEGFPKAEINDLDSVRALIDAQTVAVMLEPVQGEAGVIPATREFMQGLRKLADEHGILFIVDEVQTGMGRTGSLFAYQQFDVIPDIMTLAKGIGGGIPLAALLAREEVCVFAHGDQGGTYNGNPLCAAVGVAVFDTITAPGFMEAAQARTRQLSEGLLALSAKRGLRGERGMGLLRALVLDRDDAPAIVEAARMLAPEGLLLNAPRGNLLRFMPALNVTEADMARMLEQLDGVIAAVRK

SEQ ID NO: 21398 - protein, 490 aa, Bordetella parapertussis 12822
MQDFPNILQRWYSMKQHFIDNASVPGSSGERIPVIDPSTGQEFDSIARGNAADIDLAVQAARRAYEGAWGRLSAAERGRLMLALSLKVLEHRDELTALESRDCGKPLKQARADVLAIARYFEYYGGAADKLHGETIPYQQGYTVLTLREPHGVTGHVVPWNYPLQIFGRSVGAALAAGNACVVKPAEDACLSLLRVAELAAETGFPAGALNIVTGYGHEAGDALTRHPGIDHISFTGSPRVGVLVTQTAAERHVPVTLELGGKSPQIVFADADLDALVPVAVNAIVQNAGQTCSAGSRLLVERGAYERVLERLGAAFAALRAGPAQSDLDCGPLIRKTQQERVRGFLDLARGDGIATVAQGRIVPEAPAEGYYQAPTLLRDVPVDHPLAQEEVFGPVLAAIPFDDEADAVRIANATEYGLAASVWTRDGGRQLRIARKVRSGQVFINNYGAGGGIELPFGGVKASGHGREKGFEALYGFTVLKTISIKHD

SEQ ID NO: 21399 - protein, 339 aa, Bordetella bronchiseptica RB50
MKAFYHPDQKLHHPQTYFSRGKMRTPQEVPARLDALAEAARKLKFDVREPADAGAGAIGAVHSLDYLRFLREAHARWKQLPDDWGDEVVSNVFVREPNALRGVLAQAARYLADGSCPVGPHTWQSAYWAAQCAISGAQTLLDGERHAYALCRPPGHHARRDAAGGFCYLNNAAIAAQMLTQRYKRVAILDTDMHHGQGIQEIFYERSDVLYVSIHGDPENFYPVVAGFENERGAGEGYGYNVNLPMPHGSPEPVFFDHLQQAQRAIELFQPDALVLSLGFDVFEKDPQAMVAVSANGFERLGQAIGAFKLPTLIVQEGGYYIEGLEDNAERFFAGLAKA

SEQ ID NO: 21400 - protein, 420 aa, Bordetella bronchiseptica RB50
MDEIQSIVIVGAGQAGAVAAASLRQLGYRGGLTLIGQEAHPPYERPPLSKAVLQGTATHAEAAVHPAGFYAENDIALLTETAVAALDPIARTVRLADGRTLPYDRCLLATGGHARELPALPRGRAGVHYIRTLNDALDLRAALRPGVRAAVIGGGFLGLEVASTARELGAEVTVIENGSRLLERALPAIVSDWLAERVRASGVDLRLGGAIAAIGDGPPYAITLADGTQVNADLIVVSIGLAPEVTLARQAGLPLDDNGGICVDAQARTADPHVYAAGDCASQPRACLGTAARFESWQNANEQARAAAAAMLGLAPAAEPYPWFWTDQYGCNIQILGLPQPGLRYVCRPQTDPQAAPRVLWIGLRDGVPCHGIAVNAGGDLRQLRVLFERGIPVDPHRLADPAEALKPLVKAWQAAVAVA

SEQ ID NO: 21401 - protein, 234 aa, Bordetella bronchiseptica RB50
MTKIFEDAAAALSGVIKDGQTIAVGGFGLCGIPSTLIEGLRDSGVANLTCISNNAGVDDFGLGLLLQTRQIKRMIASYVGENKEFERQYLNGELELEFNPQGTLVERLRAGGAGIAAFFTRTGVGTVVEENKETRDFGGDTYVMEQALKADVSLVKAQRADTSGNLVFSRTARNFNPEVAMAGGVTIAEVEELVEAGEMDPDAVHLPGIFVDRIIVVPNPEKRIERKSFRTRGQ

SEQ ID NO: 21402 - protein, 383 aa, Bordetella bronchiseptica RB50
MNQEAENTKLFAPLSLRGVVLPNRVLISPMSQYSAVDGVVQDWHRYHVAAMARGYPGSVMLEVAAVTRDGRGTPGDLGIWSDEQIAGLAELARIIEAHGVVPAIQIGHAGRKASMQRPWEGGRPLALDSSDEAWQTVGASALPIQDGWPAPRQLAQHELAGLVDSFRAAAARAVQAGYRFVEVHAAHGYLLHGFLSPISNQREDQYGGSLENRMRFPLEVVAAVRAALPDEVPLSVRISAVDGMEHGWQLADSIVFARELKALGVDLVDCSSGGIQGSATAGKGPQAVKRGPGFQVPFAHAVRQEAGIATIAVGLIVEPAQAEAILRQEQADLIAIGREALQNPNWPLHARQALGADRDYSAWPAQYGWWLQRRPKVAWEEGR

SEQ ID NO: 21403 - protein, 346 aa, Bordetella bronchiseptica RB50
MSASLTADRTPPLTTAALPYPLDPQIQRFVERMQADSAAHPRRDLVPVEQARAISEAVRRPWAEGGPQMARTREIHAPTPHGPVRLRVYTPRAARPGPALLYVHGGGWVLFSLDTHDRLMREYAERAGLTVIGVDYTRAPEARYPRAIEEIVGVIDWLDANGAELEVDRARLCIGGDSAGANLSVAACLTLRERGAAPLAGMVLNYGVYDANLFRDSTVKYGGGEYLLSTQQMVWFYWNYLRAGDDPRDPRISPVHADLRGLPPAFMAITELDLLHDANQDMAARLREAGVDVQAKVYPGTVHSFLEAVSLAQVSVAAFDDTAAWLRAVLRPAAAAAAIHTGEHQP

SEQ ID NO: 21404 - protein, 485 aa, Bordetella bronchiseptica RB50
MTSSPDIGACAYIGGRWAQTPAARTFRTALPHDTRQSGREFGCATPADAEAAVARATAAAAPWAAVPALQRAEPLRKAAALLLERLDELTRLLALEAGKPLQEARGEVSAAAGFLHAYAGWPAWGGQGAVKRNGALRIVQEKFPRGVAAIITPWNYPLSNPCQKIGAALIGGNPVIWRPSVSTPAVSLALIEIMHQAGFPDGVFNALIEDGDAVSRALVASEAVAAVSFTGSTRVGLQVAAAAAGRGAAVQCEMGGKNAAVVMPDADLDLAAERIAFGAFGFAGQKCTAVSRVLVHRHIADAFLERLLDIVRDLRPGLPHQEESCLAPLISARQRDLLVDAIAQARERGARLIEGGAPIEQAPYAHGNYLSPALIQVHDLDDPLWTDEYFGPVLALRVCDDLDQAIAEVNATRYGLGAALFSHDARAIGRFTDQVQAGVVKINDVPPGLYPHVSTGGWKASGLGPNELSEDGVDFFLHKKSVYLA

SEQ ID NO: 21405 - protein, 494 aa, Bordetella bronchiseptica RB50
MTIGARLQHVIDGGPWPSIHCNGRVGSLIGGDIVPGNGAMIEVLDASTGEPLFRYLDGSDGLVRRAAESAAAAQVRWAVMPADGRAAVLLAVSAAIRANLARLAELEAVTAARPIRDCRAQVDRVADMFQYYAGWCDKFYGDVIPVPNQYLNYTMREPIGVLLHIVPWNSPLFMAAWHLAPSLATGNAVLLKPSELTPLSAIALVRIAESAGLPTGLVAVLAGLGHTMGNAAIEHPLVRKIGFVGSPETGAKVAGAAARVVKPCVLELGGKSANIVFPDADLDQLCEATVKSMFIGAGQTCVAPSRLIVHRSLEQQVVERLLDAASTLEMGLPELDSTAIGPIHNRRQFDHVNRMIEQGRRDGARCRQAGNAVPQRGLYVPPTIFTGVARDGALARQEVFGPVMACLPFDTEQEAIDLANDTEFGLAGAVWTHDVKRAHRVAAAINAGTVWINTYKSTDIRSPFGGIGLSGYGRSSGHEALQEYTRLKSIWVAT

SEQ ID NO: 21406 - protein, 428 aa, Bordetella bronchiseptica RB50
MTNDIYDKGLAIRKEVVGVDSVERSLRDATEYTAPFQALATEYCWGRVWGRDELDRRTRSIANIAMMIALNRAPELRIHIKGALTNGVPRKEIAEVILQSAVYCGIPAAGDAFRQMQSVFDEADAAAACAPASPAARKSIAVIGLGAMGYPMAAQLVRAGHDVRPYDANPAVLARFAEEFNTGVAPIASCVAGADFVVTVLPDSTVVTRVLDGDNGSGGVAARIKPGATLIDMTSGDPATTRALAARLGEAGVRMIDAPVSGGFVKARTGELAIMVGGEADTVAAAMDILQAMGTSIAHVGPIGAGHTVKALNNYISAIGWLAVIEAIHTGKRFGLDVATMNRIFNQSSGRNSSTANKVEQAVLSGTYHTGFSLALMAKDVGIAVGLARQMGVDAEVGTLAHRIIQTAFDQSAEKDLDNSRLFDILYS

SEQ ID NO: 21407 - protein, 502 aa, Bordetella bronchiseptica RB50
MITDRLYALAESQPDAIALVFETRQYRYRELADMVSAMAARLHRAGVRPGDHIALMCGNRPAFLACWFALGELGAVCVPLNTGLVGEGFCYSLAKSESRLLIVEPELLAPRRDTLAAMEGAPPVLEIDAAMDLPPAEPPARWAGPPCAAGDLNSILFTSGTTGLPKGVTLPHGAYVAASDDMVQSLALTRADRILVFLPLFHANPQMYAVASVLGCGATLVLLRNFSASRFFDEAVAHGATGFTYVGTVLSILDKHYPEPRRDHALRWCVGGGAPARVWEAVESRFGISVRELYGMTETGGWVSMNTPQRARFGSVGHARAGIELAVVDEAGAPVAIGAKGEIVARSERPHVFFSEYWRNPEATAGTLKQGWLHTGDRGYLDEDGFLYFDGRQKELIRRGGEMIAPTEVEQQLLKHEQVRDCAVVGVPDDIMGEEVHAYVVLQGEPDAGALQAFLKARLPAYMAPRYFSFVPAIPKTETQKIKRHLLADLPAQVVDLAVARR

SEQ ID NO: 21408 - protein, 408 aa, Bordetella bronchiseptica RB50
MDTQTSSPDTKQHYQPFVWEDPFLLHEQLTEDERMIQATAHAYGQEQLLPRIVHAHRTETFDRKIFLELGQLGFLGATLEGYGCAGVNHVSYGLIGREMERVDSAYRSSVSVQSSLVMYPIHTFGSEEQRQTYLPGLASGELVGCFGLTEPDHGSDPGGMATRARGVAGGYRLSGAKSWITNSPIADVFLIWAKDDAGDIRGFILDRGMQGLSTERIDGKFSLRASITGTIAMDEVFVPQDRMLPHVKGLRGPFSCLNKARLGISWGALGAAEACLHQARDYVLARTQFGRPLASNQLVQKKLADMETEIAIGLQASLQVARLMDQGRVSTEAISIIKRNNCGKALEISRVARDMLGANGVSDEYHIIRHMINLEAVNTYEGTHDIHALIVGRAITGIQAFYDSGSTQ

SEQ ID NO: 21409 - protein, 387 aa, Bordetella bronchiseptica RB50
MKPDTRLVHLGRDPERFEGLVNIPPCRTSTFLHASVADYQAAASRKQDSLYYGRFGSQTSRALEAACTELDGGHGAMLFPCGLAAITRVLGSLLEPGQHLLMADTVYGPARAFCEQELARLGVETTWYAPDADLDALVRPATRVIYGEAPGSLTFEMQDLRALAEVARRHGLVSVVDNTWATSWFCQPLALGIDISIQSASKYIVGHSDAMLGVAVANEAQFPALRRAAAQYGNAVSPDDCYMALRGLRTLGVRLERHQASALRVAQWLRTRAEVEQVLHPALPDSPGHALWRRDFSGASGLFGVAFRAGDDAALARFVDDLRLFGIGVSWGGFESLALPSHPVRNTSAAALGGRPLVRLHIGLEDPDDLIADLARALDRHMAAARG

SEQ ID NO: 21410 - protein, 259 aa, Bordetella bronchiseptica RB50
MQHDQAAGAPVVQVEGLRKSFGANAVLKGVDLTIRRGEVVVVMGPSGSGKTTFIRSLNFLEVPDEGAITICGTQVAVQARAGLKREQRRRVREIRQKTAMVFQSFNLFSHMTVIKNIIEGPVQVKGAARDQAIEQARALLRQVGLAEKENEYPSRLSGGQKQRVAIARALAMKPEVIFFDEPTSALDPELRDEVLSVMRKLADEGMTMVVVTHEVRFARDVADRVIFMEGGVVLEDAPSASFFDAPASERIRQFLRRVQ

SEQ ID NO: 21411 - protein, 489 aa, Bordetella bronchiseptica RB50
MRIEHLIDGKAVAGKQYFETINPATQETLAEVAAGGEAEVHAAVAAAKAAFPKWAGLPAAERARLVRKLGDLIAAHVPEISRTETNDCGQTIAQTGKQLVPRAADNFYYFAEMCTRVDGHTYPTPTHLNYTLYHPVGVCALISPWNVPFMTATWKVAPCLAFGNTAVLKMSELSPLTAARLGELALEAGIPPGVLNLVHGYGRDAGEPLVAHPDVRAVSFTGSTATGNRIVQAAGLKKFSMELGGKSPFVIFDDADLDRALDAAIFMIFSNNGQRCTAGSRILVQQSIYADFTQKFVERARRIRVGDPLDEGTIVGPLISPAHLAKVRGYIELGSKEGATMLCGGLDRPSYAPELDARVRDGNFVWPTVFADVDNRMKIAQDEIFGPVACLIPFRDEAHAIELANDIEYGLSSYVWTESVGRAHRVAAAIEAGMCFVNSQNVRDLRQPFGGTKASGTGREGGTWSYEVFCEPKNVAVSLGNHHIPHWGA

SEQ ID NO: 21412 - protein, 320 aa, Bordetella bronchiseptica RB50
MAYDPGIQAYVERARRALGDMAGLKALSLAQRRVRADRYAALVREPYPESLEVSDTYIVQPGHEIPVRVYRPRAEGPLPTIVYLHGGSFVAGSPQGHDFITTSLACNTGAQVLSVHYRRAPENPYPAPTDDAYAALCWAQREAELLGVDPERIAVAGDSAGGNLAAACALMARDRGGPALRMQALIYPTLDADLDTPSYLNNTADAFLTREAMAFAVNAFLPQGLDTRDGYALPLRAADHAGLPPAYLLLADHDPLLDDGTRYAARLREAGNAVQLRIGAGMIHGFLRARRLSATADAEFHLLCAALRQALGLPEPAARW

SEQ ID NO: 21413 - protein, 329 aa, Bordetella bronchiseptica RB50
MPENPFRPNSRARDLAITQHLSREGRKVDKIGFIGLGNMGAHMARRLCEAGYAPAVFDVDASRRAAFEAIGASWADSPQAMADQVSTVVVSLPTPAVVEEVLTGAQGLIHGKAVKFIVDTSTTGPEVSKRAAERLAGRAIQLVDAPVSGGTSGAADGSLSIMVSGAPQAYETVSGILRVIGRNLFYLGEEPGQGQLMKVINNTICAAATLASFEGLVLGSRAGIDARVMLDIINVSSGRNFSTEVKIPQCVVDRNFPLRFTTTLLHKDVKLCLDEAARQGVPMWVSDAARQMLQFAISQGDGPVDYGNVIKRYEAWAGTQFGSEPQPQH

SEQ ID NO: 21414 - protein, 372 aa, Bordetella bronchiseptica RB50
MKARQDCSIELRDLTLAYGERDIIRGLNLDVRRGEILSLLGPSGCGKTTTLHAIAGLIVPRKGSVVIDGVDQTDVPINRRNVGMVFQGYALFPHMTVFDNVSYGLRIKSVAKAEIRERTMRALALVGMEQYAQRKPRQLSGGQQQRVAIARTMVMEPRVLLLDEPLSNLDAKLRHEIRGDLKRILRELSITSVFVTHDQEEAMFLSDRIVLMKDGAIAQLSSPREIYNNPANSFAAAFLGNTNFIAATLLSQTPDHTGCEVSATETGQVLKGRSALRFDAQQPVFLSVKHDRVSYTLSHEEFLALRERPGISTMQCRVADVHFLGHVTKVECQAGGQTMTVLRSSACVPPDLAAGAAIYLYWPEEESLVLSL

SEQ ID NO: 21415 - protein, 348 aa, Bordetella bronchiseptica RB50
MKFVHSETHRRHDPQFFIVRGQITRSTEQPERADRLLAAAQRRGHERVEARDFGEAILAEVHCPRYLDFLKNGYAQWRALPGASQEITPHVHPPREESGYPVSIIGRAGFHIADTSSPMGPHTWEAALAASHSACTAAQLVIEGAPAAYSLSRPPGHHATRDRAGGFCFLNHTAVAAQWLRHHVARVAILDVDVHHGNGTQDIFYERDDVLHVSLHADPAYFYPFFTGYAQETGRGIGAGCNLNLPLPIGTDDEAFLAALRIACRRVLDFKPDVVVVALGLDTYEGDPLNAFRITTPGFARIGQAIAGLALPTVLVQEGGYLSDELGENLATFLDGFCQHHRPTATLR

SEQ ID NO: 21416 - protein, 306 aa, Bordetella bronchiseptica RB50
MSDAAPMRIGFIGLGAMGGPICGHLAAAGHDVAAYDIQPAAVQAAAARGARPAASVREAADGAALLVVMVHNAGQADAVLFGEGGAAAALPAGATVWLASTVAPAYARGLQARLREHGAGLVDGPVSGGATGAQAGALTIIASGQAQALAAAEPAMRACSSIIHRVGEEAGAASTVKLVNQLLTASHIALTAEALALGARAGVDPDVLVKVISQSAGTSRQFEKRAPRMAAGDHAPQSTVDIFLKDLEIALDAARALRFPVPIAASAHQVFSMAAGAGDGPNSDTTVLRVYERNGGVDVAAARKEA

SEQ ID NO: 21417 - protein, 431 aa, Bordetella bronchiseptica RB50
MSEPKQPSWRLETIAVHGGYRPDPTTRAVAVPIYQTVAYAFDDTQHGADLFDLKVPGNIYTRIMNPTTDVLEQRVAALEGGVAALALASGQAAVTYAILTIAEAGDNIVSSSTLYGGTYNLFAHTLPQYGITTRFADPRNLASFEALIDERTKAIFAESVGNPLGNVTDIAALAEIAHRHGVPLIVDNTVPSPYLLRPIEHGADIVVQSLTKYLGGHGTSLGGAIIDSGKFPWAEHKARFKRLNEPDVSYHGVVYTEAFGAAAYIGRARVVPLRNTGAAISPFNAFQILQGIETLALRVDRIVENSVKVAGFLRDHPKVEWVNYAGLPDHADHALVRKYMGGKAPGLFTFGVKGGREAGARFQDALQLFTRLVNIGDAKSLATHPASTTHRQLNPEELEKAGVREETVRLSIGIEHIDDLIADLEQALAQV

SEQ ID NO: 21418 - protein, 493 aa, Bordetella bronchiseptica RB50
MQDSQDNGQSGLAAMWIGGRETLAQDGQTIEIANPATRQPLARVPRGRQAEVDLAVAAASQAYAGWRACSPRERADALLRIADSLAAESEALARLLATETGNALRTAARPEAQGAAGIFRYYAGVAGEAKGETVPGAEGTLAYSVREPLGVVAAIIPWNSPVAAAAVKIASAIAVGNTIVVKTAEDAPLSALKLAALCNAALPAGVVNCLTGYGSECGAALAMHPGVRKISFTGSTETGKAIMRAAADRIVPVSLELGGKSPSIVYPSANCDWAVDGVMTAMRFTRQSQSCTAGSRLFVHRDIYDDFLRKLAGRLDRLVVGDPLDEATDMGALINQRQHAKVNDYIACGLAEPSARLLAGGPSPGEGRLAQGYFALPTLIAGVDNGWRVAREEIFGPVLVAIPWSDERQVLEMANDTHYGLAAYVWTTDLGEAMRGASALDAGWIQVNRGHAPGVGVSFGGVKNSGFGREFSLEGMLDSFTQRKSVTLDFSHA

SEQ ID NO: 21419 - protein, 416 aa, Bordetella bronchiseptica RB50
MQHAPVIQQDAPGLVVVGAGCAGVEAAFAARNAGWQGPITLLGEESAEPYHRPPLSKAFLQGTAGIDSLGLKQAALYERAAIARIGATRVTRIDRAARRLHCADGRTLPYGKLVLACGGRARRLDEALAEGGGHVHYLRTLDDARGLRARLEHSRRVVIVGAGYVGLEVASACRALGLAVTVLEAAPRVLARVTAPVVSAFYEATHRGQGVDLLLDTGVAALEPAGDGGVAAVHTSDGQRIPTDLVIAGIGLAPNVELAREAGLAVGDGIVVDAMLRTEDPDILAIGDCALAYNPRYGRAMRIESVPNALEHARQAAATVCGKPRELDPLPWFWSDQYGLKLKMAGVAHGHDQVVVRGDPRQGAFSVFYLKSGQLLAVDTVNRPGEFMAARKLIFSTIGQADRLADETRELKHWLA

SEQ ID NO: 21420 - protein, 475 aa, Bordetella bronchiseptica RB50
MSTQYRSFVAGQWQDGGEPVALYNPSDLQEEAGVYMHAPVEMVNQAVRAAEEALDAWRGLHAMARSRLLDGIADGLVRRRDELAMAIAREQGKPLRDALAEATRAADIFRYFASETIRQKGYTYASIRPGVRVEVQRNPVGVVALVTPWNFPVVIPAWKAAAALAYGNTVVMKPSEIAPCGAWILADVMREAGLPAGVFNLVLGAGQAGAALVAHEAVAAVSFTGSVATGKRIAAAAAGKRIQLEMGGKNPLIVLDDADLDTAVACAIDGAFLYAGQRCTASSRIIVTEGIHAAFVKRLLAQTASLAVGHALDEATVIGPVVNAEQFEKNRRYADLARQEGGTVAGGRALSRPTRGHYFEPCLVTGLDNSATVCREEVFGPFACVLTARDYEHALAIANDTPFGLSSGLCTTSMKHAQHFKAHTKSGLASINTSTSGVDFHVPFGGNGASSYGPREQGEFAIEFFTTLRTVYIGD

SEQ ID NO: 21421 - protein, 209 aa, Bordetella bronchiseptica RB50
MSVSPARDLSTTLLADAGARVMSAGIKPLRAGWHVHGRALTVSVDAGDNLAIHAALAQARPGEVLVIDAQGYLDRAVMGGIMCAQAAAVGLAGVIIDGAMRDLAELRAGTLPAYALGGSPAGPTKRGGGTVRRAIRCGGVDVRPGDWIMADDDGVVVYRDDEAEAVLAATLAKQQAEAARMAAIARGELRPAWLDDALARAPIDTGKSA

SEQ ID NO: 21422 - protein, 397 aa, Bordetella bronchiseptica RB50
MSNVNTLSALAKSGALSGKRVFIRADLNVPFDDAGRISEDTRIRASVPGIRLALDAGAAVMVTSHLGRPKEGALTEADSLAPVAQRLSELLGMQVRLVPDWVDGVSVEPGEVVLLENCRGNVGEKKDDEGLSRKMAALCDVYVNDAFGTAHRAEATTHGIARFAPVACAGPLLEAELEALGRALHDPKRSLVAIVGGSKVSTKLSILQSLADKVDQLVVGGGIANTFMLAAGLPIGKSLAEPEQVEQARAVIEIMKRRGAEVPIPTDVVCAKSFGADAAATVKAAADVAEDDMILDIGPQTAQRLADILKAAGTIVWNGPVGVFEFDQFAHGTEVVARAIADSAGFSIAGGGDTLAAIAKYGIADQTGYISTGGGAFLEFLEGKALPAVAVLQARAA

SEQ ID NO: 21423 - protein, 418 aa, Bordetella bronchiseptica RB50
MPRPHIHDPDLSFSYLHWSTRMSSTPSFHWQDPLLLDQQLTEEERMVRDAAVAYSQDKLAPRVLEAFRHEKTDPAIFAEMGELGLLGATIPTEYGGAGLNYVCYGLIAREVERVDSGYRSMMSVQSSLVMVPINEFGSEAQKRKYLPKLAAGEWIGCFGLTEPNHGSDPGGMETRATKTPDGYKLTGNKMWITNSPIADVFVVWAKCVGGDFDGKIRGFILEKGMKGLSAPAIHGKVGLRASITGEIVMDEVEVSEEQMMPGVSGLKGPFTCLNSARYGIAWGALGAAEACWHTARQYTMDRKQFGRPLAANQLIQKKLADMQTEITLGLQGCLRLGRMKDEGTAAVEITSIMKRNSCGKALDIARLARDMLGGNGISDEFGVARHLVNLEVVNTYEGTHDVHALILGRAQTGLQAFY

SEQ ID NO: 21424 - protein, 408 aa, Bordetella bronchiseptica RB50
MTDTTSPRRLQTRLLHAGKKPAYDGGAPVNPPVVRASTVIFDNVAQQRDLRARRSGERLFTYGARGNPTNFALEDAVSELEGAYRTKLFPTGLAAIAMALLSYLKPGDHLLMSDAVYEPARKLVHSFLAPYQIRCTFFAADGSDVQDKLEPATRMIYAECPGSLVYEMCDLPRLAEIAHRHGALLACDNTWGSGCQYRPLALGADVSIMAATKYLSGHSDVMMGTVATTEAAWPALSERSDAFGMTVSPDDAYLVLRGIRSLAARLAMHERHALRIAGYLQERPEVRTVFCPALPGHPGHDIWRRDCTGTNGLLSFELQAGFDRAAAEQWIDSLALFGLGASWGGYESLVTLADLGAARSVADWSGRGVVVRLHIGLEDPQDLIADLDQAFAAIGPAGRHNTVSRSEA

SEQ ID NO: 21425 - protein, 410 aa, Bordetella bronchiseptica RB50
MEQQHTIVIIGAGQAGGWAARTLRAEGYAGRVLLCGDETAPPYERPPLSKEQLAAQAPALPSLMDAAQLAELHIDWLGGAAATRIDRAGRRVLLGDGQALRYDALILCTGGRPRLPPLPGADLPCVHTLRTIDDAARLRAAFDGAPRVAVLGGGWIGLEVAAAARQRGCAVVLLEAADRLCARSGPGLLSETLARLHAGQGVDLRLNARVQRIDAHGRGCRLALADGQGIEADIVVAGVGLVRNDELARQAGLACDHGVIVDGACRTSDPDIYAAGDVAVMARPDGKLAGLESWQNAQDQGIAAARAALGQAVRYAPLPFFWSQQYDTLVQMAGASEPGAALVLRQGGPAQLLCVEMRADGRAAAVLGVNAAREFRQLRKYIAEGARLDARRLADPRSPLAGAVLGEAAA

SEQ ID NO: 21426 - protein, 354 aa, Bordetella bronchiseptica RB50
MTSLWDPIQIGRMNLAHRLAMSPLTRSRAQDDGTPGELAAEYYAQRASLGLLISEGTQPSADGQGFLNSPGIYSEAHVAGWRKVADAVHAAGGHLYIQVMHAGRMSHPANTPHGRQAVAPSAIAPEAQIHTPTGMQQVPAPRALSPDEIQATVRDYRHAAARAIEAGADGVEIHGANGYLIQQFLSPNANHRDDAYGGPVAHRTRFALEVAAAVAEEIGADRTGIRLSPGSRLGGIDEGPHYGDMYRHLVAGLAQLKLSYLHIAHNGDEALLKDLRQLWRGPLLVNRVNRPIELIGQDVETGLADIAPVGRWALANPDFVARLRAGQPLNPPDQATFYGGGARGYTDYPRLAMR

SEQ ID NO: 21427 - protein, 342 aa, Bordetella bronchiseptica RB50
MNLLSPIDIAGIALRNRIAVAPMSRTQADAHGHPAAETAAYYARYARHGAGLVITEALYTAGPAARAYFNQPGLASEAQAEHWRATVRAVHQEGGRVIAQLQHAGKLAEPGLHARPLGPVDGAAQGLSWQTQQPNAPAHAATAEEIERIIEGFALSARLAHYAGFDGVEIHGARGYLVNDFLSAYNVRDDEWGADRARIAEAVLRAVRQSCPLPIGFNYSIYKMDEYRYQPPGGGAEIAALLARLCQAGADILHISSRRVLKPEPWGGLLAQLARAAAPKALMVNGGLATLQDCETALAATQADLVSLARPFLANPDWLARSLAGEPLRAYEPGMEQRPLLD

SEQ ID NO: 21428 - protein, 489 aa, Bordetella bronchiseptica RB50
MTQLTQPLSRAELLRDACYIDGKWVGAGNGPSIPVDNPSTGKTIISVPKLGRKEAEQAIDAAEAALPAWSARTGKERAAILLKWAQLMMENQQDLAVIMTSEQGKPVAEAAGEIAYAASFLEWFAEEAKRIDGDILQSPKGGQRLMVLKQPIGVTAAITPWNFPAAMITRKVGPALAAGCTMVVKPAQQTPLTALALAVLAEQAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGQPHALGGSFFQPTVVRDVTQSMRFAVEETFGPVAPLFKFESEDEVIGMANNTIFGLAAYFYTRDYARIWRVSEALEYGIVGINTGIISNEVGPFGGVKQSGLGREGSKYGIEDYLELKYLCVDLGA

SEQ ID NO: 21429 - protein, 421 aa, Bordetella bronchiseptica RB50
MKNRDLNTRRTLATPRGVGVMCDFYAVRAENSTLWDAEGKEYIDFAGGIAVLNTGHRHPKVKAAIAAQLDNFTHTAYQIVPYEGYVSLAERINAVAPIEGLKKTAFFTTGVEAVENAVKIARAYTGRSGVVAFSGAFHGRTMMGMALTGKVAPYKLAFGPMPGDVFHVPFPNATQAISVADSLKALDLLFKVDIDPKRVAAIIIEPVQGEGGFNVTPPELMQALRKVCDEHGILLIADEVQTGFARTGKLFAMQHHSVQADLITMAKSLGGGMPISGVVGRAEVMDGPAAGGLGGTYAGNPLAVAAAHAVLDVIAEEKLCERAAELGKRLMDRLEGLRAKCPAIADVRGLGSMVALELNDPATGKPDAEAVKRIQQQAIERGLILLSCGVYGNVLRFLYPLTIPDDQFARALDILAETIAA

SEQ ID NO: 21430 - protein, 456 aa, Bordetella bronchiseptica RB50
MTTLSSAQQQDIQYQLHSYTNAVKHRDVGPRIITHGEGVYVFDDQGNRYLEGMAGLWSVAVGFGEQRLVEAAARQFQELPYYHTFTHKSHPSVIALAERLIGYTDGRMAQAFFTNSGSEANDTVVKLVWYYNNALGRRDKKKIIARQRGYHGVTVASASLTGLPGNHKDFDLPLPQIRHTACPHYYRYGLPGETEEDFATRMAGELEAMILREGPDTVAAFIGEPVMGAGGVIVPPRTYWQKIQAVCRKYDILVIADEVITGFGRLGQRFGSQVFDIEPDIMVLSKQITSSYQPLGAVLLNARVADVVAEHSGRLGTFGHGYTASGHPVATAVALENLRLIDERGLIEHAAEMGALLHLELQALSSHPLVGEVRGVGLIAGVELVADKATRQPFDPLGKAGGYAYERAHDHGLIVRGIQDTVAFCPPLIITAEQVRDMVARFARTLDDVAAHVAQG

SEQ ID NO: 21431 - protein, 354 aa, Bordetella bronchiseptica RB50
MKAFFSEEQLLHVPEQFMRLGRISAPTDVPARAETLRAMLASRGVTVDSPPDYGREPLEGIHSHEYLDYLEHAYTRWQAMRANGADPGPEVLPNLSPYYNGRVEHAARGPCPSTSIVAETGYYLSDLSCPVGPHTWRSALRSTHCAVAAADWALQNQALAYALCRPSGHHAHRDRAGGFCYLNSSAAAAQRLAQRCERVVVLDVDAHHGDGTQNIFYQRSDVMTISLHADPSGYYPFYTGYAHERGYGSGHGYNLNFPLPHGARNAIFLETLDSALTALRDYRPRALVLALGFDTYKDDPISVLKLDMDAYRQIGERINGLGLPTVVVQEGGYMVPAIGPALEAFLQGMAPATV

SEQ ID NO: 21432 - protein, 435 aa, Bordetella bronchiseptica RB50
MPGGRACARLQGFVALQSCGAPAARGLFPPLFLSPFRIPIMRKFSRIERLPPYVFNITGELKMAARRRGEDIIDMSMGNPDGATPQHIVDKLVEASTRPDTHGYSVSKGIPRLRKAICDWYMRRYAVEFDPDSEAIVTIGSKEGLAHLMLATLDRGDTVLVPNPSYPIHIYGAVIAGANIRSVRMTPGIDFFEELERAVRESIPKPKMMILGFPSNPTAQCVDLSFFERVVALAKEHDILVVHDLAYADVCFDGYVAPSIMQVPGARDVAVEFFTMSKSYNMAGWRIGYMVGNRELVGALARIKSYHDYGTFTPIQVASIAALDGPQDCVNEIVAQYQRRRDVLARGLHEAGWNVEIPKASMYIWAQIPEPYRAMGSLEFAKRVLSDAKVAVSPGIGFGEYGDEYVRFALIENEQRTRQAVRGIKDMFRKDGLLK

SEQ ID NO: 21433 - protein, 414 aa, Bordetella bronchiseptica RB50
MHQNGFTTTIVHSDRDQSAEHGAVHKPMHPSSEYVYEDARELAAVFQGKAGFTYARQGTPTTTALEARITRMEAGKSTVSFATGMAALAAIFTTLLRRGDHLVSSQYVFGNTNSLLNTLMELGVEVTMVDATDVRQVRDALRPNTRMVFTETIANPGTQVADLAGMGALCRERGLVYVVDNTLTSPWMFRPVEVGASLVMNSLSKYIAGHGHALGGAVTDTGLYDWSGYANIYESYRKGAPTGWGLTQIKKKGLRDMGGTLAAEPAHRIAIGTETLALRMARHCSNALALATFLQGHPGVARVHYPGLSSHAQHQRASELFDGRYGGLLGVELAEGIDCFDFLNRLRIVLMATHLGDTRSLALPAAHTIYYEMGAEKRAQMGIADSLIRVSVGIEDEADLLFDFDQALRGCLQS

SEQ ID NO: 21434 - protein, 393 aa, Bordetella bronchiseptica RB50
MSSALANIYARLPVSFTHGRGVWLWDTGERRYLDALAGIGVSCLGHGHPGLVAAISEQAARLIHTSNIYEVPQQAALARRLAELSGMSEVLFSNSGSEANEAAIKLARYYGYKQGNTHAHIITMDSSWHGRTLATLAATGSDKARQGFGPMPSGFIQVPYNDLPAIRAAGEAEPRVTAVLLEVLQGEGGIRPSDMAFLRGVRQLCTERGWLLMIDEVQSGIGRTGKWFAHQWADIRPDVMTLAKGLAGGVPIGAMLAAGPAAGVFAPGSHGTTFGGGPLACAAGLAVIDAIEQEGLLANAHEVGAHLHAALASELAGVPGIIEVRGRGLMLGIELDRPCGILATRAMEAGLLINVTRERVVRLLPPLILSGEEADQIVRILVPLIKQFLAQQQ

SEQ ID NO: 21435 - protein, 218 aa, Bordetella bronchiseptica RB50
MRLILLGPPGAGKGTQAAFLTQHYGIPQISTGDMLRAAVKAGTPLGLEAKKVMDAGGLVSDDLIIGLVRDRLTQPDCANGYLFDGFPRTIPQADALKSAGIALDYVVEIEVPESDIIERMSGRRVHPASGRSYHVRFNPPKAEGVDDVTGEPLVQRDDDREETVRHRLNVYQNQTRPLVDYYSSWAQSDAAAAPKYRKISGVGSVDEIKSRLSQALQS

SEQ ID NO: 21436 - protein, 1273 aa, Bordetella bronchiseptica RB50
MASTTLGVKVDDALRDRLKAAAQKLNCTPHWLHKQAILSYLDRIERGHLPAEMAHLGRDERGEDEDAGASADAMPPFFEFGQDVQPQSVLRAAITAAYRRPEPECVPLLLGQARVAGPEKVHAMASKLVHALRAKRSGGGVEGLIQEFSLSSQEGVALMCLAEALLRIPDRATRDALIRDKIAHGDWRSHMGGSQSLFVNAATWGLMITGKLVAVSSEQSLSKALTRLIGKGGEPLVRKGVNMAMRMMGEQFVSGQTISEALANNRKMEARGFRYSYDMLGEAATTAADAERYYAAYEQAIHAIGKAAAGRGIYEGPGISIKLSALHPRYARAQRDRVMAELLPRVKALTLLARQYDIGLNIDAEEADRLEISLDLLEALCFVPELDGWNGIGFVIQAYQKRAPFVIDYVIDLAKRSRHRLMVRLVKGAYWDTEIKRAQVDGLEGYPVYTRKVYTDVAYLACARRLLAAPEATYPQFATHNAYTLSAIYQMAGQNYYPGQYEFQCLHGMGEPLYEEVVGPLAQGKLNRPCRIYAPVGTHETLLAYLVRRLLENGANTSFVNLIGDDSITVEQLVADPVEAASRIVPLGAPHEKIPLPRELYGSVQQGARANSAGLDLTNEHRLGSLSAALLASAAIDWRAWPMLGEGDPGWDPAGAVEVANPANLRDIVGHVMQATPQHVEQALRDAANAAPIWQSTPVPERAQCLRRAAQLLEEQMQTLLGLIVREAGKSLPNAIAEVREAVDFLRYYADQAEREFDNDTHRPLGQVLCISPWNFPLAIFTGQVAAALAAGNTVLAKPAEQTSLIAGQAVAILRAAGVPAGAVQLLPGRGETVGAQLVASPQVRGVMFTGSTEVARIIAGALAERLDDQGHTIPLIAETGGQNAMVIDSSALAEQVVFDVLTSAFDSAGQRCSALRVLCLQEDSADHVLAMLRGAMRELRVGNPDRLSVDVGPVIDAEARNGIQGHIEAMRSSGRPVDQVELAGECRYGTFVPPTLIEIDHIGELTREVFGPVLHVLRYRRDDLDGLIEQINATGYGLTFGVHTRIDETIARVTEQVHAGNLYVNRNIVGAVVGVQPFGGEGLSGTGPKAGGPLYMYRLLATRPAGLPPALDPAAPMPQALALPGPTGETNTYRVEPRGAVYCVAATEAGARAQWAVVSQTGNHAWFADTPAARAWIAGLDARLREQAALLEDSELDEADFQAVLFEGDGDALRALNMRIAQRPGPLVSVHGLSADALAAGASYAPDRLLAERSISVNTAAAGGNASLMTIG

SEQ ID NO: 21437 - protein, 354 aa, Bordetella bronchiseptica RB50
MKAIRIQGLTKHYGAHQVLRGIDLELAQGELLALLGPSGCGKSTTLQMLAGFDQPTDGQIWIGDRQVSGAGVMVPPERRNISLVFQNYAVWPHMTVFENVAYGLQVRKVARTELAQRVKRALDTVRLTALAQRYPSELSGGQQQRVALARALVVEPDILLLDEPLSNLDAHLREEMRYEIRQVHDLLGLTTVYVTHDQGEALVTADKIAVMQSGQVQQFDSPVNVFSRPANAFVASFIGTNNELHGQLAEPGALRVGDRVLHGDDRSQAGAGGAACLCIRPSAVKLGAAPGANTLSGTVTRVAYLGEYRDVQVELAAGQFVRAYVDPSSTLEPGQRVEVHLPIEHCQILSVTTS

SEQ ID NO: 21438 - protein, 507 aa, Bordetella bronchiseptica RB50
MPGRGCVPRFFSSDSIDMTISPLQLLNDPSLLRTDALVDGRWIAASRRFAVHDPATGRKLADVANLDAAHAREAIAAAQAAWPAWRARTVKERSAILRKWFDLLLANQDDLARLLTAEQGKPFGEARGEIAYAASFVEWFAEEAKRINGETLPAFDNNRRLLVLRESIGVCAAITPWNFPLAMITRKVAPALAAGCPVIVKPAEHTPLTALAAAQLAVRAGVPAGVLGVLPADGANSIAIGKELCANDAVRHLSFTGSTEVGRILMAQSAATVKKLSLELGGNAPFIVFDDADLDSAVEGAMQSKYRNAGQTCVCANRIYVQDGVYDAFVEKLADAVRALKVGPGFDEGVTQGPLIEPEAVDKIERHIEDAVSKGGRVVAGGRRLGGLFFEPTVLVDATSQMLCAREETFGPLAPVFRFHADEDAIAAANATEFGLASYLYSRDVGRIFRAAEALESGMVGVNVGILATEHVPFGGVKQSGLGREGGRHGIDDYVEIKYMCVGDILK

SEQ ID NO: 21439 - protein, 509 aa, Bordetella bronchiseptica RB50
MDLSDLKKLGLDVAYPFKEQYENYIGGQWVPPVGAEYFDNLSPITGQPFCRVPRSGAADIELALDAAHRARAAWARTSPAERANILLRIADRIEGQLPMLAVAESIDNGKPLRETTAADLPLAIDHFRYFAGCIRAQEGAISEIDANTVAYHFHEPIGVVGQIIPWNFPLLMAAWKLAPALAAGCVVVLKPAEQTPASILVLAELIGDLLPPGVLNVVNGYGKEAGQALATSKRIAKIAFTGSTPVGKHILHAAADNLIPATVELGGKSPNIFFDDVMDHDDEFLDKALEGLAMFALNQGEVCTCPSRILIQESIYERFIEKAIARVQSIKTGHPLDAGTMVGAQVSQVQMDKILSYIDIGRQEGAQCLTGGARNDMLPGGLDQGFYVQPTMLLGKNSMRIFQEEIFGPVAAVATFKDEEEAIAMANDTFYGLGAGVWSRDGARAYRVGRGIEAGRVWTNCYHLYPAHAAFGGYKQSGIGRETHKAALSNYQQTKCLLVSYSAKALGFF

SEQ ID NO: 21440 - protein, 450 aa, Bordetella bronchiseptica RB50
MAFDFDLYVIGAGSGGVRAARFAAGYGARVAVAESRYLGGTCVNVGCVPKKLLVYGAHFHEDFEQAAGFGWNPGRPEFDWPTLIANKNREIERLNGIYRNLLVNSGVALHEGHARIVDPHTVEINGQRHSAQHILVATGGWPFVPDIPGKEHAITSNDAFFLPELPRRVLVVGGGYIAVEFASIFNGLGAQTVQVYRRELFLRGFDGSVREHLRDELVKKGLDLRFNTDVERIDKRADGVLAVTLSDGSVLETDCVFYATGRRAMLDDLGLENTGVRLAESGYIEVDDEYRTSEPSILAIGDVIGRVPLTPVALAEGMAVARRLFRPQEYRKVDYDLIPTAVFSLPNIGTVGLTTEQALERGFRVTRYESRFRPMKLTLTQSQEKTLMKLVVDADSQKVLGCHMVGPDAGEIVQGLAVALKAGATKQVFDDTIGIHPTAAEEFVTMRTAT

SEQ ID NO: 21441 - protein, 460 aa, Bordetella bronchiseptica RB50
MPRSTARAAWKRELAATLALGLPLVLTNLAQMAMTVTDVIFIGRLGSQALAASALGANLFTAIEFFGLGLVAATAPMVAHALGRRGNAVRDVRRTVRQGLWTAVIYSVPGCLLLWHGEAILLAIDQPPELAAQAGAYLRALMWAMPPFLGFLVLRSFVAALQRPRSAFLIALAAIVLNVFGNWVLVFGNLGAPALGLVGAGLASALATLGLFLGMVGVVCLDRRFRRYHLFGDVWQPDWQRLAEFWKLGLPIGAATAFEVTIFNAAAFLMGWLGEPELAAHAIAIQIASVTFMIPYGIAQAATVRVGHAYGARQPDQVARAGWCAFSLGIGSMAIAAALMLLAPGLLVSAFLDIGDPANAQVLRLATAYLAVAALFQIVDGAQVLGAGMLRGLHDTRVPMLYAALGYWGVGLPSGAALAFWAGWRGVGVWSGLAIGLALVAVLMMQRWLRRDRVGLLRRA

SEQ ID NO: 21442 - protein, 298 aa, Bordetella bronchiseptica RB50
MSATLAFCGAGLMGAPMIRRLLAAGHRVRVWNRSAAKAQALAADGAVVCATPAEAAAGAQAVLLCLTDLAAVQATVFGPHGVADVAGGLLVDHSSIEPDATRALAARLLAASGRVWIDAPVSGGVAGAQAGTLSILAGGPAAAIEAAQPWLRAYAGRVTRLGDTGAGQIGKLCNQTIVATTVNAIAEAVALARRNGIDAAALDTALAGGWADSVLLRIFVPRMTAPVDQPLGALQTMLKDLENVAALAAASGTQLRGLQGVLDSYRTAAARGLGPGDLSDIVRVAWPERPAAPAREPA

SEQ ID NO: 21443 - protein, 273 aa, Bordetella bronchiseptica RB50
MSATPASDVRIRFEDVCVDYPTADGPMRVLDGINYEIRQGEFVSVIGPSGCGKTTMMGLVGGFVQPTAGRVLLDGQPVGGPGPDRGVIFQEYGVFPWLTVRENIAFGLNLRSNRVAAGERAQICQRYMTLMGLGDFAHHYPKHLSGGMRQRLALARAYAVKPQFLLMDEPFGALDAQTRSAMQDLLLQVQMTEGKTVMLITHSVEEAIYLSSRIVVVTARPARIRTIIDVPFGYPRAENLHEDPRFGELRSHIRALVMEEYAKQARQTVRLSD

SEQ ID NO: 21444 - protein, 498 aa, Bordetella bronchiseptica RB50
MTLHDSAYWRAQAAALAPEGRAYIDGAYCDAADGATFAAHSPIDGRKLADVAACGAADVDRAVAAARRAFEAGVWSGLAPRERKHRLLRLAALITKHQEELALLETLDMGKPIRDALAFDLPETARCYAWYGEAIDKRYDEIAPTGADALATITREPLGVVAAVVPWNYPLMMAAWKVAPALAVGNSVILKPAEQASLSALRLAALAEQAGIPPGVFSVVPGLGAQAGQALGLHPDVDCIAFTGSTATGKRFMTYSGQSNLKRVWLECGGKSPHIVFADCPDLDRAAQVAALAIFSNQGEVCIAGSRLYVQHGIYDAFMEKVAAFAATLRPGNPLDPDSALGAMVDERQTQAVMARIAAGAQEGARLRLGGRQVLTNSGGYYIEPTIFDCPGQDNSLVREEIFGPVLAAQGFADEDEAVALANDSIYGLGAGLWTADLGRAHRLSRRLRAGLVWVNCYADGDITVPFGGVKQSGFGRDKSLHAMDKYSDLKTTWISLR

SEQ ID NO: 21445 - protein, 305 aa, Bordetella bronchiseptica RB50
MMQTLGFVGLGMMGLPMLENLAGDERWQILAYDRSPAPFERLAGHPAWGKRLRAAAGLHELAACDAVITMLPNSAITNAVVLGGDGQPGLIDLLESGAAIVDMGSSNPADTRRLSEQLAARGLTLIDAPVSGAVAKASTGTLAIMAGAAEADLRRVRPILERMGAAIIHTGAVGSAHAMKALNNYVYAAGLLAVSEAMVIARRMELDLEVFTDVLNASSGRNVASETKLRQFIIPGTYNGGFALALMAKDLGTAQSLQALTGVQADQLALCAELWRQALAQLPGGADNTEIHRFLAQRTPATEPA

SEQ ID NO: 21446 - protein, 510 aa, Bordetella bronchiseptica RB50
MAFETLIEELAQREARARAMGGEEKLARRRAEGVLNARERIDRLVDADSFLESGLLAVSVRSEVRDRTPADGKIAGYAQVDGRDIALVANDFTVMGASSSSVNTSKIGHMVKNATRRGLPMVFLGESTGARMPDTMGARGIGSGDRPTQYRRTRETPWASAVLGHCYGSSSWYAVLADFAVMRKGAIMAVSSVKLTSMAITEAVDPEELGGWEMLTSGSGLVDMAVDSDEEALDAVRRFLSYLPSHHMEAPPVRPVPAGSGEQGHRILDILPESRTKVYDVRKILSLIVDNDSLFELKARYGRSVVTALARIDGHTVGIIASNPQAKGGAIDVDACNKATSFMVLCDSYNIPLVFMADQPGFLIGVEGERRGAVGRVMNWMNALSLVSVPKISIIMRKTYGQAVLNMGGAGNADEVIAWATAEVNFMDPRSGVTIVHGLTAQSDPDAYAARLAEMERDTSAWEMGGAYSAHHVINPADTRDTLIRLLRVHRLRLTNGVGEHLMRTWPTSY

SEQ ID NO: 21447 - protein, 362 aa, Bordetella bronchiseptica RB50
MEGHSPQRGSRILEISGVTKTFGPTTALAGIDLDVREGEFLTLLGPSGCGKTTLIRIIAGFETPTAGDVRIDGRSIVAAPPYRRPLGMVFQSLALFPHLNVAENIGYGLKIRRVPPARRQAKVAQALEMVGLAGYGERYIGQISGGQKQRVALARAIVTEPRVLLLDEPLGALDMKIRRQMQTELKQIQESLGTTFIFVTHDQEEALTMSDRIAVFRNGAIEQVDTPAAVYERPATRFVAEFVGDTNFLEGTVDRQAGGAPRVRLADWDCSLQPPAAQWAEGARVGVSLRPQHLRIAALEQGRLRATVLRRVYAGQNTRLWLAVGQRKLLADWHGAEDGAPPEPGATVGLTWDDRRVCVVSL

SEQ ID NO: 21448 - protein, 1025 aa, Bordetella bronchiseptica RB50
MKPIFRIEHPFGSLPARAARGGLLLAGALACCAAAHAELLGVDGGGPSGGAGASGPGLAGQPGSGPAPGLGGDRTTPVPGGNGGAGGGAGAAGGSGESTHYGGGGGGSDSGGGGGALVYEMAGGAAGGNGGGVAQALSVGADLQSSRGGAGDDGGAPSYGTEPGGGGGGGGSGAAVLAGGGYRALGAAIVGGRGGAGGAGFESGGGGGGGHGIRVDAADVRIDLFATQVAGGQGGDGGAGSGGSGGGGDGGHGLAGAANDLRLRVGADSSLRGGDGGATWPVTHRAGAGGAGGAGLFVSASRWQVETAGLIQGGNGARGEASRELDGGDGGAGGAGIALAGDTGRLVNRGEIRGGSGATGGTSERAAPGAAGAGGAGVRIAGNGNRLVNAGRIAGGLSADGQQADAVRIDGAGNTFELRAGSVLQGNAVATGGANVLALGGAQPGVFDVSALVAGAPAAWSGVARYGGFTAYEKTGTGSWRLTGGNAAALSWTVRAGRLAVDAEMAGSAMTVAAGGTLGGTGTVGDTTVRAGGALAPGNSIGTLRVAGDLVFEPGSRFEVEADPAGTASDRVTVSGTADIRGGTVLHVGPEGGFEARQRYVILTAGRRLGQFDAVGSGYAYLAPALSYDATSVALTLQRRGAAGSGELAFADLADTANQRATARAAETLPAAHPVYRAIETLPEGAPPAAFDALSGEVHASTRSALLTGARQAQQVNLGRLRDHLGLAWQAGAPMAASGSAPGAAALPGALSPAWAEVVGAWQRLDGDGNAAQVRQHVGGLFVGADTALANGWRVGGSLGFTDGRIEVDARASQTDVASYTAALYGGRAWDTGAGRLNLLAGAAYTWHDIASERRVDVGDLRQELTADYGASTTQLFTELSYAMPLGMTAELEPFAGLAWNQLRVRGFTETGGSAALSGASSRDDMATTTLGARVAVPLGAGATLRAMAGWRHAFGDRTPQSTLAFGQGSAFEVAGAPIARDAALLGVGAGIEVAHNAFLDVAYAGEFGGGNRQHTANAVLRWRF

SEQ ID NO: 21449 - protein, 365 aa, Bordetella bronchiseptica RB50
MTMASIFSPYELGELILPNRVVMAPMTRARTLDTVPAQSMALYYAQRASAGLIVTESAQVSAQGRGYLCTPGIHTPEQVAAWRNVTDAVHRAGGRIFIQLWHVGRLSHTSLLPDGGSPVGPVSVAAAHTLVQAYGHDGRPAQVPASPPAALDIAGIRRIVADFRAAAENAARAGFDGVEIHAGNGFLFEQFINAGLNTREDQYGGPSIANRLRLLLETVDAVSAVIGRQRVGVRISPFAHAGDLHEFDSEKASWLGLAGALCQRRIAYLHASHLGQAGFQRDMRKAFGGTFMLAGGFTAQTAQAALDAGEADLVVFGRPFIANPDLVERMRHGWPLAEAGKHAFYGGDDRGYTDYPRYAAAQPAA

SEQ ID NO: 21450 - protein, 250 aa, Bordetella bronchiseptica RB50
MIDARGIVKAFHGLRVLDGVSLTLRKGEVVAVIGPSGSGKSTFLRCLNHLEIIDEGSIEVEGEALARAVPGGKSQYAADADVRRLCRKMGMVFQSFNLFPHMTVLQNVIEAPVTVKGLRRDAVIPKAEELLRKVGLLAKRDNYPGRLSGGQKQRVAIARALAMEPDIMLFDEPTSALDPELTGEVLRTMRQLADEHMTMLVVTHEMGFAREAAHRVVFMDEGRILEEAASDRFFDAPQHPRTREFLAHML

SEQ ID NO: 21451 - protein, 1113 aa, Bordetella bronchiseptica RB50
MPATHPAPDPLWYKDAVIYQLHVKSFFDANDDGVGDFAGLLAKLDYIVELGVNTIWLLPFYPSPRRDDGYDIADYRGVHPDYGSLADARRLVRAAHARGLRVITELVINHTSDQHPWFQRARAARPGSAHRAYYVWSDDDKAYAGTRIIFCDTEKSNWTWDPVAGAYFWHRFYSHQPDLNYDNPQVLREVLGAMRYWLDMGVDGLRLDAVPYLVEREGTNNENLPETHAILRRIRRVIDSEYPGRMLLAEANQWPEDAQEYFGAGDECHMAFHFPLMPRMYMAIAQEDRLPVTDIIRQTPSIAPQCQWAIFLRNHDELTLEMVTSRERDYLWNVYAAEPRARINLGIRRRLAPLLERDRRRIELMNSLLLSMPGTPVLYYGDELGMGDNIHLGDRDGVRTPMQWSPDRNGGFSRADPERLPLPLLMGPLYGYEAVNVEAQQRDPHSLLNWTRRMLAKRRQSHVFGRGELSFLYPGNRKILAYLRTWEDTVVLCVANLSQAAQPVELHLSEYAGRVPVEMLGGTAFPQIGELPYLLTLPPFGFYWLDLSAGAAPPAWHSELPPQMPESITLVSRGAGAALRLTEASRRQLEADVLPAYLQRQRWYAARRKPGVMRLAYSVPLNDDVESYYEAEIEVSDDGPPRRFHTPVALAWQDDTAAQYPLARVRRGAQLGTLTDASLQPGYARVLLAALTAGRDIQAGGEPAVRLRFLPEPGLADLALRDDSEVRALSADQSNSSLLVGERVVFKLLRELHAGPHPEAEMTRYLTQAGYAHTPALLGEVVRVQGDQAPHTLALAHAYVVNEGDAWNWTVAYLKRTVDAAMLTGASADDYQQELAGYEVLAGTIGQRLAQMHSVLARAGELPGFAPRPASERDAALAGEHAVAQLDRALQALRACESGLAPASHACAQWLFEHRDRLAAHIMTLAQAETGALRIRVHGDFHLGQILVAQTDAYLIDFEGEPARPMAERRQLSSPFKDVAGILRSFDYAVAELSRDDPLGGAPRDFNTGVAEPADPASAPRETREALLARFRQRAGAALLASYGNAIDPVLALPPERAQALTCLYLLEKAAYEICYESAYRPERLPVPIHGLAETARAALLAAAVDHDEGPAP

SEQ ID NO: 21452 - protein, 166 aa, Bordetella bronchiseptica RB50
MNTMYDFSAPTITGAERALADFRGQVALVVNVASRCGFTPQYSGLEELYRSYRNEGFVVLGFPCNQFGRQEPDDEAAIAQFCETQYAISFPLFAKIDVNGAHAHPLYRWLKARKPGLLGTRAIKWNFTKFLVGRDGLPLRRYAPAHTPESLRHDIARACAAPGPTP

SEQ ID NO: 21453 - protein, 471 aa, Bordetella bronchiseptica RB50
MKTLHTDVAIIGAGTAGLAAYRAARAAGKRALLIEGGQYGTTCARVGCMPSKLLIAAAEAAHAAAHGGPFGVHIDGAVRIDGAQVMARVKSERDRFVGFVLEGVENIPAEDKLRGMARFVEDTVLRVDGHTEVRAGSVVIASGSRPAVPPPFLALGDRLVVNDDVFAWDTLPARVAVFGPGVIGLELGQALARLGVQVRVFGVSGSLGGITDPRVRQSARKAFQQEFYLDPDARVLETKRVGDEVEVRYVALDNTERTERFDYALVATGRRPNVDGLDLHNTSLALDARGVPHFDRHTMQAGQAPVFIAGDANADAPLLHEAADEGRIAGENAARYPDVAPGLRRAALGVVFSDPQIALVGTPFARLESGTFVAGEVDFGDQGRSRVMLRNRGMLRVYADIESGRFVGAEMVGPSAEHIGHLLAWAAQQSLTVAQMLEMPFYHPVVEEGLRTALRDAAARLAQARPQRLAA

SEQ ID NO: 21454 - protein, 477 aa, Bordetella bronchiseptica RB50
MRTITSLIDGQWAGGAGDSENINPSDLSAPVCLVAQASAQQAAQAVEAARRAQPGWAATGLAARAQILKDIGRGIVANSQQLAHTLASEQGKTLPEARGEVQRAADIFDYYAGEVFRLGGEMFPSIRAGVEVEISREPLGVVALITPWNFPIAIPAWKTAPALACGNAVVLKPSEFTPATAVMLAEIIRAAGVPDGVFNLVLGTGADVGQVLTGHPAVAGVSFTGSSATGRKIAASAVAGHKKLQMEMGGKNPLVVLDDADLEIALACALDGAFHATGQRCTASSRLIVTPGIYNRFVQELAQRVMALNVGHALDERSQIGPVSNGAQFDKDLSYIALARDEAQRVVGGAALQRAQRGYYLQPCLALDVSLDARIAREEVFGPLACVLRAQDYEHALAIANDTEYGLSAGICTQSLKHATHFRRHVQSGLAMVNMPTSGVDFHVPFGGRGASSYGSSEQGHYAREFFTSLKTSYIRP

SEQ ID NO: 21455 - protein, 409 aa, Bordetella bronchiseptica RB50
MAMDSIAIIGAGQAGAALAARLRQAGFQGGIDVFGAESAPPYQRPPLSKKYLAGDWEQERLWLRPAQFWREQGIALHLGGTVEALDLASRTLRCGGRRHGWRKLALTTGAALRPLPAAFAGRSNVFELRNLADVQRLQPAFLAGRRLLVLGGGYIGLETAAVAAQAGLSVQVVERASRVLERVACPATAAAIRALHQRHGVLIHEGRTVVGTEGDEALTGVELDNGLRIACDLVVAGVGVAPQTALAEAAGIDCDDGILVDAYGRTSAPDVWAAGDCARFVLGGEPARLESVQNAIDQAEAVADDMLGQGRPYQPVPWFWSDQYDMKLQIVGLNRGYDAVVSHASAKGESHWYFRADRLISVDALNDGRAYMVGKKLLEAGRAVGRGEVERPGFEPMQLLRDQAEGRLR

SEQ ID NO: 21456 - protein, 446 aa, Bordetella bronchiseptica RB50
MSTTHVLHRSLRHTPPVAVRGEGVWLYDQAGRAYLDGSGGAAVSCLGHNHPDVRAAMHAQIDALAYAHTGFFSTEIAERLADRLVADAPAGTSHAYFVSGGSEAIEAALKMARQYFVEIGQPQRRHLVARRQSYHGNTLGALAVGGNEWRRAQFAPLLIDVAHVAPCYAYRDQREDESAEQYGERLARELEDTFQRLGPDTVIAFVAEPVVGATAGALTAVPGYFRRIREICDRYGILMIADEVMCGMGRTGTLYAVEQEEIVPDLITIAKGLGGGYQPIGAVMAQGRIVDAMGKGSGFFQHGHTYLGHATACAASLAVQEVIRRDGLLARVRQQGDGLRQRLMQALGAHPHVGDIRGRGLFLGVELVRDRATKATFDPELALHARVKREAMARGLMVYPMGGTIDGRHGDHVLVAPPFIIADDELDQLVERLAGAIDAAIAQTRA

SEQ ID NO: 21457 - protein, 468 aa, Bordetella bronchiseptica RB50
MIPAAAPSPGFGATMRDIARQAWPVLISQWAGISFGVLDTAMTGHASPQDLAAMSLSVSVYITVFVGLMGVVHALIPILAQHFGAGQQREVGSTWGQGVWLALGLSVVGAILMLFPDAWLSLSGDVDPAVRDRVAAYLRALVLALPATLVFRTIYALGTAVSRPKVVMSINLAAVFVKAFCNWVLIYGKFGLPALGAVGAGLATAISGWLSLAAGLWIITHDRYYRRFRLRVGRPDWRALKELLRLGLPMGGSYLVEVSAFTFMALLVAREGTYVSGGHQIMSNLAALCYMMPMALGVATAALTAQAIGAGRPDLAHRTGMAGLALGLLGAALTAAVLLVGRPLIIAAYTDDLEVAAVAASLLAIIPLFHLCDSMQCINSYLLRAHKVAVMPLVLQTVALGGVGLLGGWWLGFGPGRGGLDPVRAALMPGSPAGAGTMWLMAMAGLGLSAVLLHYWYRRIARLALARG

SEQ ID NO: 21458 - protein, 417 aa, Bordetella bronchiseptica RB50
MESAASSAGGHRYAPLAAASPVRSLSEIEARETPRQPTGLDEFDRVLGGGLVAGAVVLIGGDPGIGKSTLLLQALASLSATTKVLYVTGEESAEQVALRARRLGLQTGNVDLLAEIRLEAIQAAVSEQKPTVAVIDSIQTLYSGELTAAPGSVSQVRECAAQLTRLAKQTGIAIVMIGHVTKDGALAGPRVLEHIVDTVLYFEGDTHSSFRLVRAFKNRFGAVNELGVFAMTDRGLRGVANPSALFLSQHQQQVAGSCVLATQEGTRPLLVEVQALVDTSHAPNPRRLTVGLEGNRLAMLLAVMHRHAGVSTYDQDVFVNAVGGVRITEPAADLPVLLAIMSSLRDKPLPAGLVAFGEIGLAGEIRPAPRGQERLREAAKLGFSVALIPKANAPRQPIEGLEIWAVDRLDAALDKLR

SEQ ID NO: 21459 - protein, 459 aa, Bordetella bronchiseptica RB50
MPLPPHPRLVAAAGLVLAWLLLCLWAWRQARMRAASQARALCALEARPGPQTVLVAYASQTGFAAELAEHTAAALASGGLQARVAELGQIDAATLGHYARALFIVSTYGEGDPPDAAAPFADTAMQSGAGLGALRYAVLALGDSSYAHFCGFGHRLDDWLRANGAAPLFDLVEVDAGDAAALRHWQHHLGVVTGCTDLPDWQAPAYQAWRLARRTLLNPGSQGAPCYFIELTPPHGTAPQWQAGDIAEIGPRDAPDSPLHAHREYSIASLPADGAVHLLVRQMRSADGALGLGSGWLTHTAQTGQAIDLRVRANRNFHPPADARPLILVGNGTGLAGLRALLKARRSAGHGRNWLVFGERSAAHDWFCRDELEQWHGEGWLEYVDAVFSRDAPQRRYVQDLLRERAERVRDWIREGAAVYVCGSLHGMAEGVHQALADILGPAQLQALQHAGRYRRDVY

SEQ ID NO: 21460 - protein, 207 aa, Bordetella bronchiseptica RB50
MLAGFAQIGTAQISDCMGRLYGVQGLRPLHAGAARIVGRAITVKTRPGDNLMIHKAISLAGPGDVIVVDGAGETANALVGELMMMDAQSRGVAAFVIDGAVRDLDVFQQGAFGCFARAVSHKGPYKDGPGEINVPVSIGGQVVAAGDVIVGDADGVVAVPLAQAGAVLAAARRKEDAELAAKEKLRAGTYAKPWVDRIIAEKTGDAQ

SEQ ID NO: 21461 - protein, 300 aa, Bordetella bronchiseptica RB50
MSRRPAGAARGSDAIGITRAVAGPAALTATQSPAMAARTAYLGPAGSWTHQACLDLYGADGLVPLSREALFAAYADGKVERACVPVATSVVGLTPYMEDVLALPRVVVVAEYPKMLGYSLLARPGTRREDIKEVHAHPVAFEEVRPWLEREMPGARRVPAASGGAAAQAVAASATQDKASFGPRVGASVYQLVSLADGIEEGPHNVTRWWVLGRDMPAPTGKDKTSLLACIPDARLAPLLADFAQAGVPILTIYERPARKTLDAHRYVVEVAGHVRDDALAGLLARQGELRVLGSYPRRY

SEQ ID NO: 21462 - protein, 228 aa, Bordetella bronchiseptica RB50
MDIERVEQVRAVERLAHRRGLALMPRAGLAAADFVAARLPAGAQVLALAGPGNNGGDALVAATLLQARGYRVAVVMPAGPARLPDDARRAWQDWCAAGGQASADLPAHAPALVIDGLFGIGLARPLGGAWQGLIDQVNAWRVPVLALDVPSGLSAASGQPLGDPPGRPVRATWTLSFIGVPAALRAPGAAAWCGQQHLSLLGLTPAFLAEAVGPCGQATATAARRSGP

SEQ ID NO: 21463 - protein, 354 aa, Bordetella bronchiseptica RB50
MSIEVRGLSKRFGAFRALDEVSLHIETGELVALLGPSGCGKTTLLRIIAGLESADAGSVLFAGEDATDVDVRQRQVGFVFQHYALFKHMTVFENVAFGLRVRHRSQRPSEARIRAKVLDLLGLVQLDWLADRYPAQLSGGQRQRIALARALAVEPRVLLLDEPFGALDAKVRKELRRWLRRLHDELHVASVFVTHDQEEALEVADRVVLMNAGRIEQVGSPREVWERPATPFVYGFLGDVNQLHGHATRGVWRLGEVALPAPDLPEADNQRAIAYVRPHDIDLARAGTAAPGIPVRLNHVYLAGPSAYLELARQDDQAIIEAQVPEPLFRSLGLKEGEALLAQPRRARVFAVQP

SEQ ID NO: 21464 - protein, 304 aa, Bordetella bronchiseptica RB50
MYLTHPSCRLHEMGDWHPESPQRLDAISDQLLASGLLPYLQERQAPEASRADILRVHTPAYLDSLRAHQPEHGYYAIDADTSMNRHTYEAALRAAGAGVAAVDAVLGGEAITAFCSVRPPGHHAERDHAMGFCFLNNVAIAARHALDFHGLQRVALVDFDVHHGNGTEHAFAGDPRVLMCSFFQHPFFPNSGADDPAPNMLNVPVAAYTGGASIRTIVREQWLPRLHEHRPELILISAGFDAHREDDMAQMGLVEADYAWITDRLVEVADQHCQGRIVSTLEGGYNLSALGRSVVAHIRSLSKL

SEQ ID NO: 21465 - protein, 232 aa, Bordetella bronchiseptica RB50
MDKVYASAAEALAGVVKDGQMIAVGGFGLCGIPEALIAALRDSGVKGLTCISNNAGVDGFGLGQLLNTRQISKMIASYVGENKEFERQFLSGELELEFTPQGTLAEKLRAGGAGIPAFFTRTGVGTVVADGKEIREFDGHQYVMERALVPDVSLVKAHIADRSGNLVFRKTARNFNPNVAMAGKMTVVEVEEIVETGTLDPDQVHLPGIYVHRIVVNATPEKRIEQRTTRPA

SEQ ID NO: 21466 - protein, 285 aa, Bordetella bronchiseptica RB50
MTTTDRIAAAFARVSEAGRAAALIPYIAAGDPSPQATVPLMHALVRAGADLVELGVPFSDPMADGPVVQRAAERAIAQGVGLRRVLELVADFRRDDSVTPVVLMGYANPIERMGQRAFAQAAQAAGVDGVLVVDYPPEEVDEFAAMLAEAGVAPIFLLAPTSTEARIEAIGRVARGYVYYVSLKGVTGAGSLDTDDVARKLALIRRHVHIPVGVGFGIRDAASAQRIAAHADAVVIGSKLIETMEQAGAQAGADQKNEAAIAAAQQWLHTIRLALDDVKRENAPA

SEQ ID NO: 21467 - protein, 373 aa, Bordetella bronchiseptica RB50
MAKRDYYEVLGVAKNASDEDLKKAYRKLAMKYHPDRNPDSKEAEEKFKEAKEAYEVLGDEQKRAAYDRYGHAGVDPNAAGMGGGMGGGFADAFGDIFGEIFGAGRRGGGGPQVYRGADLKYALEITLEQAASGFDTEIRVPSWENCDTCHGSGAKAGTSPKTCRTCGGSGAVRMQQGFFSVQQTCPTCHGTGKEITDPCPSCDGVGRTRRNKTLQVKIPAGIDDGMRIRSSGNGEPGINGGPPGDLYVEIHIKQHKIFQRDGDDLHCELTIPFTTAALGGELQVPTLGGKAEISIPEGTQSGKTFRLRAKGIRGVRGSYPGDLYCHVVVETPVRLSDEQKAILRQFEASLNDGGDRHSPQSKSWTDRVKEFFS

SEQ ID NO: 21468 - protein, 316 aa, Bordetella bronchiseptica RB50
MQKHKIAFLGLGAMGLPMACNLVKGGHAVTGYDLNPQALDALAQAGGQRAASAREAAAGAALVIAMLPTATHIQAALEGADGALQGMDPGALFINMSTILPQETDLIAQRLAERGMRMLDSPVGRSAMEAQRGTLLILASGSAQDKARARDALLCMGNQVIDCGEVGGGSRVKVVNNFMGISLNALTAEALTLAEASGLSVELALEVMRGTIAGLGHMNITYPNKVLRGDLSAGFQVDLAHKDLGLALELAARSRACVPMGSAAFQSYTAARAQGRGGQDYSAIYPVMRSLSGLPEALPYQVDTPVEADPFGAAAR

SEQ ID NO: 21469 - protein, 304 aa, Bordetella bronchiseptica RB50
MTTEKHLGFVGIGRMGTPIAERLLEAGYTLTVYDTQAPALQALAAKGAHIADSPKAVADRAETVLVSLPTPDIVLAVALGEDGLARGSAVRTVIDLSTSGSQAARTLADGLAAQNIASIDCPVSGGVTGAKRGTLALMVSGPRERYDALHDMFGVIGKPVYVGERAGMAQTMKVINNLISVTALSITSELMVMGVKAGLDPDIMLQVINSGSGRTNASEDKIPRFVLTRSFDFGFAIGLSAKDVRLCLEESEQLGVPLRVGDAARRLLNDARDKFGNDADLTEIIRYVEDNAGVQVRGKAADAA

SEQ ID NO: 21470 - protein, 301 aa, Bordetella bronchiseptica RB50
MATIGSKTYDTTTPRNVAFLGLGVMGLPMAGHLARAGHQVTVYNRTAAKAQAWAAEFGGKAAATPREAAAGAQIVFCCVGNDDDLRSVVLGADGAFAGMQAGAVFVDHTTASADVARELYAAARELNLQFIDAPVSGGQAGAVNGALTIMCGGDSATFEDIKPVAHAFGRAVTLVGPPGAGQLAKMVNQVCIAGVVQGLSEAIAFGQTAGLDMKLVLDVISKGAAQSWQMENRGATMVDDQFDFGFAVDWMRKDLGLVLAEARNNGARLPLTALVDQFYGDVQKMGGNRWDTSSLIKRLRD

SEQ ID NO: 21471 - protein, 484 aa, Bordetella bronchiseptica RB50
MENLGYPARLELYVAGQWRGVEGRRTQVVVNPSTQQPLGELPLASVEDIDDALAAADQAFGDWARTTAWERADILQRAAALIEARRDRLAVVLTLENGKPLADSHGELDRVVETILWCAEEGKRTYGRVLPARAQRLSQSSLKRPVGPVAAFVPWNFPAVLAARKLAAAMAAGCTVVLKPAEETPAICIELVRAFVDAGTPAGVVNLLYGVPAQVSERLIASPIIRKVSFTGSVAVGRLLASMAAGHLKPATMELGGHAPVVVFDDVDADRVAKMCVGFKYRNAGQVCLSPSRFYVHERIADRFAESFVRHAGLLRVGDGMEEGVQMGPLNNVRRLQAAERLVEQAVGAGASLALGGRRIGQRGYFYPPTVLEGVPDAADILAEEPFCPVAPIMRFGSMDEVIGRANHPSLGLAAYAFTNRMATSAEFAERIEAGWIGINNFVPALADAPIGGMKDSGLGYEGGPEGLDAYLHARFVSQLNVEV

SEQ ID NO: 21472 - protein, 427 aa, Bordetella bronchiseptica RB50
MSTNAELFDRACRSIPGGVNSPVRAFRSVGGTPRFIQRAQGPYVWDAEGKQYIDYVGSWGPAILGHAHPEVVRAVQEAAVHGLSFGAPTEAEVELAEMLIARLPSLEQVRLVSSGTEATMTAIRLARGATGRHKIIKFEGCYHGHSDSLLVKAGSGLLTFGNPSSAGVPPEFVAHTLTLEFNNLAAVDAAFSQHGAEIACVIVEPVAGNMNLIKPAEGFLAGLRELCTRHGAVLIFDEVMTGFRVGPQGVQGLTGVRPDLTTLAKVIGGGMPVGAFGGRADLMAHIAPLGGVYQAGTLSGNPVAVAAGLATMRLIGEPGFYERLSAQTARLAQGLQERARAAGVPFSADAIGGMFGLYFGDRVPASFAEVSACDTEAFKRFFHAMLERGIHFAPSAFEAGFVSATHDDAVIDATLEAAEQVFATLRA

SEQ ID NO: 21473 - protein, 311 aa, Bordetella bronchiseptica RB50
MASAQLATLSAQVRQLYAGWDQNTDIARIRRDWDAFFGAVRLPARVTPVDAGGVPCHWIEAPASTRDRVVVFIHGGGYQIGSHRSHHNLMARLSACSGRAVLSIGYRLAPQARCPAALEDVDAAHAWLAGQGWAARQTALAGDSAGGALAVLLLARLRARGAALPAACAVMSPWIDLQARGESYTANAASDPIANRATVLRMARAYLGRDGDPEAPAVSAQHADLRGLPPLLVQAGSAEALLDDARALAARAAASGVAVRLSVWQDMPHVFQLFAARLDAADAAIAELADFINHPLRAARTGAEPHHETST

SEQ ID NO: 21474 - protein, 286 aa, Bordetella bronchiseptica RB50
MDTSSSSLPAIERQHLPALFAARPTDAHKGSCGTLGVIGGGPGMVGAALLAARAGLKVGAGKVLVGLVAETPPLPCDPMQPELMLRDFRGLLEAGLGIDAWTAGCGCGMDALAANALSELFQLRGDAALVLDADGLNLLAAGAVQPRWGDAPVVLTPHPAEAGRLLGLSTEAVQADRPAAARTLAARYGAWVVLKGAGSIVCDPAGACRINRTGNPGLATAGTGDVLAGILGALLAQRIAPEQAVPGAVWLHGAAADALVTHGIGPIGLTAGELADSARRLRNSRA

SEQ ID NO: 21475 - protein, 469 aa, Bordetella bronchiseptica RB50
MASTMETDLLVLGGGPGGYTAAFRAADLGLSVVLVEQRPTLGGVCLNVGCIPSKALLHCAKALDEARAMSELGIEFSEPRIRLDKLRAHKEALVAKLCGGLGGLARQRKVQVVTGTGRFDGPHSLAVSDGSRVAFKQAVIAVGSRPVRLPFLPDDPRIMDSTGALELKEIPRRLLVIGGGVIGMELATVYAALGARVTVVELTDGLLPGCDRDLVKPLAQRVAGRYEAVLLGTRVSAAQARDDGIHVGFEGPQAPGPQVYDQVLVAAGRRPNGAAIDAERAGVRVDEGGFIRVDAQQRTNVGHIYAIGDVVGEPMLAHKAAHEGKVAAETAAGMRVANDARVIPAVAYTDPEVAWVGLTETAAQRDGIAYEKAAFPWAASGRALSLGRGEGLTKILVDPATHALLGVGMVGPQAGDLIAEAALAIEMGAEPGDIALTIHPHPTLSETLAFAAEAYEGTLTELYLTRKKS

SEQ ID NO: 21476 - protein, 497 aa, Bordetella bronchiseptica RB50
MFNLSASIAFHARRTPDKAAIVYRDQEIGYAEFHQRILQAAAMLHARGISQNDVVALFMKNSAAFLELAFAASYLGAVFLPVNYRLAAPEAAYILGDAGAKLLLVDEEFDAIVALETPKIVIDAHAQADSRRLGQPGLEIPPQAAVAETDLVRLMYTSGTTSRPKGVMHSYGNLHWKSIDHVIALGLTASEKLLVVGPLYHVGAFDLPGIAVLWVGGTLCVHREFDPEAVLASIERHRLTCGWMAPVMLSRVLTVPDPDRFDLDTFAWCIAGGEKTPESRIRDFTRVFTRGRFVDGFGMTETCSGDTLMEAGREIEKIGSTGRALPHVEIRIADGAGGWLPANQKGEICMRGPKVTKGYWNAPEKTAEAFYGDWLRSGDVGYLDEEGFLFVTDRTKDMILTGAENVASSEVEAALYELPQIAEAAVIGVHDDKWGERITAVVVLNPGQTLTLEEIDRHCRQRLASFKVPRELKVVAELPRNPSGKVLKRVLRDEYNG

SEQ ID NO: 21477 - protein, 492 aa, Bordetella bronchiseptica RB50
MRISMGKITGFMEFQRLQEAAEAPQKRLKHWREFVLHLNDEQAKQQAARCMDCGIPFCSNGCPVNNIIPDWNDLVYRQDWRRALDVLHSTNNFPEFTGRICPAPCEAACTLNINSDAVGIKSIEHAIIDKGWAEGWVTPQVPVRKTGKKVAVVGSGPAGLACSQQLARAGHSVTLFEKSDRIGGLLRYGIPDFKLEKSQIDRRIAQMEAEGVEFAPSTYIGNPDDAAADGLTVRTPQSLLADFDAVVMTGGSETPRDLPVPGRELSGVYYAMDFLRQQNKAVAGDRLSGQTLAKDKHVVVIGGGDTGSDCVGTSNRHGAASVTQFELLPQPPECEDKPMVWPYWPLKLRTSSSHDEGCERDWSVATKALAGSDGQVEKLVGVRVEWFKDEATGQMKMREVEDSEFEIPADLVLLAMGFVSPVATVLDAFGVDRDARGNVRANTDDYRTNVDKVFAAGDMRRGQSLVVWAIREGRQCARSVDEYLMGTSELPR

SEQ ID NO: 21478 - protein, 298 aa, Bordetella bronchiseptica RB50
MAVSPGAGRPWAAPNLLPLPMPVHTRNSSELALSLEDVALGYGDFTVLDGISMQVHAGQVVAVMGGSGSGKTTLLRAATGQIVAQRGSVQAFGTDVGSVSQDGLQSLRKRMGVLFQQGALFTDLNVFENVAFPLREHTALDEAELTARVLDKLDAVGQRTAAHLRVAEISGGMARRVALARAVVLEPELILYDEPFAGLDPISMGITARLIRSLADRLGCATVLITHDVQESFAIADQVYLVGQGRLAAAGTPQQLAASQDPYVKQFLNGEPDGPVAFQYPETPAFRAWLAQQEGRKP

SEQ ID NO: 21479 - protein, 397 aa, Bordetella bronchiseptica RB50
MTDESRHIDTLLQHLGTAPFDPDTGAAPVNLPSMRASTVRFRDLAALEQAQRRKAGGDRAVTYGRMGMDTHAALEHVFKELEAGTHCYLASSGMGAVTMAFLSLLSAGEHALVADCVYGPVYELDNAVLKRMGIELTFFAPGDDLQALVRPNTRLLYVESPGSLLFQMLDLPALAEFARRNQLVLATDNTWGSGYIYRPLELGAQVSVIAGTKYVGGHSDLMLGAVVTNDEAVAQRLNRTQYAMGYSVSADDAWLALRGVRTLPIRMAQHARHAQRVCEFLQGRPEVARIYHPAWPQDPGHALWLRDCSGSNGMLAVELRLSQPAARVFVESLQLFGIGFSWGGFESLVQLVTPGELARHRYWQGGGNALVRLHIGLESPEDVIADLTQALARAASA

SEQ ID NO: 21480 - protein, 396 aa, Bordetella bronchiseptica RB50
MEFSQFKVNALMEITARPDLVFVRGQGSWLEDHAGKRYLDFVQGWAVNTLGHCAPEMKRALAEQADKLMNPSPAFYNLPSIELAQRLTSASCFDRVFFANSGAEANEGAIKLARKWGRVNRNGAYKIITMNHGFHGRTLATMSASGKPGWDTMFAPQVEGFPKAEINDLDSVRALIDAQTVAVMLEPVQGEAGVIPATREFMQGLRKLADEHGILFIVDEVQTGMGRTGSLFAYQQFDVIPDIMTLAKGIGGGIPLAALLAREEVCVFAHGDQGGTYNGNPLCAAVGVAVFDTITAPGFMEAAQARTRQLSEGLLALSAKRGLRGERGMGLLRALVLDRDDAPAIVEAARMLAPEGLLLNAPRGNLLRFMPALNVTEADMARMLEQLDGVIAAVRK

SEQ ID NO: 21481 - protein, 511 aa, Saccharomyces cerevisiae
MSKSKTKTDKRNQSSLSRIKLSALHYCMSDAEPSIAYLQDNSAFINNEWHNLVLEKIFPVYNPSTEEDITQVSEKSQHDSTEEDITQVSEKSQHDDDKAVVDISERGRLLNILADLIERDRDILAAIEHLDNGKPFDEAYLLDLASVLKELRYTAGWADKLHGTLRFAITIPTFQDLRFLRYTRHEPVGVCGEIIPWNIPLLMYIWKIGPALAAGNTVVLKPEELTPLTALTVATLIKEAGFPPGVVNVVSGYGPTAGAACLSHKDNDKLAFTGSTLVGKVVMKAAAKSNLKKVTLELGGKSPMIVFIDADLDWAVENAHFGVFFNQGQCCIAQSRITVHESIYDEIVERDLEKAKKQVLGNPFESDTRYGPQILKIEFDSIPRLINSAKAEGAKVLCGGGRDDSCVGYYIQPTVFADVTDEMRIAKEEIFGPVITISRFKSVDEAIKRVDNTKYGLAAYVFTKDKAIRISAALKAGTVWVNCVHVASYQIPFGGNKNSGMGRELGEYGLE

SEQ ID NO: 21482 - protein, 306 aa, Synechococcus sp. WH 8102
MIDRLGPPGGDPAIDGPLDDRLGGAPANVACGLARLGTSVAFLGRLGADAIGDRFATLFLQRGVDVDSVQWDAQRPSRIVLVRRSADGERQFRGFAGDEGLGFADQALASVELPKQARWLLTGTLPLAAHASADSLRGAVAQSKARGIALAVDVNWRPTFWDSAARPDAGPSQQAIELIRPLLEQAALIKLAREEAIWLFGSTDPRAICTQLPQEPDVVVTDGAEPVRWWMDGASGTQPAFHPPQVVDTTGAGDAFTAGLLHRWSASPAERVRFASACGALVCAGAGGIDPQPTEAQVEAFLGGVS

SEQ ID NO: 21483 - protein, 251 aa, Synechococcus sp. WH 8102
MRDLTMQWGARPVLDRVSLVMQPGERLAVVGPSGAGKSTVLRLLAGLQLPTSGELRLFERPQTYLRLDQTDPPDVRLVFQNPALLASLTVEQNVGFLLREQGQLTREEIRERVEACLEAVGLFDVAHQYPGELSGGMQKRVSFARALIDNPQRGDEAMPLLLYDEPTAGLDPVACTRIEDLIVKTTTVAKGCSVVVSHVRSTIERSAERVVMVYGGHFQWSGSVEEFRTTDNPYVEQFRTGSLRGPMQPSH

SEQ ID NO: 21484 - protein, 490 aa, Synechococcus sp. WH 8102
MTTAFHSPTSRRRKTLQEANLLEGPLMLIKSIRGFSSNRAMTWLACAPLALMGLGIFTLSAKAEELPDLNAAFLANNLWLLVATILVIFMNAGFAMVEAGMCRQKNAVNILAKNLFVFALAVTAYWFVGYSFMYGDAAIDGWLYFGGLFFDPTVTAETISDAGLVPTVDFLFQAAFAGTAATIVSGLVAERIKFGEFVVFALILTAFIYPVAGSWEWNGGWLNSVGNAEFIDFAGSSIVHSVGAWAGLVGAALLGPRIGKYVGGNVQAIPGHNMSIATLGALILWIGWYGFNPGSQLAMDQWVPYVAVTTTLGAAGGAIGATVISTITSKKPDLTMIINGILAGLVSVTAGCGNLTLTGSWVAGLVGGIIVVFSVSALDSAGIDDPVGAFSVHGVCGVWGTLVIGLWGFDVQGDGSPLGLLVGGGIEQLGIQALGTAAYAIWTVVTCFIAWQIIGALFGGIRVTEQEETEGLDIGEHGMEAYAGFSTTNN

SEQ ID NO: 21485 - protein, 246 aa, Synechococcus sp. WH 8102
MTVAIRATDLVKSYIAGVRALDRVSLEVSSGEVLVVMGPSGSGKSTLIRTFNGLERLDGGALDVLGVRLDSTHADPQVRAIRRRVGMVFQQFNLFPHLSILENISLAPVKVQKRPKAEVEQRALELLEQMGIQEQAEKYPAQLSGGQQQRVAIARALALDPEVMLFDEPTSALDPERVKEVLDAMRQLARGGMTMVVVTHEIGFAREVADRVMFMDQGQVVETSDPVTFFSGAREERSRRFLSQMV

SEQ ID NO: 21486 - protein, 113 aa, Synechococcus sp. WH 8102
MRVERPWGWYEDLLAAPGYKVKRLLIRRGRQLSLQRHRHRSESWTVVAGDGALLCGECWLEANAGVMLTIPCGALHRARSDQSDLVILEVQHGNDLREDDIERLQDDYGRVIS

SEQ ID NO: 21487 - protein, 141 aa, Synechococcus sp. WH 8102
MSEWIRGQTAGGSAGDLGPLQLAWLGDAVWELHQRLRFCRSPGRADVLHRAVVAKVCAEAQAEALGRLDPVLSEQERDLVRRGRNRAGRGPKRSDAAVYGLATGFETMVGWLYLNDPARLAELLDHLDQAGTLSTSSTPRP

SEQ ID NO: 21488 - protein, 258 aa, Synechococcus sp. WH 8102
MPQWISTPERGSLYQWLPRSLKSPRIPRYFYMSTKPLVISPSILSADFSRLGDEVKAVDEAGADWIHVDVMDGRFVPNITIGPLIVEALRPVTQKPLDVHLMIVEPEKYVPDFAKAGADIISVQVEACPHLHRNLAQIKDLGKLAGAVLNPSTRLDTLEYCLELCDLVLIMSVNPGFGGQSFIENQVQKISDLRRMCDERGLDPWIEVDGGVKAGNAWKVIEAGANAIVSGSGVFNQPDYAEAIKGIRNSSSKEAVLV

SEQ ID NO: 21489 - protein, 472 aa, Synechococcus sp. WH 8102
MSQSHFGLIGLGVMGENLVLNAERNGFSSVVYNRTYAKTEEFLNGRGQGRNIQGATDLQDFVGKLERPRRILMMVKAGPAVDAVVDQISPYLEEGDLLIDGGNSDYHDTERRVKELESKSFGFIGMGVSGGAKGALEGPSMMPGGTKASYDAIESLVNKMAAQVDDGPCVTYIGPGGSGHLVKTVHNGIEYGIEQILAEGYDLMKRVKGMNGEQMADVLAQWNATEELSSYLVEITEVCLRTKDPEDGADLVEKIMDQAGQKGTGLWTVVTALQMGASVPTIYASLNGRVMSSLKPERVAAESILKGPVIKDFDLGTPDDAMAPLMDATVLSCIASYAQGMELLRIASRDLDYSLQMPSIAQIWKGGCIIRARLLQRIQDAFAANPDLTNLMLDPWFADQINRRLPGLAKVVAGAAESGIPVPCFSSTLDYINSYRTGRLPQNLVQAMRDCFGSHTYQRVDKEGAFHTEWLG

SEQ ID NO: 21490 - protein, 484 aa, Synechococcus sp. WH 8102
MGQFDQNRRTKIVATIGPATESSERIKELVQAGATTFRLNFSHGDHSEHAARISTIRQVSEELGINIGILQDLQGPKIRLGRFAEGPITLANGDSFSLTSRPVSCNQSIATVTYDKLADEVTAGSRILLDDGRVEMKVEQVDQAEQTLHCTVTVGGVLSNNKGVNFPDVQLSVRALTDKDKVDLEFGLSQGVDWVALSFVRNPSDMEEIRGLIREHGHETPVVAKIEKFEAIDQIDAILPLCDGVMVARGDLGVEMPAEEVPLLQKELIRKANSLGIPIITATQMLDSMASSPRPTRAEVSDVANAILDGTDAVMLSNETAVGDFPVEAVQTMATIACRIEKDYPQRSVDSHLASTVPNALSGAVSTIASQLNASAILPLTKSGATAKNVSKFRPASPILAITPDPTVACRLQLVWGVKPLVIPQHELTTHTFLAAMTQAKTMGLLKEGDLVVQTAGTHTGVSGSTDLVKVGIVSSEEAPVNMI

SEQ ID NO: 21491 - protein, 158 aa, Synechococcus sp. WH 8102
MRRLFAALLSALLVFGFAPVAKADVAGLTPCSESARFQQRAAAATTPQAKARFEMYSQASCGDDGLPHLIVDGRWSHAGDFVYPGIMFLYVAGCIGWAGREYLKATRGKNAAMNEIQIDLGIAFKSLLAAATWPLAAFGEFTSGKLLEDDNKVTVSPR

SEQ ID NO: 21492 - protein, 146 aa, Synechococcus sp. WH 8102
MLVGEELLNKARSLSNRPEDDIARGCGYVGPSGRLLKKSFYRALVEAKAEAQGWQLPRSTTNSGGGGSRGRQAEFRTRVHGNGNLLIGHAYTRRLGLEPGQEFRIELNSDSGSISLSPLNESTMESTADQVQPFSDSQASDMAGVE

SEQ ID NO: 21493 - protein, 392 aa, Synechococcus sp. WH 8102
MPTSRRLEALGNGVFARTDRAKQAHRDKTGVPPLIDLSLGSTDLQPPEEILRCMAAAVTDPASSAYCLEAGTAPFQQAVAAWCQRRFGVEVDPQRQVQLLVGSQEGTAHLPLAILDPGDRALLLDPSYPSHRGGLVLAGASICSLPLFQEQDWLPDFDAIRPAVWDQLKLFVLGYPHNPTATVGNQELLDQAMARGCRHQLVIANDNPYVDLALEGEAPSLLRSPGWSEWGIEFFSLSKGWCLGGFRLAFAIGAEPLITALRQVKGVVDFNQSLALQQGAIQALTQWADWPRSLHGAYRERRDRVLSVLRGGGWSCPTPGMAMYLWLPLPADAGVRKLDDETFASHVLQRSGVALTPGSGFGEGGKGWLRMALVRPTDELEDAARRVVAAVP

SEQ ID NO: 21494 - protein, 324 aa, Synechococcus sp. WH 8102
MSGSGYKDYFQVLGVDRSADADSVKRAFRKLARQYHPDVNPGNASAEARFKEISEAYEVLSDPDKRRRYEQFGQYWNQSGASGGAAGPGMDVDFGRYGNFDDFIGDLLGRFGGPAGGGGFQSSGFPGGGFSGGGFPRGNAAARTPVNLDAEASVSITFAEAFRGTERTLSVNNERVQVRIPSGVKNGSRLRLKDKGNLQPGTGRRGDLFLNLNVKDHPVWRLEDDQLKADLPVSLDELALGATVTVMTPDGEAQVAIPACTAPGRSLRLKSKGWPAKGGRGDLLLTLALVMPTSWSPEEQQLLEQLRRQRSESPRHGWLRSAAL

SEQ ID NO: 21495 - protein, 280 aa, Synechococcus sp. WH 8102
MPTRIAYLGPAGTYGEQASRALAELEGLTEVSFLPCVGLRAVVECLAQAGADAAVVPVENSVEGGVTATLDALWAHSDLGIRRALVLPIRHALLGSGSLQDVTEVLSHPQALAQCSGWLAAQLPQALQLPTSSTAEAARMVAGSRFRAAIASRKAGLEHGLEELAYPVNDVAGNRTRFLLLHRGERRLEGDVASLAFSMHRNAPGALLEALACLAEQGLNMSRIESRPSKRELGEYVFFVDVELPAQQPEALSTLVAALTPLCEHLAHFGAYPSSELVSG

SEQ ID NO: 21496 - protein, 418 aa, Prochlorococcus marinus str. MIT 9313
MVDALDSKSSAFGHVGSSPTAPTAVMGTYKRFPVTLLRGKGCWVWDDHGHQYLDAVAGIATCALGHSDRALRRSLGQQLKQLQHVSNLYRIPEQEALAHWLVENSCADSVFFCNSGAEANEAAIKLARKHGHRRRGIDRPIILTANSSFHGRTLAAISATGQPNFHKGFEPMVEGFEFFPFNNLQAFEQQLNRLEAQGPSVAAVLIEPLQGEGGVNPGEAGFFRRLRELCSQHQILLIFDEVQVGMGRCGNWWGYQQLGIEPDAFTLAKGLGGGHAIGALLVKQHADLFEPGDHASTFGGNPFACKAALTVAKEIERRGLIAKVQQRGAQLREGLTDLVQRFPRQLKGVRGWGLLQGLVLQDESTFTAPNVAQAALEEKLLVIAAGPKVVRMVPPLIIKPSEIRQLLQRLEATLAHFR

SEQ ID NO: 21497 - protein, 453 aa, Prochlorococcus marinus str. MIT 9313
MEHPFDLIVLGAGSGGLAAAKRAASHGAKVAIVEGDRVGGTCVIRGCVPKKLLVYGSLYREQLEVAPSFGVELSDAQINAGVLLANVRQEVDRLNTLHIDLLAKNGVELVTGWGSFTSPNSVAVSRNGAIDASQELHGDHILIAVGGRPHRPDIPGAELGWVSDDMFMQSSFPDRVVVVGAGFIACEFACILHGLGVEVIQLVRGDHLLRGFDRELSTAVQDGMQEKGIDLRFGENPAALKGQPGDLVLSTQSGERFSCGGVLLATGRRPFLQGLNLDAAGVVLEGRRISVDANQSTNIPHIFAVGDVTDRINLTPVAIDEGRAFADSVFGQKPRQVNHDLVASAVFSQPELATVGLTEEQSIDRYGKDQVKVYRARFRSMAQALPKRGPRCLLKLIVARNTDRILGCHMVGEHAAEIIQMAAIALGMGATKADFDRTMALHPTVSEEFVTMT

SEQ ID NO: 21498 - protein, 135 aa, Prochlorococcus marinus str. MIT 9313
MNNWIRSQSAIGGANELGPLQLAWLGDAVWELHQRLRHCYQPGRSEDLHRAVVDEVKAAAQAEALLRLDPHLSDLEKDLVRRGRNKSGRGPRRGDAATYGKATGFETMVGWLFLQNPARLAQLLDQLEETEHDLL

SEQ ID NO: 21499 - protein, 142 aa, Prochlorococcus marinus str. MIT 9313
MDTDAGLIELDLFDDDAPNTVANFTKLVKEGFYDGLSFHRVIDGFMAQGGCPNTREGAKGMPGTGGPGYTINCEINSKKHLAGSLSMAHAGKNTGGSQFFLVHDAQPHLDGVHTVFGQAANMDVVLALKNGSRINKVTIQEN

SEQ ID NO: 21500 - protein, 442 aa, Prochlorococcus marinus str. MIT 9313
MTSHRFETLQLHAGQVADPVTNSRAVPIYQTSSYVFNDAEHGANLFGLKEFGNIYTRLMNPTTDVFEKRVAALEGGIAAVATASGQSAQFLAITNCMQAGDNLVSTSFLYGGTYNQFKVQFPRLGIDVKFADGDDVDSFATQIDANTKAIYVESMGNPRFNIPDFKGLSGLAKDMGIPLIVDNTLGAAGALLRPIEHGADVVVESATKWIGGHGTSLGGVLVDAGTFNWGNGKFPLMSEPSAAYHGLVHWDAFGFGSDICSMLGVPSNRNVAFALRARVEGLRDWGAALSPFNSFLLLQGLETLSLRVERHASNAMALATWLQDHPKVASVNYPGLKNDPYHAQAKTYLTNRGMGCMLMFSLKGGFDDAVSFINGLELASHLANVGDAKTLVIHPASTTHQQLSAQEQESAGVTPTMVRVSVGLEHIEDIKADFEQALAAIS

SEQ ID NO: 21501 - protein, 218 aa, Prochlorococcus marinus str. MIT 9313
MTLSQALESGNPPEQLSGPLWVFPPNRDCDGGTAWWLGCDPEPVLIDCPPLTTTTLEALKQLAAGRTARILLTSREGHGRVRAFQDALGWPVLVQEQEAYLLPGLTSLDSFVDQHTTAAGLRLLWTPGPTPGSCVVFAPDPWNVLFCGRLLIPVAFVQLAPLPHRRTFHWPRQLRSLQKLRQWIPSDSRPALASGAPLGALRGEKLAPWDAWELQVNQ

SEQ ID NO: 21502 - protein, 126 aa, Prochlorococcus marinus str. MIT 9313
MIDPSAAFQVSAQLDERANGSEPLLGGQLREKAVWVDEAVCIGCRYCAHVATNTFVIEPTMGRSRAIRQDGDSTERIQEAIATCPVNCIKWVQFEQLDELRAQLAALELLPLGFQRTSRKRRNHGS

SEQ ID NO: 21503 - protein, 1125 aa, Prochlorococcus marinus str. MIT 9313
MTSSGKIRIYELSKDLGLENKDVLHAAEKLSIAAKSHSSSISDDEAKRIRGLLRQGSAANSAPPSKSEPEKTILSVKKAAPTAIKDVAPPIRKATSSSEISHVKPSAPANPIPTSPARPSTESVAHPAPPTRPANPTPTPTSSPPKTAARPINAPISRPAIPSRPTAPTPRSANKPSSPVPPSAGGKDPRAGQTSTTSKATTVSGGGPRPKIVSRPQSPTAPGRSAPPAKPSIPSERKAPKPELVGRPKPKRPVVAPPSRPDPEGQRPDKKRPGISPRPIGGPNQRANTSQRPGAPIRQGKTRPGQPRSAGNTLELVGKPIRRDRSDAGSAGRDSNNRPGAPTRPGMPTGMRKPVAPGELMQLQKPTGRPGTPPPRRPDGTSVGTRGGSEGATPPVERTATAPTAPKRPGHRPAQAPAAGAPRRPGRPEWDDSAKLEALRNKSPQKQRQKVHIIGENDDALTAETSGYAGEKQAVVLTASLARPAKPKSQKKPASKPVAALRKRKKETTRQRQRRRAMELRAAREAKQVRPEMLIVPEANLTVQELADMLSIESSEIIKSLFFKGITATVTQSLDLPTIEAVAEEFGVPVLQDDIEEAAKKTTEMIEETDLAHLIRRPPVVTVMGHVDHGKTSLLDAIRKARVAAVEAGGITQHIGAYQVEIDHGGQPRKITFLDTPGHQAFTAMRARGTKVTDIAVLVVAADDGVRPQTLEAISHARAAKVPIIVAINKTDKEGASPERVKQELSDQNLLSEEWGGDVVMVPVSAIKGENIDKLLEMILLVTEVEDLQANPDRLAKGTVIEAHLDKAKGPVATLLIQNGTLKTGDVLAAGPVLGKVRAMVDDSGARLKEAGPSGAVEALGFSEVPTAGDEFEVYPDEKSARVVVGERASDARATRLAQQMASRRVSLAAMSGQASDGELKELNLILKADVQGSVEAILGSLEQLPKDEVQVRVLLSAPGEITETDVDLAAASGAVIVGFNTSMASGAKRAADATGVDVRDYDVIYKLLEDIQMAMEGLLEPELVEESLGEAEVRAVFTIGKSAVAGCYITAGKLQRNCRVRVRRAKQVVFEGDLDSLRRNKDDVKEVATGFECGIGCDRFANWEERDIIEAHKLVTKRRTLSSS

SEQ ID NO: 21504 - protein, 106 aa, Prochlorococcus marinus str. MIT 9313
MTPVLIQALPTLHLVLAFALAFWTLTFIFRIVLSWYPQVKLSEGFWPLVSWPTEPLLAMTRRVVAPIGGVDVTPVIWAGLISLLRELLVGQQGLLSQMLLKSQAIA

SEQ ID NO: 21505 - protein, 475 aa, Anagallis arvensis
MSPQTETKAGTGFKAGVKDYKLTYYTPEYVTKDTDILAAFRVTPQPGVPPEEAGAAVAAESSTGTWTTVWTDGLTSLDRYKGRCYNIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQDETGEIKGHYLNATAGTNEEMIKRAVFARELGVPIVMHDYLTGGFTANTSLAHYCRDNGLLLHIHRAMHAVIDRQKNHGIHFRVLAKALRMSGGDHVHSGTVVGKLEGEREITLGFVDLLRDDYIEKDRSRGIFFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 21506 - protein, 247 aa, Prochlorococcus marinus str. MIT 9313
MQWGKWPVLDQVNLVMQPGERLAVVGPSGAGKSTVLRLLAGLELPTSGELRLFGEQQAYLRLDQEQPPDVRLVFQNPALLASLTVEENVGFLLMRGGRIKQKEIRERAMACLEAVGLYDVADLLPGQLSGGMQKRVSFARALIDDPDRESAAMPLLLYDEPTAGLDPVACTRIEDLIVKTTTVAKGCSVVVSHVRSTIERSAERVVMLYGGKFHWAGSIEDFGKTDNPYVDQFRTGSLRGPMQPEEH

SEQ ID NO: 21507 - protein, 322 aa, Prochlorococcus marinus str. MIT 9313
MPIAADITALVGRTPIVRLNRLPQLSGCHAEVLAKLESFNPTASVKDRIAGAMIQAAEEAGTIAPGRTVLVEPTSGNTGIALAMVAAARGYRLILTMPDTMSTERRAMLRAYGAELQLTPGSDGMTGSIELAKELVATIPEAYLLQQFDNPANPQVHERTTAEEIWNDCEGRLDGLITGVGTGGTLTGCARLLKQRNPSLRVFAVEPALSPVLAGGSPAPHRIQGIGAGFIPSVLDLSLIDEILPVSDDDAMEMGRRLAREEGLLSGVSSGAAVAAALQVGSRAEMVGKRLVVVLASFGERYLSTPMFSAASAVPAQRDGYL

SEQ ID NO: 21508 - protein, 476 aa, Arenaria drummondii
MSPQTETKASVGFKAGVKDYKLTYYTPDYETLDTDILAAFRVTPQPGVPAEEAGAAVAAESSTGTWTTVWTDGLTSLDRYKGRCYHIEPVAGDENQYICYVAYPLDLFEEGSVTNMFTSIVGNVFGFKALRALRLEDLRIPVAYIKTFLGPPHGIQVERDKLNKYGRPLLGCTIKPKLGLSAKNYGRAVYECLRGGLDFTKDDENVNSQPFMRWRDRFLFCAEAINKAQAETGEIKGHYLNATAGTCEEMIKRAVFARELGVPIVMHDYITGGFTANTSLAHYCRDNGLLLHIHRAMHAVIDRQKNHGMHFRVLAKALRLSGGDHIHSGTVVGKLEGERDITLGFVDLLRDDFTEKDRSRGIYFTQSWVSTPGVLPVASGGIHVWHMPALTEIFGDDSVLQFGGGTLGHPWGNAPGAVANRVALEACVQARNEGRDLAREGNTIIREACKWSPELAAACEVWKEIKFEFQAMDTID

SEQ ID NO: 21509 - protein, 131 aa, Synechococcus sp. WH 8102
MVAIDVLWSQNKDRLSNQPMPFISVKTNITDVQTPNGLLKKLSAALATATGKPESYVMTLLDSGVPMTFAGSEEPCAYVEVKSIGALTPPAMSDQFCELIKSSLGIPKDRIYIGFDDVNASNWGWNGRTFG

SEQ ID NO: 21510 - protein, 123 aa, Synechococcus sp. WH 8102
MGRLNQSDPIDPSLAFSASVDQPIERSGCEPQLGGSLCERAVWVDESVCIGCRYCAHVAGNTFVVEPHLGRSRAIRQDGDSTECIQEAIDTCPVDCIHWVPFEDLHTLQSDLIRQDLQPRPRG

SEQ ID NO: 21511 - protein, 222 aa, Synechococcus sp. WH 8102
MQPLSPAFIDQLRFNEAGLIPAIAQDWLDGAVLMVAWMNRESIQQTLNSGEAHYWSRSRQELWHKGATSGHTQTLRSIRYDCDADVLLLTIEQRGDIACHTGARSCFYEGGDQRSDGGSNALSPPADACTELFRVIESRRDNPEEGSYTNKLLEGGDNKILKKIGEESAEFVMACKDDNPEEIAGEAADILFHMQVALAHHGVSWRQVQEVLAARRGAPRRH

SEQ ID NO: 21512 - protein, 420 aa, Synechococcus sp. WH 8102
MVDAADSKSAGHWSWGFKSPGSHPEAVMNTYNRFPLTLVRGRGCWVWDDQGRRHLDAVAGIATDTLGHSDRALRRSLGRQLRRLQHVSNLYRIPEQDALATWLVQHSCADSVFFCNSGAEANEAAIKLARKHGHLKRGIDRPRILTASASFHGRTLAAVSATGQPRYHQGFEPMVEGFDYFPYNDIHAFESLLERHEANGPAVAAVLLEPLQGEGGVHPGDAGFFQRLRHLCSERNILLILDEVQVGMGRSGRLWGYEQLGIEPDAFTLAKGLGGGHAIGALLVNAKADVFEPGDHASTFGGNPFACTAGLTVAQEIQRRGLLRNVEERGQQLQQGIQGLVARYPQLLQGVRGWGLLQGLVLHQDCGVTAPQLAKAAIEQRLLLVAAGATVLRMVPPLVISANEVRQLLRRLDATLAELV

SEQ ID NO: 21513 - protein, 232 aa, Synechococcus sp. WH 8102
MTTIDWIWILHPALAVVLVYPLLGVVVRLAWQTRQRRLARVKHPVTVGRDHSDLGRWLAAAVVLIVLVALTVVIGTKTTPAEFAGGGRRAAQLLMVLVGTVASLVALLRCKAAPLRLAFSLITWIGVLSLGAQPEVWRLSDNPFSAAFWQSHYWSGVGVTGLMLFSLGAKPEILKNQRLRRLHITASVLAAVLFLGQAISGSRDLLEIPLSWQKPAVYSCDFAARECPSVPV

SEQ ID NO: 21514 - protein, 212 aa, Synechococcus sp. WH 8102
MAEPEALQNLSPHQWWGLIHPALIILFVYPVVGATIRLGILARERRLEINPIADTVPLEHAQHGSWVTGGVVVAVLIGLSHSLAGADLGLRLLLGFVVLIGYISLLRSRLIWQRLLAGAISWGGMLILGLQPTVERLSDQPWTGLFWQSHFWMGWILTGLLLSSTAIHPLIGRSTRIRRWHVATNVLVALLLAMQAISGSRDLVISGLLTLH

SEQ ID NO: 21515 - protein, 428 aa, Synechococcus sp. WH 8102
MNTSRSQAIFGAAQGLMPGGVSSPVRAFKSVGGQPIVFDRVKGPYAWDVDGNKYIDYIGSWGPAICGHAHPEVISALQEAIEKGTSFGAPCALENTLAEMVIDAVPSVEMVRFVNSGTEACMAVLRLMRAFTGRDKVIKFEGCYHGHADMFLVKAGSGVATLGLPDSPGVPRSTTANTLTAPYNDLEAVKALFAENPDAIAGVILEPIVGNAGFIQPEPGFLEGLRELTKEHGALLVFDEVMTGFRISYGGAQAHFGVTPDLTTMGKVIGGGLPVGAYGGRADIMGMVAPAGPMYQAGTLSGNPLAMTAGIKTLELLKQPGSYEKLTATTEKLIAGIKEAATAAGLPFTGGSVSAMFGFFLCEGPVRNFEDAKATDSERFGKLHRAMLERGVYLAPSAFEAGFTSLAHSEADIEATVNAFRESFAEVA

SEQ ID NO: 21516 - protein, 173 aa, Synechococcus sp. WH 8102
MPRSNRNDNFIDKSFTVMADLIVKLLPINARSKEAYVYYRDGLSAQNDGDYAEALENYDEALKLEDNPTDRGETLKNMAIIYMSNGEEERAIETYRRALDENSNQPSCLKNMGLIFEKWGRIAEEDGRQDDADRWFDQAAEAWTQAVRLNPGGYLDIENWLKSTGRSNVDVYF

SEQ ID NO: 21517 - protein, 402 aa, Synechococcus sp. WH 8102
MAKRSLASLNAGDLSGKRVLVRVDFNVPLNEAGAITDDTRIRAALPTINDLIGKGAKVILSAHFGRPKGQVNDAMRLTPVAARLSELLGKPVAKTDSCIGPDAEAKVNAMADGDVVLLENVRFFAEEEKNDAGFAEKLAGLAEVYVNDAFGAAHRAHASTEGVTKFLKPAVAGFLMEKELQYLQGAVDEPKRPLAAIVGGSKVSSKIGVLEALIDKCDKVLIGGGMIFTFYKARGLSVGKSLVEEDKLELAKELEAKAKAKGVELLLPTDVVLADNFAPDANSQVADVTAIPDGWMGLDIGPDAVKVFQDALGDCQTVIWNGPMGVFEFEKFATGTNAIATTLAELSGKGCCTIIGGGDSVAAVEKAGLADKMSHISTGGGASLELLEGKVLPGVAALNDAA

SEQ ID NO: 21518 - protein, 280 aa, Synechococcus sp. WH 8102
MGGWIDEEHRGVRYGLAGDVLVEETSPFQRISVIRSERYGKGLLLDGCWMTAEQQERHYHEALVHPALCSAEAIERVLVIGGGDGGTARECLRYPEVIHLDLVEIDGRVVELSQEHLPGIGGAVWSDSRCQLTVGDGIAWAANAPDQSYDVVLVDGSDPAGPAEGLFNRAFFEHCRRILKPGGVFATQSESPEAFREVHVAMVRLLREVFGHADPLYGWVPMYPSGWWSWTFAAVDGPRYRTVQPARAALVAEGCEIWSPRWQQGALDAVPAFIARELAP

SEQ ID NO: 21519 - protein, 459 aa, Prochlorococcus marinus str. MIT 9313
MLPENFLLSELRKPVISGLTRPEAWRRKQLKQIEVLIEKHQDEVLDALATDLGKPPTEALFELIALRGELKLAQRQLSRWMQPRHVQVPLAHQPGQAEVILDPLGCVLIIGPWNYPFSLTLQPLISALAAGNTAVLKPSEHAPATSRLIAHVIPQHFSSEVIQVIEGDGAIAAALIKQPFDHIFFTGSGAIGQKVMAAAAEHLTPVTLELGGKSPAIVIDGADLSVTARRLVWGKGLNAGQTCIAPDHLLIQEQLKQPLLQAMKGAITELYGGDPLRSPHLAKIINDRHFQRLQHLLDQAKQRGKVLSGGQIDPDQRRIAPTLIDVDKRDDPLMEEELFGPLLPVISVQSLHEALAEVRQQPKPLALYLFGGTHADQQQLLNTTSSGGVCFNDVVMHVGIPELPFGGVGASGMGRYHGLAGFETFSHQKSVLRRPFWLDLKLRYPPYKANLALLKKVLG

SEQ ID NO: 21520 - protein, 328 aa, Prochlorococcus marinus str. MIT 9313
MSRIYEDNSQAIGNTPLVKLHAVSKNAKATVLAKIEGRNPAYSVKCRIGANMIWDAEKRGLLSKERTIIEPTSGNTGIALAYTAAARGYKLILTMPESMSLERRRVMAVLGAELILTEAAKGMPGAIAKAKEIAESDPQKYFMPGQFENPANPDIHSKTTGPEIWNDCDGAIDVLVSGVGTGGTITGVSRYIKQEKGKAIISVAVEPTHSPVISQTLNGEEVKPGPHKIQGIGAGFIPKNLDLSLVDRVEQVSNDESIAMALRLANEEGLLVGISSGAAVAAAIRLAEQPEFAGKTIVVVLPDMAERYLSSVMFESVPTGIIQAPVAA

SEQ ID NO: 21521 - protein, 127 aa, Prochlorococcus marinus str. MIT 9313
MLNATARRGMSKAPQRVERPWGWYEDLLEGEGYKVKRFLVFAGQQLSLQRHQHRSENWTVVSGQGQLFCKNTWHDAQAGTTLYIPLGVLHRARGGQSDLVVIEVQHGQLLQESDIERLEDDYGRVIS

SEQ ID NO: 21522 - protein, 387 aa, Prochlorococcus marinus str. MIT 9313
MNIQLGRTKVVRRAYGIDETALVPGGRTVDPEITDTCWNLAGIEREIPIIASAMDSVVNVDMAVALSRLGALGVMNLEGVQTRYKDPNPVLDRISSIGNDAFVPLMQEIYSKPVQEALIYQRIKEIKNQGGIAAVSGTPVAAMRFSKTIAEAGADLFFVQATVVSTEHIGPEGQQTLDLEALCQGMGVPVVMGNCVTYEVALKLMRAGAAGVMVGIGPGAACTSRGVLGVGIPQATAVADCAAAREDYERESGRYVPIVADGGIITGGDVCKCIACGADAVMIGSPIARALEAPGRGFHWGMATPSPVLPRGTRIKVGSTGSLERILRGPALLDDGTHNLLGALKTSMGTLGARTIKEMQQVEVVIAPSLLTEGKVYQKAQQLGMGK

SEQ ID NO: 21523 - protein, 428 aa, Prochlorococcus marinus str. MIT 9313
MNTTRSQAIFSAAQRLMPGGVSSPVRAFRSVGGQPIVFDRVKGAYAWDVDGNRFIDYIGSWGPAICGHAHPEVIVALQDALEKGTSFGAPCELENQLAEMVIDAVPSVEMVRFVNSGTEACMSVLRLMRAFTGRDKLIKFEGCYHGHADMFLVKAGSGVATLGLPDSPGVPRSTTSNTLTAPYNDLEAVKELFAENPDAISGVILEPVVGNAGFITPEPGFLEGLRELTREHGALLVFDEVMSGFRISYGGAQARFGVTPDLTTMGKVIGGGLPVGAYGGRAEIMEMVAPAGPMYQAGTLSGNPLAMTAGIKTLELLKQEGTYERLESTTERLIKGILEAAKAAEVPITGNSIGAMFGFFLCEGPVRNFEDAKATDTELFGKLHRAMLERGIYLAPSAFEAGFTSLAHSEADIETTLKAFRESFAAVA

SEQ ID NO: 21524 - protein, 280 aa, Prochlorococcus marinus str. MIT 9313
MAANLLAAGYELKVHSRSRAAEQNLALQGSRSCSSPAEAAADSQALLICVSDDEAVEEVLFGSQGAASMLSSGAVVVDFSTITPATSISMAERLADQGVTYLDAPVTGGTEGARAGTLTVLVGGNKQALARVQPLLEVIGERIHHFGSVGRGQQVKALNQVLVAGSYAALAEAIALGQQLGLPMQEVITALQHGAAGSWALKHRSTAMLEDHYPLGFKLALHHKDLGIALETAERAGLQLPITSQVKSMEANLIEHGHSEEDVSVLRRWFDQQQAESQPF

SEQ ID NO: 21525 - protein, 311 aa, Prochlorococcus marinus str. MIT 9313
MHHRPTLASKPYGGLSWKKVLGLLAMDSPSTTANGWIDEHHQGVRYGLQGRVLVDETSPYQRITVIDSSRYGKGLLLDGCWMTAEHQERHYHESLVHPALCSAAQLERVLVIGGGDGGTARECLRYQDVKHLDMVEIDRRVVELSQKHLPSLGSHAWSDPRLQLNLENGIAWVANATESSYDVILIDGSDPAGPAEGLFNQTFFEHCRRILRPGGVFATQSESPEAFRQVHIDTVRLIRQVFGYADPLYGWVPMYPSGWWSWTFAAIDGPRYRNPLPARAAAISAGCEIWSPRWQQGAFEAIPAFIERELT

SEQ ID NO: 21526 - protein, 356 aa, Cordyceps bassiana
MSRANPPNNASASRKISFNVSEQYDIQDVVGEGAYGVVCSAIHKPSGQKVAIKKITPFDHSMFCLRTLREMKLLRYFDHENIISILDIQKPRGFDSFNEVYLIQELMETDMHRVIRTQVLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVLFRTLFADTSDLALDLLEKLLAFNPVKRITVEEALKHPYLEPYHDPEDEPTAPPIPEEFFDFDKHKDNLSKEQLKQLIYQEIMR

SEQ ID NO: 21527 - protein, 412 aa, Rhodococcus erythropolis
MTSDIVVIGGGVAGVSAVQSLRSEGYDGRLFLIGKERELPYDRTSLSKAVLAGDLADPPPLAPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTAAEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 21528 - protein, 329 aa, Rhodococcus erythropolis
MQMRAATYHKSGEASDVLSIIQCEKPEPGPGQVLVRVSFSAVNPSDVKTRSGKTPRPIDDFQIPHMDGCGRIVAVGPGVHEGRIGQRVWLWLAALGSRWGTAAEYTLVPANQAVALPDSASDELGACLGIPAMTAHECLLHAGPVTHKKVLIAGGAGAVGHFAIELARWAGATVIATVSTPDKAKLARQAGADFVVNYRDDDVADQITAFTNGVDIFVEVAIVDNWNIDLAVAAPGASIATYATDGRELSIPIRECMAAGLGLRFFLLYTHSRSALSLAAQSITDALAEQALTPLPHLTFPLDEIALAHEAVENGESRKVLLDLRDSDT

SEQ ID NO: 21529 - protein, 436 aa, Cunninghamella elegans [sequence omitted]

SEQ ID NO: 21530 - protein, 493 aa, Epifagus virginiana
MERWRFSLMVFNNKLKHEYGIKKSLDSVSSIENTIENKDSNSKPNIKGRAQNIRSCGGRDNYSYNNIIYLFGVEYNRNLIPNDTFLFRDNKGDSFYISFNIENHIFEIDINFSCLSELEIERYFYSYHGFDYFNFNNGSAIEDYLYNHYMYDTPSNNHITSCIESYLQSQICVNPSIISDSSDSYIFGCFDKRRTHNESRRSGIRNRAQSSYLTIRESFNNLDSTKKYKHLWVQCENCYGLNYKKFLKSKINLCEQCGYHFKMSSSERIEVLVDPDTWYPMDEDMSSLDPIEFHSEEEPYKDRIYSYQKRTGLTEAVQTGLGQLNGIPIAIGVMDFQFMGGSMGSVVGEKITRLIEYATNKILPLIIVCASGGARMQEGSLSLMQMAKISSALFDYQSNKKLLYVSILTSPTTGGVTASFGMLGDIIIAEPNSYIAFAGKRVIEQTLHKIVPEGSQAAEYLFQKGLFDLIIPRNLLKSVLGELFKLHAFFPLN

SEQ ID NO: 21531 - protein, 466 aa, Amycolatopsis mediterranei
MPTTPDDIQRLIADEDVEVIDVQFCDLPGVMQHFTVPAKAFTEEAYEEGLAFDGSSVRGFQSIHESDMLLLPDAATARIDPFRKAKTLALNFFVHDPFTREAYSRDPRNIARKAEQYIAEYGVADNVYFGPEAEFYIFDSIRFDSAEHASFHEIDSVEGWWNTGADEVGGNQGYKTKFKGGYFPVPPVDHFADLRDDIVRNLQGSGFEIERAHHEVGTAGQTEINYKFNTLLHAADDLQLFKYIVKNTVFAAGKTATFMPKPLAGDNGSGMHCHQSLWKDGQPLFHDESGYAGLSDTARHYIGGLLKHAPSLLAFTNPTVNSYHRLVPGFEAPVSLVYSQRNRSACVRIPITGNNPKAKRAEFRCPDSSGNPYLAFSAMMMAGLDGIRNKIEPPEPIDKDLYELPPEEAKDVKLVPGDLGTVLNTLEGGVFTPDVIETWISYKRENEIDPLRLRPHPYEFSLYYDV

SEQ ID NO: 21532 - protein, 213 aa, Malus x domestica
PIKAPILVEQGLFWDNEELISLLSKESEQNELQKPLQISPSLAGARREAVDWMLRVASHYSFSALSAVLAADYFDGFLSSLQLQVEKPWMTQLAAVACISLAAKVEETQVPLLLDFQVEDSKYVFEARTIKRMEILVLSTLQWKMNPVTPISFIDYITRRLGLKNHLCWEVLKRCELVLLSLISDSRFMSFLPSVVATAIMLHVVNNIEPCLL

SEQ ID NO: 21533 - protein, 382 aa, Solanum tuberosum
MASEVHAVVDAHSPPKTPTVCVTGAAGFIGSWLVMRLLERGYNVHATVRDPENQKKVKHLLELPKADTNLTLWKADLAVEGSFDEAIQGCQGVFHVATPMDFESKDPENEVIKPTVRGVLSIIESCAKANTVKRLVFTSSAGALDVQEDQKLFCDETSWSDLDFIYAKKMTGWMYFVSKILAEKAAMEEAKKNNIDLISIIPPLVVGPFITPTFPPSLITALSLITGNEAHYGIIKQGQYVHLDDLCEAHIFLYEHPKAEGRFICSSHHAIIYDVAKMVRQKWPEYYVPTEFKGIDKDLPIVSFSSKKLMDMGFLFKYTLEDMYKGAIETCRQKQLLPFSTQSTADNGRDKEAIPIPTENYSSGKENAPVANCTGKLTNGEI

SEQ ID NO: 21534 - protein, 382 aa, Solanum tuberosum
MASEVHSVVDAHSPPKTPTVCVTGAAGFIGSWLVMRLLERGYNVHATVRDPENQKKVKHLLELPKADTNLTLWKADLAVEGSFDEAIQGCQGVFHVATPMDFESKDPENEVIKPTVRGMLSIIESCAKANTVKRLVFTSSAGTLDVQEDQKLFYDETSWSDLDFIYAKKMTGWMYFVSKILAEKAAMKEAKKNNINFISIIPPLVVGPFITPTFPPSLITALSLITGNEAHYGIIKQGQYVHLDDLCEAHIFLYEHPKAEGRFICSSHHAIIYDVAKMVRQKWPEYYVPTEFKGIDKDLPIVSFSSKKLMDMGFQFKYTLEDMYKGAIETCRQKQLLPFSTRSSADNGKDKEAIPISTENYSSGKENAPVANCTGKFTNGEI

SEQ ID NO: 21535 - protein, 302 aa, Emericella nidulans
MTRTHPSSFQQLEKLGEGTYATVYKGRNCQTGEMVALKEIHLDSEEGTPSTAIREISLMKELHHDNILSLYDVVHTENKLMLVFEYMDQDLKKYMDTHGNHGQLEPAIVKSFAFQLLRGIAFCHDNRILHRDLKPQNLLINSKGQLKLADFGLARAFGIPVNTFSNEVVTLWYRAPDVLLGSRTYNTTIDIWSIGCIIAEMFTGRALFPGTTNEDQLQKIFRVMGTPSERTWPGVSQFPEYKSDFPVYPPQDLRQVVPRIDPYGLDLLRCMLRLQPDLRISAVDALRHPWFNDVPGAQPVPV

SEQ ID NO: 21536 - protein, 475 aa, Zymomonas mobilis
MTEGLFPRGRKVRVVSTLGPASSTAEQIRDRFLAGADVFRINMSHGTHDEKKVIVDNIRALEKEFNRPTTILFDLQGPKLRVGDFKEGKVQLKEGQTFTFDQDPTLGDETRVNLPHPEIFKALDKGHRLLLDDGKIVVRCVESSPTKIVTRVEVPGPLSDHKGFNVPDVVIPLAALTPKDRKDLDFALKEKADWVALSFVQRVEDVIEAKELIKGRAPLLVKLEKPAAIENLESILAATDAVMVARGDLGVECLPESVPPTQKRIVERSRQLGKPVVVATAMLESMIKAPAPTRAEVSDVANAIYEGADGIMLSAESAAGDWPHEAVNMMHRIASYVENAPGYIERVRFTPTPAEPTTVDALAENASKTAETVGAKAIIVFTETGKTAQRVSRARPVAPILSLTPDAEVARRLGLVWGAQPVQVSTVKTLDEAKKLAAETAKKYGFAKAGDKLVVVAGEPFGKAGTTNIVDVIEA

SEQ ID NO: 21537 - protein, 365 aa, Novosphingobium aromaticivorans
MDAYAAIIERQGGEFVLDNVSIEDPRDGEVLVKVAAAGMCHTDLTVRDQYYPTPLPAVLGHEGSGVVEKVGRGVTTVKPGDKVVLSFSYCGTCPSCLKGHQAYCPSLFPLNFMGRRLDGSTPITRNGQEVNACFFGQSSFATYSIASENNCVKVADDAQIELLGPLGCGIQTGAGSIHNALCPEPGSSIAIFGVGSVGLSAVMAAKASGCLKIIAVDRNAGRLELARELGATDVIDANTVNAQEAIVAMTGGGADYAMDTTAIPAVLRSAVDSTHNMGETAVVGGAKLGTEFSLDMNNMLFGRKLRGVVEGSSTPQVFIPQLIAMQKAGLFPFEKLCTFYDLDQINQAVEDTEKTGKAIKAILKM

SEQ ID NO: 21538 - protein, 501 aa, Novosphingobium aromaticivorans
MATQLRSAENEYGIKSEYGHYIGGEWIAGDSGKTIDLLNPSTGKVLTKIQAGNAKDIERAIAAAKAAFPKWSQSLPGERQEILIEVARRLKARHSHYATLETLNNGKPMRESMYFDMPQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVQSYLRLATEEGAEVLTGGSRSDAADLADGNFIKPTVFTNVNNSMRIAQEEIFGPVTSVITWSDEDDMMKQANNTTYGLAGGVWTKDIARAHRIARKLETGTVWINRYYNLKANMPLGGYKQSGFGREFSHEVLNHYTQTKSVVVNLQEGRTGMFDQ

SEQ ID NO: 21539 - protein, 490 aa, Novosphingobium aromaticivorans
MGVTIPPLERSDFLTGQPLVDGTEICAGSTYAVTNPATGKTLANVVKLGAAQTRRAIESNSRALIDWRKRPAQERARLLHDWLALVRLHRHDLGLLMTAEQGKPLAEALGEVDYAASFIQWFAEEARRVYGEVIPASADRRIVVIRQPVGVAGAITPWNFPAAMITRKVAPALAAGCTVTLKPSELTPMTAFALAKLAREAGVPPGVFNVVCGDAPEIGSVLTSHPDVTKFTFTGSTAIGKLLTAQCAATLKRVSMELGGNAPLLVFDDADLDQAVEGAIASKFRNTGQTCVCANRILVQSGIHDRFVEALAARVSAFRVGNGLEGATDQGPLITASALAKVQGHVADAVAQGAQLVTGGKRHEAGELFFQPTVLTGARPAMRLADEETFGPVAPVFRFETEAEALALANATHSGLAAYAFTRDIDRAWRVSEGLETGMVGLNSGIVSTETAPFGGIKESGLGREGSRHGIEEFLEMKTISVGVRPESPV

SEQ ID NO: 21540 - protein, 479 aa, Novosphingobium aromaticivorans
MTQIEHWIGGTAVAATGGAYFDDLNPVDDSVYSRVPAGTAEDVNRAVENAHQAYLQHRDLPAAVREGWIAKAAEIMERDTAKFADVLVDEIGSPIAKAGFETRFAVSFLRAAIGVPRRIRGETIPSDTPGRFSMSLRQPVGVVAGITPFNVPLIKGIKQSAMALATGNAFVLLPSEAAPMIADLLAKLWKEAGVPDGLFNVVYGNGAEIGDVLTGHPKVASITFTGSSRVGKHIAEIAARNLKKYTLELGGKSPLVICADADLDKAVNAALFSIFMYQGQVCMGASRIYVERSIFDQFTKAFAAATGRANSGDLRDPTTMLGPIISERQRDRVRRHIDDARSKGAAVLAGGEWSGNSCAATILSGVTAEMTVFEEETFGPVTSLFPFDTLEEALELANNTEYGLSASIFTRDLDKALAFAQRAEAGMVHINAPTLHDEPHVPFGGTKASGFGREGTEADLEIMTEWKWVTIQSATEGGH

SEQ ID NO: 21541 - protein, 289 aa, Ribes nigrum
MIAGSIAGSIEHMAMYPVDTLKTRIQAIGSCSAQSAGLRQALGSILKVEGPAGLYRGIGAMGLGAGPAHAVYFSVYEMCKETFSHGDPSNSGAHAVSGVFATVASDAVITPMDVVKQRLQLQSSPYKGVVDCVRRVLVEEGIGAFYASYRTTVVMNAPFTAVHFATYEATKKGLLEVSPETANDENLLVHATAGAAAGALAAVVTTPLDVVKTQLQCQGVCGCDRFSSSSIQDVIGSIVKKNGYVGLMRGWIPRMLFHAPAAAICWSTYEASKTFFQKLNESNSNSSVT

SEQ ID NO: 21542 - protein, 1141 aa, Phaeosphaeria nodorum
MAGTEPIITQGIEPSSGESHSPPGERHVSATWGSKDGNISNAEWNDPEANKLPEKVAELEKKGEINQDGQRKKIVVVGLGMVGIAFIEKLMKYDVKRREYDVVVIGEEPHLAYNRVGLTSFFQHRLVENLYLNPKEWYSSMPEGSLNYHLNTMVTEIDSYNKTVKTSSGDTVPYDILVLATGSDALLPRHTPGHDAKGVFVYRTIEDLQNLIEFASSRKGTTGAVVGGGLLGLEAAKAMMDLEDFGQVRLIERNRWVLSRQLDGDAGGMVVEQVRALGLDVMLSKRVGKILTTEENAVKGVVFEDGEEMECSCISFAIGIKSRDELARKSGIKCADRGGGIVVGSDLTTSKPDIYAIGECASWENQTFGLIAPGVEQADVLAFNLTQAKAHAPRKFKSPDLSTKLKLLGVEVASFGDFFADRDGPKNMPGRQRAEKKEAGGINVKALTYKDPFQQVYKKYLFTMDGKYLLGGMMIGDTKDYVKLVPMVKNQKPLDMPPSELIIGASKGDDDGSDLTDDTQICSCHNVTKGDVVNSVKDGTCKSIGDVKSCTKAGTGCGGCMPLVQTIFNKTMASMGNEVKNHVCPHFEHSRADLFNIIYVKELKDFSAVMKACGKEPESLGCEACKPTIGSIIASLYNKHLLDLDRRGLQETNDRFLANIQRNGTFSVVPRVSGGEITPEKLIVIGMVAKKYNLYTKITGGQRIDMFGAKKHQLPEIWQELIDGGMESGHAYAKSLRTVKSCVGTTWCRFGIGDSVGMAVRLEERYKSIRGPHKIKGGVSGCVRECAEAQNKDFGLIATEKGFNIFVGGNGGAKPRHSELLAKDVPPDDVVPILDRYLSFYIRTADKLQRTARWMENLPGGIKYLQEVILEDKLGICADLEKQMEDLVGTFFCEWTEVLKDPKKRSWFSQFANTSETISDTIEPTQERGQERPSYWPKDSITEDFRGHKWTELSWQPLVKAEEFKDTDTGDSKAIKRGDTQLAVFKVRGKYYCTQQMCPHKRAFVLSDGLLGEDLASNKLWVSCPYHKRNYELSGDNAGKCANDESVNIAVFPIEERGDGYLYVKLPSVEELDSVLGTSKFVIKKSETEDPFVALDKKLERLALKGRKGTQVSHLENGLGEKGKAAMILAGGERGAGGLDW

SEQ ID NO: 21543 - protein, 442 aa, Thermotoga neapolitana
MIGYQIYVRSFRDGNFDGVGDFKGLKGAISYLKELGVDFVWLMPVFSSISFHGYDVVDFYSFKAEYGDEKDFREMIEAFHDNGIKVVLDLPIHHTGFLHTWFQKALKGDPHYRDYYVWASEKTDLDERREWDNERIWHPLEDGRFYRGLFGPLSPDLNYDNPQVFEEMKKVVYHLLEMGVDGFRFDAAKHMRDTLEQNVRFWRYFLSDIEGIFLAEIWAESKVVDEHGRIFGYMLNFDTSHCIKEAVWKENFKVLIESIERALVGKDYLPVNFTSNHDMSRLASFEGGLSEEKVKLSLSILFTLPGVPLIFYGDELGMKGIYRKPNTEVVLDPFPWSENISLEGQTFWKWPAYNSPFSGVSVEYQKKKRDSILLHIMKWTGFRKENHWLDRANIEFLCKEEKLLHVYRLVDEGRSLKVIHNLSNGEMVFEGVRVQPYSTEVI

SEQ ID NO: 21544 - protein, 472 aa, Thermotoga neapolitana
MYPIPSWVYDSVVYQIFPDRFFIGKGKTVEDKKDLYLKRGGTIEKWGVPPRKLPGAQHVKVFYGGDLWGIAEKIDYLEELGVNAVYLTPIFLSDTNHKYDTIDYFKIDPQFGGKRAFVHLLKVLHSRNIKLILDGVFNHVGSQHPWFKKARKKDPEYVNRFFLYRDRHRSWFDVGSLPELNVEVEEVREYILKVVQHYLEVGVDGWRLDCGHDLGPLVNLWINMKVKEFSSEKYLVSEIWTYPAGWEMVDGLMNYNFRSLVLSYVNGETDSIGTELERAYRETKNIFGCWNMLDSHDTPRLATTVPVKDLRKLAIVLQFTYPGVPLVYYGTEIGLTGGEDPECRATMEWNREKWDMELFEFYKKMIRFRRTDPGLRFGEFILLKEKPLAFMRKAPHPLQDTIVVVNPEEEKNVVLSLPDGKIMNATPLFDIFTGEKFHVDGGVVKVPVGRRSFRILKPIDLRVGRYRLYKRV

SEQ ID NO: 21545 - protein, 349 aa, Solanum tuberosum
MTTRGTTQPLLDQLHQTQHTVGLGRKRFRRSKSTPVGEIAPVEINEIKNDQSLLRSKLILDKLHPSIRKVIVYLIIYLGIGTICFYFVRSKIKGKKIDGVLDSLYFCVVTMTTVGYGDLVPNSATTKLLACVFVFSGMALVGLVLSKAADYLVEKQETLLIKALHMGCRVGPSEILEEIETNKVRYKCFMVAAFLIMLIIIGTVVLTRVEKFDTVDAFYCVCATITTLGYGDKSFSTKAGRIFSIFWILTSTLCLGRFFLYVAEWNTEKRQREIVKWVLSRRTTNVDLEEADLDDDGVVGAAEFVIYKLKEMGKINQHDVAAVLKEFESLDVDQSGTLSTADLTLAQSS

SEQ ID NO: 21546 - protein, 426 aa, Mycoplasma gallisepticum
MIKLTFNLIKGLDYKKLDKNYQAKLDEIFSQLKNKKTPSANMLGWIDYVDQDHTKIYKSIDNKITEWDKLKVTDVVVIGIGGSFTGIKAILDVVAYLPSEQKRQIHFIRSLSENSFLKILEEVKDKNWGIVVISKSGTTLEPSVGFKLFREALYKQYGEQAQKRIVAITDPKKGVLHDIAVKNKYEMLPIYSDIGGRFSTITPSGLLVAGLVGADYKQLIEGAKKAKADLFASSELKKNSAYTYAALRHYLYTEMKKDVEIAITYEEQHEYLMLQHRQLFGESEGKSLNSLFPTYSVFTTDLHSMGQLYQDGKKIFFETVFSFEKANKNKLKLKNSEFNNDDQLDYLTKKSVNQLNYVACEATKQAHASAGVPIIEIDVKENSAYGFGYLYFWLCVATSVSALLLGHDPYNQPGVENYKQRMFKLL

SEQ ID NO: 21547 - protein, 214 aa, Mycoplasma gallisepticum
MIRLIFLGAPGTGKGTISSYLKEQHGFFHISSGDLFRFYAKEEKTALAEEIKSYINNGLYVPDELTNRTVADFYHKNQSQDKIIFDGYPRTLNQCEYIDEIIKFTHVILLQPTDWDMIINRLSLRRSCPQCKRIYNINSVDFKPKVANLCDLCKVELIHRKDDDPSVVSTRINVYNEQTKPVIEYYKKKNLLHVVDANKSFEELYKLVLEIVNK

SEQ ID NO: 21548 - protein, 355 aa, Sclerotinia sclerotiorum
MASRAPNPSSGSRKISFNVSEQYDIQDVVGEGAYGVVCSALHKPSGQKVAIKKITPFDHSMFCLRTLREMKLLRYFNHENIISILDIQKPRNYESFTEVYPIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTMFPKTSDLALDLLEKLLAFNPVKRITVEEALKHPYLEPYHDPEDEPTANPIPEEFFDFDKNKDNLTKEQLKQLIYHEIMR

SEQ ID NO: 21549 - protein, 101 aa, Prochlorococcus marinus subsp. pastoris str. CCMP1986
MSQNYLHALDLTLGILLSFLTLVFLIRLILTWYPKVDLNKGFWLLIAIPTSSILNVTRKLIPPIGGVDVGPVIWIGIISFLREILVGQQGLIKLAILKSIS

SEQ ID NO: 21550 - protein, 486 aa, Prochlorococcus marinus subsp. pastoris str. CCMP1986
MSSNELDEIKFGTDGWRGIIGFDFNLSNLSRVVVASCQELYYQYFEETNSKKILIGYDRRFMANEFAKEIASFVKGCGFEPILSTSYVPTPSCSLYAKKFMFLGCLVITASHNPYNWLGLKIKSFKGCSVDESFTKEVEKRLLLGNSIERLEGAYEKVDIKKFHLDQIKSNFNIDFIANNLKKMNLHIFVDSMHGSAANCLSQIFEGYDSKIFTEIRADYDPLFGGNPPEPLLKYLDNLTKTLTKTSKNGIKTLGIIFDGDGDRIAVIDEKGRFCSTQVLLPFFISYLGEKNKNLYPVLKTVSGSDIISNIAKNQDREVFELPVGFKYIAKKMIKEKIFIGGEESGGVGFGDFMPERDALYAAMILLNGIAEKSKYLYETLDQIQENFGPSFYRRIDVKFPNQSEKEILEKYIKNNIPSKICGYSIKSVSNIDGIKLRMDNNFWLLFRFSGTEPLLRLYCEAKSENDLNEVLEWSQKYINKVKNIK

SEQ ID NO: 21551 - protein, 433 aa, Prochlorococcus marinus subsp. pastoris str. CCMP1986
MTDILKTTYSEEVFSSALELMPGGVSSPVRAFKSVGGQPIVFDRVKGPYAWDIDGNRYIDYIGSWGPAICGHAHPEVITALQEAIEKGTSFGAPCVLENKLAEMVIDAVPSVEMVRFVNSGTEACMAVLRLMRAFTGRDKVIKFDGCYHGHADMFLVKAGSGVATLGLPDSPGVPRTTTANTLTAPYNDLEAVKKLFSENPDAISGVILEPIVGNAGFITPEPGFLEGLRELTTENGSLLVFDEVMTGFRISYGGAQEKFGVTPDLTTLGKVIGGGLPVGAYGGKKEIMSMVAPSGPVYQAGTLSGNPLAMTAGIKTLELLKQEGTYEKLESTTSRLIEGIIQSAENNGIAINGGSVSAMFGFFLCEGPVRNFEEAKTNNSELFGKLHREMLKRGVYLAPSPFEAGFTSLAHSEEEIDRTLEAFDQSFSVIKN

SEQ ID NO: 21552 - protein, 442 aa, Prochlorococcus marinus subsp. pastoris str. CCMP1986
MSNQKFETLQLHAGQEPDPTTNSRAVPIYQTSSYVFDNAEHGANLFGLKEFGNIYTRLMNPTTDVFEKRMAALEGGMAALATSSGQAAQFLAIVNCMKAGDNFVSTSFLYGGTYNQFKVQFPRLGIEVKFAEGDSIDSFKDKIDDKTKAIYVESMGNPRFNIPDFEGLSNLAKENGIPLIVDNTLGAGGALIKPIDFGADIVVESATKWIGGHGTSIGGVIVDAGTFDWGNGKFPLMSEPSDAYHGLVHWDAFGFGSDICKSLGVPDNRNIAFALRARLECLRDWGPAQSPFNSFLLLQGLETLSLRIERQTSNALELAKWLDSNPQVTSVNFPGLESDPYYSRAKKYTTGRGMGCMLMFSLNGGYENAVKFIDSLELASHLANVGDSKTLVIHPASTTHQQLSEEEQLSAGVTPTMVRVSVGIEHIDDIKADFEQALSKIS

SEQ ID NO: 21553 - protein, 417 aa, Prochlorococcus marinus subsp. pastoris str. CCMP1986
MELVDAPHSKCGTFGYVGSSPTAPTLMNTYTRFDISFKKGNGCWLWDEKGKKYLDAVAGIATCSLGHSNRILRKKLSAQLKKVQHISNLYKIEEQEELSKYLTKQSCAESVFFCNSGAEANESAIKLIKKYGNTVHKGKESFILAAESSFHGRTLATLSATGQPKYQKGFEPMVKGFKFFKYNDIASVKKLFEELKANNQKASGILVEPIQGEGGVIPGDKKFFKELREICNKYNSLLILDEVQSGVGRTGKMWGYENLEIEPDGFTLAKGLGGGHAIGALLVQKKANIFTPGDHASTFGGNPFACRAAITVLEEIKRRKILKNVLERGNQLNEGFTKISAKFPKIISGIRGLGLIQGLVINDSYTDAKTITLKAFDKGLLLVPAGGNVVRFVPPLIISRNEINILLKKLDLIFEEM

SEQ ID NO: 21554 - protein, 331 aa, Prochlorococcus marinus subsp. pastoris str. CCMP1986
MEKVLVTGASGFIAIHCIHELIKAGYLVKGSLRNMNREDEVRKSLDKDSDNHKLEFCKLDLLDNEGWDEAASDCDYLLHVASPFTIEEPKKESILIKPAVEGTLRALNASKNSSKVKKVVLTSSMAAIAYGHDKQLCSPEDWTDTTKNVGAYVKSKTIAEKAAWDFIHNDTEHSFSMTTIHPGMVFGPLLSDDNDGASAELISKMINGKFPALPDAYFTVVDVRDVAKLHVESLRKNQSDNKRIIATSPQGINIMEISNILRKNGYKKAPQNFIPTKMINSLAPFNKEMKSMAAMVNRGSYGADITETISIYNWEPISLEKTLIDMGNSIK

SEQ ID NO: 21555 - protein, 121 aa, Prochlorococcus marinus subsp. pastoris str. CCMP1986
MDSNSLSAFDNYVETKELTGYEPVLGGELTEKAVWVDESRCIGCRYCAHVATNTFVVDDDYGRSRAIRQDGDNLETVQEAIDTCPVDCIHWVEFGNLEDLESSLDRDMFQSLGKLPRMNKH

SEQ ID NO: 21556 - protein, 51 aa, Orobanche cernua var. cumana
SPNTDGIHITRTSNINILDSQIKTGDDCISIVNGSRNVEVRSIVFGPGHGI

SEQ ID NO: 21557 - protein, 268 aa, Prunus persica
RATMIMRLKAKIQALEEQMSSVSEKSSKYGQIAAEEVPKSLYCLGIQLTGEWFRNSDLQRKTKDRKQIDMKLKDNNLYHFCVFSDNILATSVVVNSTSINSKSPDKIVFHLVTDEINYAAMKAWFSINSFRGVVIEVQKFADFTWLNASYVPVLKQLQDSETQSYYFSGNNDDGRTPIKFRNPKYLPMLNHLRFYIPEVFPALKKEVFLDDDVVVQKDVSDLFSIDLNGNVNGAVETCMETFHRYHKYLNYSHPLIRAHFDPDACGCA

SEQ ID NO: 21558 - protein, 146 aa, Hordeum vulgare subsp. spontaneum
MEFQGQHDNPANRVDEYGNPFPLAGGMGGAHAAPGTGGQFQARREEHKTRGILHRSGSSSSSSSSEDDGMGGRRKKGMKEKIKEKLPGGHKDNQQHMATGTGTGGAYGPGTGTGGAYGQQGHAGMAGTGEKKGIMDKIKEKLPGQH

SEQ ID NO: 21559 - protein, 503 aa, Brassica napus
MAITVPRRQLFIGGQWTEPLRRQTLPVVNPATEDIIGYIPAATSEDVELAVEAARKALTRNKGNDWSKASGAVRARYLRAIAAKVTERKSELANLEAIDCGKPLDEAAWDMDDVAGCFEYYADLAQGLDSKQKAPLSLPLDTFKGYVLKEPIGVVGLITPWNYPLLMAVWKVAPALAAGCTAILKPSELASVTCLELADICREVGLPPGVLNILTGLGTEAGAPLASHPHVDKIVFTGSTATGSNIMTSAAKLVKPVSLELGGKSPIIVFDDVKIDKAVEWTMFGCFWTNGQICSATSRLLVHEKIADEFLDKLVKWTKNIKISDPFEEGCRLGPVVSKGQYERVVKFVSNARKEGATVLCGGARPGHLKKGYFVEPAIISNVTTSMEIWRDEVFGPVLCVKTFSTEDEAIQLANDSQYGLAGAVLSNDLERCDRVSKAFEAGIVWVNCSQPCFCQAPWGGTKRSGFGRELGEWGLENYLSVKQVTQYISNEPWGWYKSPSKL

SEQ ID NO: 21560 - protein, 151 aa, Rhizobium etli
LLENVVLNERREPDFDDGSLTENTRCAYPMHFIPNASETGRAGHPKTIIMLTADAFGVMPPIARLTPDQAMYHFLSGYTAKVAGTEKGVVEPEATFSTCFGAPFMPRHPAEYGNLLKELISRHGVECWLVNTGWTGGAYGTGKRMPIKATR

SEQ ID NO: 21561 - protein, 213 aa, Populus tremula
CDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNIQAMISAFECVHDGWGVAVLVGVPSKDDEFKTHPMNLLNERTLKGTFFGNY

SEQ ID NO: 21562 - protein, 213 aa, Populus tremula
CDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELIAPKDHDKPVQQVIIEMTDGGVDRSIECTGNVQAMISAFECVHDGWGVAVLVGVPSKDDEFKTHPMNLLNERTLKGTFFGNY

SEQ ID NO: 21563 - protein, 213 aa, Populus tremula
CDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVAELINPKDHDKPVQQVIIEMTDGGVDRSIECTGNVQAMISAFECVHDGWDVAVLVGVPSKDDEFKTHPMNLLNERTLKGTFFGNY

SEQ ID NO: 21564 - protein, 213 aa, Populus tremula
CDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVAELINPKDHDKPVQQVIIEMTDGGVDRSIECTGNVQAMISAFECVHDGWGVAVLVGVPSKDDEFKTHPMNLLNERTLKGTFFGNY

SEQ ID NO: 21565 - protein, 213 aa, Populus tremula
CDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECVHDGWGVAVLVGVPSKDDEFKTHPMNLLNERTLKGTFFGNY

SEQ ID NO: 21566 - protein, 213 aa, Populus tremula
CDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKAHPMNLLNERTLKGTFFGNY

SEQ ID NO: 21567 - protein, 213 aa, Populus tremula
CDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVGRSIECTGNVQAMISAFECVHDGWGVAVLVGVPSKDDEFKTHSMNLLNERTLKGTFFGNY

SEQ ID NO: 21568 - protein, 213 aa, Populus alba
CDLLRINTDRGVMLTDGKSRFSINGKPIYHFLGGSTFSEYTVCHIGTVAKINPAAPLDKVCILSCGISTGLGAAMNVAKPQKGHTVAVFGLGAVGLAAAEGARLSGASRIIGVDLNPSRFKEAKKFGVTELINPKDHDKPVQQVIIEMTDGGVGRSIECTGNVQAMISAFECVHDGWGVAVLVGVPSKDDEFKTHPMNLLNERTLKGTFFGNY

SEQ ID NO: 21569 - protein, 213 aa, Populus alba
CDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEARKFGVTELINPKDHDKPVQQVIIEMTDGGVDRSIECTGNVQAMISAFECVHDGWGVAVLVGVPSKDDEFKTHPMNLLNERTLKGTFFGNY

SEQ ID NO: 21570 - protein, 213 aa, Populus alba
CDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNY

SEQ ID NO: 21571 - protein, 213 aa, Populus alba
CDLLRINTDRGVMLTDGKSRFSINGRPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNY

SEQ ID NO: 21572 - protein, 213 aa, Populus alba
CDLLRINTDRGVMLTDGKSRFSINGKPIYHFLGGSTFSEYTVCHIGTVAKINPAAPLDKVCVLSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNY

SEQ ID NO: 21573 - protein, 213 aa, Populus alba
CDLLRINTDRGVMLTDGKSRFSINGKPIYHFLGGSTFSEYTVCHIGTVAKINPAAPLDKVCILSCGISTGLGAAMNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNY

SEQ ID NO: 21574 - protein, 213 aa, Populus nigra
CDLLRINTDRGVMLTDGKSRFSINGKPIYHFLGGSTFSEYTVCHIETVAKINPAAPLDKVCILSCGISTGLGAALNVAKPKKGHTVAVFGLGAVGLAAAEGARLSGASRIIGVDLNPSRFKEAMKFGVTELINPKDHDKPVQQVIIEMTDGGVDRSIECTGNVQAMISAFECVHDGWGVAVLVGVPSKDDEFKTHPMNLLNERTLKGTFFGNY

SEQ ID NO: 21575 - protein, 213 aa, Populus nigra
CDLLRINTDRGVMLTDGKSRFSINGKPIYHFLGGSTFSEYTVCHIGTVAKINPAAPLDKVCILSCGISTGLGAALNVAKPKKGHTVAVFGLGAVGLAAAEGARLSGASRIIGVDLNPSRFKEAKKFGVTELINPKDHDKPAQQVIIEMTDGGVDRSIECTGNVQAMISAFECVHDGWGVAVLVGVPSKDDEFKTHPMNLLNERTLKGTFFGNY

SEQ ID NO: 21576 - protein, 213 aa, Populus nigra
CDLLRINTDRGVMLTDGKSRFSINGKPIYHFLGGSTFSEYTVCHIGTVAKINPAAPLDKVCILSCGISTGLGAALNVAKPKKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNY

SEQ ID NO: 21577 - protein, 417 aa, Azospirillum brasilense
MERILGGMSLPDLGTFALVNDRLDRLSDYPFTRLAALLSGVTPRANAEPIMMSVGEPQHQPPAIIDETLRANAHLWGKYPPVGGTPEFREAVGAWLARRYALPDGLFDAEKSVLPVSGTREALFLLALLAVPPSKAGRQPAVLMPNPFYAPYEGAALLAGAESVFLPSTRETGFLPDLDALTPELLERTALFYLCTPANPQGAAADAAYLERAIGLARRYGFILAVDECYAEIYLDKPPVGALQVASGLAHDGKPWANILVFHSLSKRSSAAGLRSGFVAGDPELMSRFTRLRSYSNAGMPLPVLAASAALWRDEAHVEENRALYRAKFDAAEASLKGRYGYYRPDGGFFLWLEVGDGEEATRRLWAEGGIRVLPGAYLTRCNPGEANPGAPFIRIALVNDAETVAHACGTIARILG

SEQ ID NO: 21578 - protein, 385 aa, Populus alba
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 21579 - protein, 385 aa, Populus alba
MAIDCIKTMPSITTPHHHPKDQDQCKDDGKSFVFDAQVLRHQTNIPQQFIWPDHEKPNTNAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEESSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYRSCLHRAVVNSQTPRKSLAFFLCPKNDKMVTPPHELVDTCNPRIYPDFTWPMLLEFTQKHYRADMKTLEVFTNWLHQRSLS

SEQ ID NO: 21580 - protein, 360 aa, Catharanthus roseus
MAKSPEVEHPVKAFGWAARDTSGHLSPFHFSRRATGEHDVQFKVLYCGICHSDLHMIKNEWGFTKYPIVPGHEIVGIVTEVGSKVEKFKVGDKVGVGCLVGSCRKCDMCTKDLENYCPGQILTYSATYTDGTTTYGGYSDLMVADEHFVIRWPENLPMDIGAPLLCAGITTYSPLRYFGLDKPGTHVGVVGLGGLGHVAVKFAKAFGAKVTVISTSESKKQEALEKLGADSFLVSRDPEQMKAAAASLDGIIDTVSAIHPIMPLLSILKSHGKLILVGAPEKPLELPSFPLIAGRKIIAGSAIGGLKETQEMIDFAAKHNVLPDVELVSMDYVNTAMERLLKADVKYRFVIDVANTLKSA

SEQ ID NO: 21581 - protein, 151 aa, Arabidopsis lyrata subsp. lyrata
MAPFPLSLIFGKNKRRDDIRYRQKPTLKGVMTAFFATQAAIFLLLLAGLSLTGTAVALIASMPVFLVFSPVLVPAGIATTILAGGLMAGGTSGVSGLTILMWLYKQFTGRDLPKIPGLNPGGGAAAGGAAPAAPAAPAAKPAAKPAAKPGG

SEQ ID NO: 21582 - protein, 108 aa, Arabis drummondii
MTAFLATTAAVFLLLLAGLSLTGTALALVASMPLFLLFSPVLVPAGITTTVLASGLMAGGTSGVTALNIIMWLYKQFTGKDPPKIPGLTPAGGAASAKKPAAKPAASG

SEQ ID NO: 21583 - protein, 346 aa, Streptomyces griseus
MTTVAAYAAPRAKAPLERTTIERRPVGEFDILIDIKFAGICHSDIHQARDGWGEGIFPMVPGHEIAGIVAETGPGVTRFKVGDRVGVGCMVDSCGTCDACLMGREQHCAEGNTQTYNALDRNGEPTYGGYSTHLVVTEKFALSIPEGIALDEAAPLLCAGITTYSPLRRWGAGPGKKVAVVGLGGLGHMAVKIAHALGAEVTVLSQSLRKKDDGLKLGADHYYATGDPRTFEELAGTFDVILSTVSAPLDFGAYLALLRTEGTLVNVGAPEEPVSLNLFSLILGNRSIAGSAIGGIEETQEMLDFCAVHGLGAEIEVIGAGQVNEAYERVLASDVRYRFVIDTATI

SEQ ID NO: 21584 - protein, 371 aa, Arabidopsis thaliana
MSLLDLPDLTLDCILEKLSPSELCAMTSVCSELRDKGSSSYLAPIDSVMYWYSNLENGKFWFPAQVYNRENGHVGFMMSCYDAKIRYDFKTDTFQARYSAHGRRAAEEKVTWQRLRPSQDDTKSRDLHVSDCLHGLRPGDHFEIQWRRTKEFPYGWWFGIVGHLQNCDGVQNCRCDSDGNNLISVFIFWSETVDSLIKENKMFNGILLAMAENVVMEFRQFRPESPWRRTVIKRKDHRETGNEENGFYGGISELLFEFEKFPETSLRRKFIGGDLRRNTEAPISQFRDELASAIVSVHPIKMNGGPSGFNNAPVTKAFVIATALFTVFFGIRGGSSKLGLSYQVISHLILLYFLLSFLIFKLFWVYRRMRI

SEQ ID NO: 21585 - protein, 452 aa, Clostridium kluyveri
FIMTSSEMTERVHAYGSKIFLQLSMGFGRSGAPGGLLTSQPVSASAVPNYWDPTVTCRELTTSEVEWIVEKFAEGAKIAHKAGFDGVEIHAVHEGYLLDQFTLSIFNRRTDKYGGDLRGRLQLPIEIVEPIKTEVGSNFPVGLRYSVKSCIKDWGQGGLAEEDYVEKARDLEEALEAPKILEAAGYDAFNADLGTPDPWYWAHPPLYQKDGLYLPYPKELKKVVKIPVMVAGKMGMPDVAEGALEDEAADMVTLGRPLLCDAYWPKKFLTGQIDRIRPCIGCHTGCMGRGFEGRPLSCTVNPAAGRERYYEVKPAAAPKKVMIVGGVAGMEAARITAMRGHKVSMYEGTKELGGQLFRLQFLISPIDDRRLLDWYRNEMKELKVKLVLDTNVTEEVVEKEKPDVVIIATGAKEIKLNLPGIEKDKVATVIEVLKGSKQVGENVLMVGGGLVA

SEQ ID NO: 21586 - protein, 475 aa, Ilex vomitoria
MSPQTETKASVGFKAGVKDYKLTYYTPDYDTKDTDILAAFRVSPQPGVPPEEAGAAVAAESSTGTWTTVWTDGLTSLDRYKGRCYQIEPVAGEENQFIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEALFKAQTETGEIKGHYLNATAGTCEEMMKRAIFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDVIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFAAMDTL

SEQ ID NO: 21587 - protein, 292 aa, Populus alba x Populus tremula
RIAAKLEMMEPCSSVKDRIGYSMITDAEEKGLIKAGESVLIEPTSGNTGIGLAFMAAAKGYRLIITMPASMSLERRMVLLAFGAELVLTDPARGMKGAVQKAEEISAKTPNSYILQQFENPANPKVHYDTTGPEIWKGSGGKVDAFVSGIGTGGTITGAGKYLKEQNPDIKLYGVEPVESAVLSGGKPGPHKIQGIGAGFIPGVLNVDLLDETVQISSEEAIETAKLLALKEGLLVGISSGAAAAAAIKIAKRPENAGKLIVAIFPSFGERYLSSVLFESVKKEAENMVFEP

SEQ ID NO: 21588 - protein, 141 aa, Populus alba x Populus tremula
YVGGGMGRTHRLETTFPRLAEPLGYVPKEDILYAVKAIVVTQRENGRRDDRKYSRMKYLISEWGIEKFRSVVEQYYGRKFEPSRELPEWEFKSYLGWHEQGDGGLFCGLHVDSGRIGGKMKATLRETIEKYNLDVRLTPNQ

SEQ ID NO: 21589 - protein, 282 aa, Hordeum vulgare
MAASRGTLLLATVLVILSLFVSPISGYWKASRTRTRRPSSRRSWSSGGATWYGSPYGAGSDGGACGYQSAVGQRPFSSMIAAGGSSFFKSGKGCGACYQVKCTGNKACSGRPVTVVITDSCPDGICASEDHFDMSGTAFGAMANRGMADRLRSAGQLRIHYARVPCKYNGMNIVFKVDAGSNPFYLSVLIMYQAGDGDLSAVDIMQGGCAPGHHNDHGQPWMAMKQSWGALWLLQSNNGKPLQAPFSFRLTSGSGKVLEVTNAIPSGWTAGTSYSSSVNYAS

SEQ ID NO: 21590 - protein, 391 aa, Chromobacterium violaceum ATCC 12472
MKFNKLSEQNLSGKRALIRVDMNVPLKNGVIGDDTRIRASLPTIEHCLKAGAAVLLMTHLGRPTEGEPKPEDSLAPVVARLSELLGKPVRLIADFHAGVELAPGEVAMLENVRLNKGEKKNNDELGRAYAALCDVFVHDAFGTAHRAEASTHAVAKFAPVACAGLLLSAELDALGKALQAPARPLVAIVAGSKVSTKLTILEALADKVDQLIVGGGIANTFLLAEGKAIGKSLAEADLVEDARRVIAKIRARGGDVPLPADVVCAKEFAETAAAATKNVAEVVADDMILDIGPDAAKQLAAIIAQAGTVVWNGPVGVFEFDQFGNGTKTLAQAIAQSKAFSIAGGGDTLAAIAKYGITDDISYISTGGGAFLEFLEGKELPAVAILAERAQ

SEQ ID NO: 21591 - protein, 468 aa, Chromobacterium violaceum ATCC 12472
MLRNTKILATLGPSSSAPEKILELARSGVNIFRLNMSHGSHDDHRARLAAIRAAEKTLDRPIGVLVDLQGPKLRIGKFPQPTTVKTGDRYEFVLDETEGNAERATLPHPEAFEALEPGHLILVNDGKLAFEVAEMHPRRIVTRVTVGGELSSNKGFNLPHTVLPLSAITGKDRKDAEFALEEGADWVAMSFVQTAADVKALRDIVGKRVGIVAKIEKPSAVDDLEAIAELADGVMVARGDLGVELPPEDVPVVQRRIVHHCRHLGRPVIVATQMLESMITAPTPTRAEANDVATAVYEGADAVMLSAETAAGQYPLEAVQIMDRIIRRVENAPDYRKVMALDYSAADEPDRTDAIAACVRKVSTLLPVTVAVAFTTSGASCLSLARERPSTPILGISPRLETARRLTLVWGVVAYHGPDAENLEDMVVKTTFCATKLSLAEQGKPMVIIAGVPFGTPGSTNLLRIVYP

SEQ ID NO: 21592 - protein, 231 aa, Chromobacterium violaceum ATCC 12472
MGEFIGTALLVLLGNGVVANVLLKNTKGHNSGLIVVAFGWAMAVFVGVFSVAAISGAHLNPAVSVALAVAGKFPWEKVPGYVAAQMLGGMAGAGLMWLIYRKHYETTDCADTKLATFCTGPAIRSLPGNLVSEIVATFVLVFAILSMVAPKMSLGAIDALPVALLVLGIGVSLGGTTGYAMSPARDLAPRIMHAILPIPGKRDSDWGYAWVPVVGSLIGGALAALAFTLPL

SEQ ID NO: 21593 - protein, 447 aa, Chromobacterium violaceum ATCC 12472
MISLFKPAPHLPPLPDAQQHGLYRRLRWQIFLGIFIGYAGYYLVRKNFSLAMPYLVEQGFSRGDLGFAMSGVAIAYGLSKFLMGAVSDRSNPRVFLSAGLVLSAAVFLLMGFAPWATSSVGVMFVLLFLNGWFQGMGWPACGRTMVHWWSQKERGGVVSIWNCAHNVGGGLIGPLFILGMGWFNDWRAAFYVPAAAAIGVAVFAWLTMRDTPQSCGLPPVEAYRNDYPEDYSDKHEQELTAREIFRKYILPNKLLWYIALANVFIYLLRYGVLDWAPTYLKEVKHFSVDKSSWAYFLYEWAGIPGTLLCGWMSDKLFRGNRGATGVFFMALVTLATVVYWLNPAGNPTVDMLALIAIGFLIYGPVMLVGLHALELAPKKAAGTAAGFTGLFGYLGGSVAANAVVGYTVDHFGWDGGFALLIGSCVAAIVLLALTTWHGHQQGKLASA

SEQ ID NO: 21594 - protein, 501 aa, Chromobacterium violaceum ATCC 12472
MQSLKPGFELKSRYANYIGGRWVPPVNGRYFENVTPITGKPLCEIPRSDEQDVELALDAAHAARYAWGHTPVTERAIALNRIADRMEANLALLAEVETWDNGKPIRETRAADIPLAIDHFRYFASCVRAQEGSLGEIDANTVSYHFHEPLGVVGQIIPWNFPILMAAWKLAPALAAGNCVVLKPAEQTPLSILVLMELIGDLLPPGVLNVVNGFGVEAGKPLASSKRIAKIAFTGETGTGRLIMQYASQNLIPVTLELGGKSPNIFFGDVAAKDDAFLDKAIEGFVMFALNQGEVCTCPSRALIHESIYDRFMEKALARVAAIKQGNPLDPATMIGAQASQEQMDKIQSYLAIGRDEGAKVLAGGARAQLDGDLAGGFYIQPTVFHGHNKMRIFQEEIFGPVVSVTTFQDRDEALAIANDTLYGLGAGVWTRDMNTAFFMGRHIEAGRVWTNCYHAYPAHAAFGGYKQSGIGRETHKMMLEHYQQTKNLLVSYAEDKLGFF

SEQ ID NO: 21595 - protein, 401 aa, Chromobacterium violaceum ATCC 12472
MNPRLDQLHPYPFQRLAALLADAKPPASLPHISLAMGEPKHPAPQLVKDALCANLAGLSGYPATQGTPALRQACADWAERRYGVRLDPASEVLPVNGSREALFSLTQCLIDAGGAAKPVVVSPNPFYQIYEGAALLAGAEPHYLNCEAENRFQPDWDGVPDEVWRRAQLVIVCSPGNPTGAVMDLAAWDKLFALSDRYGFVIASDECYSEIYFDQPPLGGLSAARALGRGLERLVMLTSLSKRSNVPGMRSGFVAGDAAILKQFLLYRTYHGSAMSLTVQAASVAAWNDEAHVESNRAAYAAKFAAVLPLLQPVLEVERPEAGFYLWAKVPDGDDAAFARALFQQRHVTVLPGSYLARDAHGANPGRGYVRIALVAEQAECVAAAQRIVEFTQTQRAATPA

SEQ ID NO: 21596 - protein, 322 aa, Chromobacterium violaceum ATCC 12472
MSDEMIYGDGAIRRQGLYGSSIENTYAGVLSFMRRNYSRDLEGVDVAVSGIPLDLSVTFRSGARMGPQAIRAASVQLAELKPYPWGFDPFEDLAVVDYGDCWFDAHNPLTIKPSIIEHARTILASGAKMLTFGGDHYVTYPLLIAHAEKYGKPLALLHFDAHCDTWPDDSPDSLNHGTMFYKAVKEGLIDPKKSVQVGIRTWNDDFMGLNVLGAPWVHDNGVDATIAEIKKTIGDAPVYVTFDIDCLDPSAAPGTGTPVPGGLTTAQALKIIRNLGDLNIVGMDVVEVAPSYDQSEITAIAAAHIACDMLCLMRNKKVAGTL

SEQ ID NO: 21597 - protein, 132 aa, Chromobacterium violaceum ATCC 12472
MSSVSASWLDEVKWDDKGLVTAIAQDAASGRVLMVAWMNRESLQLTADTGIAHYWSRSRRKLWKKGEESGHLQTVRELRLDCDGDVIVMQIEQIGGIACHTGRESCFYRRFENGGWTTVDAVLKDPRAIYHP

SEQ ID NO: 21598 - protein, 379 aa, Chromobacterium violaceum ATCC 12472
MSHDIIRCQAAVAWAAGQPLSIEEIEVHPPKAGEVRVKMVATGVCHTDAFTLSGADPEGVFPCILGHEGGGVVESVGPGVTSVAVGDHVIPLYTPECRECKFCLSGKTNLCQKIRATQGKGLMPDGTSRFSKDGKPIYHYMGTSTFSEYTVLPEISLAKVNKAAPLEEVCLLGCGVTTGMGAVVNTAKVKAGDNVAVFGLGGIGLSAIIGARMAGAGRIIGIDINEGKFELAKKLGATDCVNPNGFDKPIQDVIVEMTDGGVDFSFECIGNVKVMRAALECCHKGWGESVIIGVAGAGQEISTRPFQLVTGRVWRGSAFGGVRGRTELPEYVERYLKGEFRLDDFITHTMPLERVNEAFDLMHEGKSIRSVIHYAAEPA

SEQ ID NO: 21599 - protein, 248 aa, Chromobacterium violaceum ATCC 12472
MSGKLVIGNWKMNTRGDSARQLAAALLADGQTNREGVGIAAPAVYLAALAEQLKGGKIALSSQDVSRFAADGAFTGEVSAAMLADVGCRYALVGHSERRQYFREDNAALLAKMRNAIAAGVTPVLCVGETLAQREAGDYLNVVREQLAILSDIADGEYVVAYEPVWAIGTGKVASLEQIAEIHAFIKNWCLQNAGGSAKIRVLYGGSVKAENAEAILATENVDGALVGGASLDADSFRVICQAAGKMI

SEQ ID NO: 21600 - protein, 435 aa, Chromobacterium violaceum ATCC 12472
MELGKWLDERPLGGFQHRLLALCGLCMILDGFDVQAMGYVAPALLEDWGIAKSALGPVFAAGLFGLLLGALLFGALSDRVGRRPVLLSCTLMFASGMLATAAAQTLPQLIVLRFLTGLGLGGIMPNAMALAGEYSPARRRASLMMIISCGFTAGALLGGLLAAWLIPAHGWRAVFVFGGAAPLLLWLPMLRALPESARFLLLRGRAPQALFWLRRMEPGLPADCRPWLAEPPSAGNSVAALFGGGLARRTLLLWLLSFLNLIVLYFLSNWMPSLLRAQGLEMRDALLAGSMLQLGGVAGTLSLGWWIDRGGFRRALPPCFLLAALGLWLLGQVEGQALWLYALLFCVGFFIIGGQPAVNALAASAYPTGLRATGVGWSLGIGRVGSVLGPWLGGVLIGLAWSQAALFALLALVSLASAAVVWAYHRERPRQGGSL

SEQ ID NO: 21601 - protein, 463 aa, Chromobacterium violaceum ATCC 12472
MKPVLNRRALLRLGGGALLGAWAARSAGPRAAATAGGYRWCNWSGLQRCAAQALATPGDEAELARLLREASRSGTPLRCVGAGHSFTPLVPTPGTIVSLDRMSGLLSYDAAAGEAILQAGTRIGQLARLLDAQGMALRNQPDVDVQSFAGAISTATHGTGAGLPALHADARALRLLTPSGETLDCGQGRDDDLLQAARVSLGSLGVIARATVATLPAYYLQRRLWLLPAGQMLDAAPELARRHRHFEFYHLPFTGYAAAITHDIRPPGPASRPASGDEDMLRELRRLRDWLGGMPALRRWTAQKLIDPKLSEQAFDKSWRLLSTARPTRFNESEWHVPREAGIACVREVIERLERRDDVFFPLEFRFVRADDAWLSPFYRRDSCSIAVHAAAGEPHDYLLTELAPVFRKYEGRPHWGKLHPYGAAELAALYPRWNDFLKLRRELDPKGVLLNPHLRRVLGVPA

SEQ ID NO: 21602 - protein, 477 aa, Chromobacterium violaceum ATCC 12472
MSQQFDVVVIGGGPGGYVAAIRAAQLGFSAACVDAFKNPEGKPSLGGTCLNVGCIPSKALLQSSENFHAVQHDFAKHGISVSGAKMDVGQMLSRKTDIINKNAAGIGFLFKKNKVANIHGLAAFKGRQGEKWVIEVTDGGKVVDTLEAVHVIVATGSSPRALPGLATDNQLVLDNEGALALTAVPKRLGVIGAGVIGLEMGSVWKRLGAEVTILEAAPTFLAAADQQIAKEAFKTLTKDTGLDIKLGVKIGEVKAGKKSVSVSYELNGEAVKAEFDKLIVSIGRVPNTQGLGAETVGLALDERGFVAVDDHCHTNLPNVWAIGDVVRGPMLAHKASEEGVAVAERIAGQKPHVDFGVIPWVIYTSPEIAWVGKTEEQLKAEGVEYKKGTSGFGANGRALGLGQAQGTVKILADAKTDRILGLHMIGPMVSELVSEGVVSMEFKAASEDLARIVHAHPSLSEVIHEAALAADKRALHG

SEQ ID NO: 21603 - protein, 181 aa, Chromobacterium violaceum ATCC 12472
MSPDASMNHDFNQDFFSLFGLPRRFAIDAAGLDAAWRAAAAQVHPDRYAASSDADKRSALMLATRVNEGYQTLKSPLNRARYLLQLSGVDTQEENNTRMPADFLMAQMEWRESIDDARADVDALESLSRRLRGEVRDLQTELEAALDARADLDAAAVLVRKLRFMEKLDQEIGDAIESLLD

SEQ ID NO: 21604 - protein, 192 aa, Chromobacterium violaceum ATCC 12472
MGWLGRENAMKRWGAMLMLWGQAALAACPALLNHSVPGLMGGQINLCQYADRPLLVVNTASHCGFTPQFTQLESLYKQYGPRGLMVIGFPSNDFFQELDKPSEIGAFCQANYGVTFPMAGKGHVRGADAQPLFKDLIAATDDAPSWNFHKYLILPGASKVISIGTRTKPDAPEVVNAFLPYLQPETQAAAKP

SEQ ID NO: 21605 - protein, 174 aa, Chromobacterium violaceum ATCC 12472
MLDRDGYRPNVGIILTNAKNEVFWGKRVREHSWQFPQGGIKPGESPEAAMYRELLEEVGLLPQHVKILGRTRDWLRYEVPTNWVRREWRGSYKGQKQIWFLLRLVGRDSDVCLRATNHPEFDGWRWNDYWAPVDAVIEFKRDVYERALSELARFMRGVESHHAYLARTSTQSEQ

SEQ ID NO: 21606 - protein, 463 aa, Chromobacterium violaceum ATCC 12472
MPGEQQTLHRGLEERHINLMALGATIGVGLFLGSATAIKMAGPAIMLAYGLGGLAIFMIMRALGEMAIHNPVAGSFSRYAQDYLGPLAGYLTGWNYWFLWLVTCMAEITAVGVYMGIWFPDVPSWYWALAAMLAMGGVNFIAVKAYGEFEFWFALIKIVTIVLMIAGGFAMIAFGFGNHGVATGISNLWAHGGFMPNGFSGVLMSLQMVMFAYLGVEMLGLTAGEAKNPKKALARAVDSVFWRILIFYVGALFVILSIYPWNELGTRGSPFVLTFESMGIPAAAGIINFVVLTAALSSCNSGIFSTGRMLFNLAEQKQALPIFAHVSKRGVPVPALLMSVAALLLGVLLNYLAPKEVFTWLTAISTFGAVWTWLIILLAQLRFRRSLSADELASISHRMPLWPYGSYLTLGFLALVIGLMAYFPDTRVALIVGPGWLVFLVAAYYLLGYHKQDAAWRLAQQSR

SEQ ID NO: 21607 - protein, 329 aa, Chromobacterium violaceum ATCC 12472
MQKRTLGRNGPQVSALGLGCMGMSAFYGPRDDAESLATLDAALDLGVNFLDTADMYGPYSNERLLARLLARRRGEVVLATKFGIVMDPADPARRGVNGRPDYARSSCEGSLKRLGVDCIDLYYLHRVDPEVPIEDTVGAMAELVKAGKVRWLGLSEASADTLRRAAAVHPIHALQSEYSLWTRDPEDGVLAACRQVGAGFVAYSPLGRGFLTGAIKSPDDFAADDFRRGNPRFQGENFQRNLRLVDKVRALAAAKGCSPAQLALAWLLAQGEDIVAIPGARKQANLRDNLGALAVELDAGDLAELGSMFAGGQVSGLRYAAEVMGMVNR

SEQ ID NO: 21608 - protein, 497 aa, Chromobacterium violaceum ATCC 12472
MSTGTINWQKKAEQLHFEGRAYIDGAYRKALSGKEFTTINPATGKVLASIEWCGKEDVELAVCAARRAFDGGAWSELATRSRMEILKRFASLIQDNIEELALLESLDVGKPIANSLSVDISNTAYCISWFAELIDKAPGEVVPVDPALLGMVTREPVGVVAAIVPWNFPLMMASWKFAPALAAGNAVILKPSEKSPLTAIRVAALAEAAGIPPGIFQVLPGAGDVGQALASHLDVDCVAFTGSTAVGKQIANYAAQSNLKRVWLELGGKSPNIILADCKDLKEAAKAAAGAICYNAGQMCTAGSRVLVAREIREAFLSELKVAMADYRPGDPLSPETNLGAVVDQRQFDKILSYITQGQNEGAKLLQGGAAVQTVHPNGLFIEPAIFDCPQPNLTICREEIFGPVLSVITFDDVDEAVRIANDSQYGLGAAVWTQNVSTAHKVARRLRAGTVWVNCYEEGGDMNLPFGGYKQSGNGRDKSLHALEKYTELKSTLIKL

SEQ ID NO: 21609 - protein, 478 aa, Chromobacterium violaceum ATCC 12472
MHHPSLKPFPDDFLWGAASAAYQVEGAFDADGKGPSVWDVFVREPGRTFQGSNGDVAVDHYHRMEEDVALMAEMGLTAYRFSVSWPRVLPRGRGEPNEAGLAFYDRLIDALLARGIEPVLTLYHWDMPQALQDEYGGWEDRRIVDDFGDYCALLFRRYGDRVKTWVSLNEQNYNLSNAYLLATHPPAAADRKRFYAANHIAFLANARAIRLFRQWVPDGRIGPSFAYSPAYPASCAPADMLAFDNAEEFTNHWWLDVYCRGRYPQIALAWLRERGEAPDIRPGDIEALAAARPDFIGLNYYYTLSYAHNPPDGVGMQRINTTGQKGSTPASGVPGLYRTAPNPALETSNWDWAIDPAGLRIALRRLTSRYGLPVLITENGLGEFDRLEDGDRVRDDYRIAYLRSHLHACREAISDGVALLGFCAWSFTDILSWLNGYQKRYGFVYVNRDETDARDLRRVRKDSFFWYQRAIASGGREL

SEQ ID NO: 21610 - protein, 487 aa, Chromobacterium violaceum ATCC 12472
MRIIEKAYTFDDVLLVPAHSEVLPRDVALSTKLTRNITLNLPLVSAAMDTVTEARLAIAMAQEGGIGIVHKNMSVEKQAAEVSKVKRHESGVVKDPITIAPDMLVRDLVLLTRQYKISGLPVIEAGKVVGIVTNRDLRFETRLDQTVGSIMTPRERLITVKEGASIDEARELMHTHRLERVLVINDAWELKGLITVKDIIKTSEHPNANKDSQGRLRVGAAVGTGADTEERVKALVAAGVDVIVVDTAHGHSQGVLERVRWVKQNFPQVDVIGGNIATAQAALDLVKAGADGVKVGIGPGSICTTRIVAGVGVPQLTAIHNVSEALKGTGVPMIADGGIRFSGDIAKALAAGGNAVMLGGMFAGTEEAPGEVELFQGRSYKSYRGMGSLGAMSQGSADRYFQESSNAADKFVPEGIEGRVPYKGPIAQVIHQLVGGLRSSMGYLGCPSIDQLHQKAQFVEITSAGIRESHVHDVQITKEAPNYHVER

SEQ ID NO: 21611 - protein, 446 aa, Chromobacterium violaceum ATCC 12472
MNHPLTTRSEFDHLDLRAHWMPFSANRNFQRDPRLIVSGEGNYLTDADGRRIFDSLSGLWCCGAGHSRKEIAEAAYRQLSTLDYSPGFQFGHPLSFRLAERVAAMAPGALNHVFFTNSGSECADTAVKMARAYWRLKGQASKTKLIGRARGYHGVNIAGTSLGGMNGNRKLFGPLMDADHLPHTLLPANAFSRGLPEQGAELADDLLRLIELHDASNIAAVIVEPMAGSAGVIVPPQGYLQRLREICTQHGILLIFDEVITGFGRTGSLFGADHFGVTPDIMNLAKQLTNGAVPMGAVVASSEIYDAFMAQATPEYAVEFAHGYTYSAHPVACAAALAALDVLEQENLVARAAELAPHFERGIHGLKGLPHVIDIRNCGLAGAVQIAPSGGDAIVRPYEAAMALWRKGFYVRYGGDALQFGPPFTATPQELDSLFDAVGETLAKLA

SEQ ID NO: 21612 - protein, 462 aa, Chromobacterium violaceum ATCC 12472
MPAGWEARANTADRGFMDSALIINQWLDEHHITEVECLIPDMTGLARGKIVPRHKYDPAVGLRLPEAVLSMTVTGDYPDRDFTSVADPDMKLLPDLSTLRPVPWNKEPTAQIIHDCYSFAGDAVDLAPRNVLKRILKLYEDQGWKPVIAPEMEFYLVEIQPDEDLPLRPPVGRTRRTEAGMQSFSIDAVNEYDDIFDVMYDWCEAQGLALDTLIHEMGTAQMEINLDHGDPLQLADQVFLFKRTVREVAIRNNMYATFMAKPMQGQPGSAMHMHQSVVDIASGGNIFSLDDGQPSEAFLHFIGGLQRYLPAAMPFFAPYVNSYRRLSRYTSAPINLSWGYDNRTCGLRVPHSDPEARRVENRLAGVDVNPYLAMAASLACGYLGMRDRIDPSEPLSGSAYEQPHQLPRHLDDAIDMLLRCRPLSELFGEHFIETYAAIKEAEYREYFDVISPWERRFLLLHV

SEQ ID NO: 21613 - protein, 391 aa, Chromobacterium violaceum ATCC 12472
MVPNYGPAGFIPVRGEGSRIWDQDGREFVDLAGGIAVNSLGHCHPELVAALTEQANKLWHVSNVFTNEPALKLASLLVEKTFAERVFFCNSGAEANEAAFKLARKYAHDNFGADKNQILSCVNSFHGRTLFTVSVGGQPKYTEGFGPVPGGIDHFEFNNIESLKAAISDRTCAVVIEPIQGESGVLPADPAFLKAARELCDQHNALLIFDEVQSGMGRTGALYAYQQYGVTPDILSSAKGIGGGFPIGAMLTTEKVAKSFGIGSHGSTYGGNPLACAVAHKVVSIVSSPEVLAGVEARHKRLVAGLEAINAKYKVFKQVRGKGLLIGCVLTDEYNGRAREFLKAAEKQQLMILVAGLSVLRLAPSLVISDADIAEGLKRLDAAIADLQSAK

SEQ ID NO: 21614 - protein, 1197 aa, Chromobacterium violaceum ATCC 12472
MQFESFAHQQSALRDAITAAYRRDERECVQALLPQAAMSPEQVASVQDLARRLVTEVRRERTRSSGVDALMHEFSLDSSEGIALMCLAEALLRIPDRETADKLIRDKISRGDWKAHLGNSSSLFVNAAAWGLLVTGKLVSSHSANGLSAAMTRLIAKGGEPLIRKGVDMAMRMLGKQFVTGETIEEALANGREREARGYRFSYDMLGEAAMTEADAQRYLKDYVTAIHAIGKESNGRGIYDGPGISVKLSAIHPRYARLKHERMMTELLPRLKALFLLAKQYNIGLNIDAEEADRLEISMDLVEALANDADLNGFEGIGIVVQAYQKRCPFVIDFLIDLARRTGHRFMVRLVKGAYWDAEIKRAQVDGLPGYPVYTRKVYTDVSYLACAKKLLAAQDAIYPQFATHNAYSLSAIYNLAAGKDYEFQCLHGMGETLYDQVVGKDKLGKACRIYAPVGSHETLLAYLVRRLLENGANSSFVNRIVDENVSIDELVTDPVAEAAGFSGMPHSKIPLPEALYGEGRRNSKGLDLSSEHVLATLQLGLQASEQQRWAAFPMLGDGDVTDGELQEVRNPADHSDVVGKVIEASAADVERALALSAGIAAAWAATPVAERAASIRRMADLMEAHMPALMGLAVREAGKTLNNAIAEVREAVDFCRYYAAQIVSEFDNASHRPLGPVVCISPWNFPLAIFIGEVVASLAAGNTVLAKPAEQTSLIAAYAVRLLHEAGIPRAALQFLPGRGEVVGAALTGDARIQGVIFTGSTEVAQIINRTLAKRQDDPVLVAETGGMNAMIVDSSALPEQVVTDVLSSAFDSAGQRCSALRVLYLQNDIADKVIAMIKGAMDELTIGNPAKLTTDVGPVIDAEAQAGLLAHIARMKNSARAMHQTKLSAACEQGTFVAPTLFEIDNLSELKREVFGPVLHVLRYAASDLDKVVAEINATGYGLTHGIHSRIDETIADICGKIKVGNIYVNRNIVGAVVGVQPFGGEGKSGTGPKAGGPYYLYRLTRAAWQPKLAAVPAAADLSALDALAAAAKAQSLALDGAIAAARKESPLTHSVALPGPTGENNLLSFAGRGRIGCVADDAQALAEQLAAAFAAGNRAVLADNELGRKFASALNGHVSLAADVLEADVDAVLYAGAKAEEARRELAARDGALVPLILRGENGYNVHRLVVERALSVNTTAAGGNASLMSMTE

SEQ ID NO: 21615 - protein, 465 aa, Chromobacterium violaceum ATCC 12472
MLFELNRASRAEILAEARQIAGLALPMMVAQIAQVATSFVDTVMAGRVGTDDLAAVSLGASVFITVYVTLMGVVAALNPILSHHLGSRDRRAFSRDAAQGLWFGLMLGALGAGLMLLLEAPLRHWLHLPPDVTDKVMLFITGAAIGMPAAMAHRALHAYASSLGHPKAIMVVSLLALALNIPLNYILIHGLFGMPRMGGAGCGWATGIVFWFNCLALLTYVSWHRHFRDSRILAGLAAPDWRRFLAFLKLGVPIGLSFFVEVSLFSFIALLIAELGTVVVATHQSVLNFSSLIYMLPQSVATALSVRVGHHAGAGDYRAARFISGVGMLMGLAMAGGAMALVLLLREPIMWMYSADPRVIAMGTTLLLFAAVYQLTDAAQTIASGALRGYKLTAVPMLIHITSFWVAGLGLGMLLGLTDWIVPRMGIYGFWTALVISLTVAGLLLTYYLARASRKRLHRDQGILL

SEQ ID NO: 21616 - protein, 337 aa, Chromobacterium violaceum ATCC 12472
MKAVAYYQNLPISHPEALQDVQLPEPVIGERDLLVEVQAISVNPVDVKVRANMAPEAGQPKVLGWDVAGVVRAVGAKTTLFQPGDRVWYAGALQRPGANSELHAVDERIVGRMPDSLDFETAAALPLTAITAWELLFDRLQVLANGQPAGRKLMIVGAAGGVGSIMIQLARQLTGLTVIATASRPETQAWVRELGAHHVIDHSQPLSRELKRIGIESVDYVASLNQTDAHFGEIVESLAPQGKLALIDDPAALDARPLKVKSISLHWEFMYTRSMFATDDQIEQHKLLTELARLVDAGIVKSTVAERFGAINAANLKRAHALLESNAARGKIVLSGF

SEQ ID NO: 21617 - protein, 159 aa, Chromobacterium violaceum ATCC 12472
MSLATTDLCDAFDAEIQVLDPVFQSFGGHARFHGPIATLKLFEDNSLVRQMLGEPGNGRVLVVDGGGSRRCALLGDQLGELAVKNGWAGLVIDGCVRDSAALGKLPLGVKALAAHPRKSVKRDSGQRDLPLRVAGCDILPGQWLYADEDGVIVSGRPLG

SEQ ID NO: 21618 - protein, 341 aa, Chromobacterium violaceum ATCC 12472
MKALAKLKAAPGLEMTDVPLPEVGHNDLLIKIVKTAICGTDIHIWNWDEWSQKTIPVPMHVGHEYVGVVAGMGSEVQGFKIGQRVSGEGHITCGYCRNCRAGRRHLCRNTTGVGVNREGAFAEYLVIPAFNAFPIPDDISDDLASIFDPFGNAVHTALSFNLVGEDVLITGAGPIGIMAVAIAKHVGARHVVITDVNDYRLELAKKMGATRAVNVAREDLKAVMQELHMSEGFDVGLEMSGNPQAFRQMLETMNHGGKVALLGIPPSNTAIDWNQVIFKGLEIKGIYGREMFETWYKMVALIQSGLDISPIITHHFKVDEFEQGFAAMLSGQSGKVILDWR

SEQ ID NO: 21619 - protein, 335 aa, Chromobacterium violaceum ATCC 12472
MAFLQIDHLNKRFGQQAVVHDFNMQVEAGEFVTFLGPSGCGKTTVLRMIAGFETPSGGSIRLAGDDITRQSPQKRGIGMVFQSYALFPNMNVADNIAFGLKMQKRSADEIRRKVGEVIALVELNGREKHFPHQLSGGQRQRVALARALVVEPRVLLLDEPLSALDARIRKNLREQIRDIQRRLGLTTVFVTHDQEEALTMSDRIFVMNQGKVEQEGAAETIYTQPATEFVARFMGNYNLLSAEQSHALLGLEVRGHLAVRPESIELLGNDDADDNQALPAVIRQHQLLGNIIRYQVDAGGATLQVDRLNRHAGDLLPAGAPVRLRFDRDNLREVR

SEQ ID NO: 21620 - protein, 498 aa, Chromobacterium violaceum ATCC 12472
MTTVQASFSATGTPRRDSAVWQAIEWLVDSGSFYQLDALSEHDCQHFGTAGRKVPGDGLVTGHGRIDGRPVLVYAHDRDFLGGSSSRVHAVRIGKLLDMALQLGLPVIGLNDSSGIRIHEGVDAGAQFSEVFHKTVKASGVVPQISVILGDCAGGAAYAPALTDFIVMAGAESTMFLTGPSVIRSATGESVTKEEIGGAQLHAEVTGLAHFNCDGREQAVALVRELLGYLPQNNASPTPRVDRGDTGPRRTPRLERLIPAHQNEPYDVLDVVAEIADNNEFLEIQAQYAPNLVTGFARFGGRTVGVLASQPLQRAGCLDVDSSLKGARFVRLCDSFDIPLLTLLDVPGYLPGREQETRGIIGAGAKLLHAYCEASVPKLAIVLRKAYGGAYPTLANWSATDFTFALEQAEIAVMGPQGAVDIIFRRELAAAADPASLREKLLDDYRAAHANASYSAKKGYVDGLLAAAEVRNAVLSHLQLLADKVGGTPARRHSNIPL

SEQ ID NO: 21621 - protein, 358 aa, Chromobacterium violaceum ATCC 12472
MSIQVENIRKAFGDFVALNDISLNFPGGELVALLGPSGCGKTTLLRIIAGLEQADAGRVLLDGQDASATHVRERQVGFVFQHYALFRHMTVFDNVAFGLRMKPRRERPSEAEIARKVHALLDLVQLDWLADRLPAQLSGGQRQRIALARALAVEPRVLLLDEPFGALDAKVRKELRRWLRKLHDELHITSLFVTHDQEEALEVADRVVLMNHGKVEQIGSPAEVYSQPASAFVYGFLGSANRIRGVSATGAVAVGGQTLAADHQLPHGQPVEAFIRPHELAILPEHGAGLPARVQRVLTLGGLSRIELEGRDELAGQSFDAELPADAPLLAELAVGQAVRLQARAARVFAADPQGGEA

SEQ ID NO: 21622 - protein, 366 aa, Chromobacterium violaceum ATCC 12472
MKPVDSLSGLSEHLSVHALCRRFGAFTALDQASLSIRKGEFVCLLGPSGCGKTTLLRLIAGLDLPDAGAIRLSGRDITRTAPAKRDYGIVFQSYALFPNLTVADNIAYGLTPRRDKAGHAHRVRELLDMVGLPGSEGKYPSQLSGGQQQRVALARALATSPGLLLLDEPLSALDARVRDKLREELKGLQRRLGVTTMMVTHDQEEALSIADRVVVMNAGRIEQTGTPAEIYRSPASRFVAEFVGDANWLPAERRGGREAAVGGCVLSLARDLPDAEALTLFIRPEDVIVKPRWAPAANTLLARVEDVSFGGAMTRLRLRPEGMPGLILRAEICPSMLNRQPLVPGEIVPVELPAAQLRAYPGEAAC

SEQ ID NO: 21623 - protein, 495 aa, Chromobacterium violaceum ATCC 12472
MARSHAEWKQLAAELKIEGRAFINGEYRDAAEGKRFDCVNPANGAKLAEIAHCGEAEVEAAVKAARRAFESGVWSELAPLKRAAVLKRFAALIREHADELSLLETLDVGKPIGDTTAVDVPASAYCVEWFAEAIDKVGGEVVPVDPKLVGLVTREPIGVVAAVVPWNFPILMASWKFGPALAAGNAVIVKPSEKSPLTAIRIAALAKQAGIPDGIFQVLPGAGDVGRLLALHMDVDCVAFTGSTNVGKLIAGYAAQSNLKRAWLELGGKSPNIILPDCPDLARAARAAASGIFYNMGEVCTAGSRVLVHKDIKERFLEEFKKAAAGFFPGDPLDPATSMGAIVDDIQYRKVLNYIDKGLSEGANLLLGGKAVHTDKGLFIEPTAFDCPSDDLTICREEIFGPVLSVITFSELDDAIRIANDTSYGLAAAVWTSNVSTAHQVSRRLRAGTVWVNCYDEGGDMNFPFGGYKQSGNGRDKSLHALEKYTELKSTLIKL

SEQ ID NO: 21624 - protein, 444 aa, Chromobacterium violaceum ATCC 12472
MNHQINEWLREHRITEVECIVPDMTGIARGKIVPKDKFVSDPEMRLPEAVLIQTVTGDYPDDSLLDLTDPDMVLEPDPNTLRYVPWAVDPTAQLIYDCCRADGSPVDVAPRNVLKRVLGLFDEMGLEPVLAPEMEFYLLSPNPDPDIPLAAPIGRTGRAEFGRRSYSIDAVNEFDPLFEDIYDYCHAQNLEVDTLIHEIGTAQMEINFLHGNPLELADQVFLFKRTVREAAFRHNMYATFMAKPMENEPGSAMHIHQSLVDKNTGRNVFTNEDGSPSDIFFHFIAGLQKYVPQTMPLFAPYVNSFRRLSRYTAAPTNVEWGYDNRTVGLRIPHSSPAARRIENRVPGVDVNPYIAIAATLACGYLGMVNKLRPTEPRQTDAYELPYQFPNSSEESLLQLAGCSEIAEVLGPRFVKMYVAMKEKEFSEYFRVISPWERKFLLLHV

SEQ ID NO: 21625 - protein, 459 aa, Chromobacterium violaceum ATCC 12472
MQKQRTTSQWRELDAAHHLHPFTDTASLNQAGARVMTRGEGVYLWDSEGNKIIDGMAGLWCVNVGYGRKDFAEAARRQMEELPFYNTFFKTTHPAVVELSSLLAEVTPAGFDRVFYTNSGSESVDTMIRMVRRYWDVQGKPEKKTLIGRWNGYHGSTIGGASLGGMKYMHEQGDLPIPGMAHIEQPWWYKHGKDMTPDEFGVVAARWLEEKILEIGADKVAAFVGEPIQGAGGVIVPPATYWPEIERICRKYDVLLVADEVICGFGRTGEWFGHQHFGFQPDLFTAAKGLSSGYLPIGAVFVGKRVAEGLIAGGDFNHGFTYSGHPVCAAVAHANVAALRDEGIVQRVKDDIGPYMQKRWRETFSRFEHVDDVRGVGMVQAFTLVKNKAKRELFPDFGEIGTLCRDIFFRNNLIMRACGDHIVSAPPLVMTRAEVDEMLAVAERCLEEFEQTLKARGLA

SEQ ID NO: 21626 - protein, 464 aa, Chromobacterium violaceum ATCC 12472
MKTIHIDVAVIGAGTAGLAAYRAAKAGGASALIIEGGPYGTTCARVGCMPSKLLIAAAEAAHHAGHTDMFGVHVDGGVRIDGREVMARVRSERDRFVGFVVRSVDGIPAEDKLPGYARFVDNTTLQVDDHTIVQAKRVVIATGSSPAVPAPFKAFGDRLIVNDDVFEWDALPQSVAVFGPGVIGLELGQALSRLGVRVRVFGLGGGVGPLSDPAVRGYARQALSEQFYLDPDAKVLEMANDGDAARIRYVNLDGEEVEERFDYVLAATGRTPNVRSLGLENTSVRLDARGVPLFDPETLLCVGAPVFIAGDANNILPLLHEAADEGKTAGANAAAYPAVSAGLRRSPIAVVFSDPQMMMVGRRFADLPEGDFAVGEVSFEDQGRSRVMGVNKGLLHVYADKATGRFLGAEMIGPRAENLAHLLAWSHQQGLTVEQMLDMPFYHPVIEEGLRTALRDAAAKLARD

SEQ ID NO: 21627 - protein, 332 aa, Chromobacterium violaceum ATCC 12472
MEKMSAIVQQAPGGVETMEMGEWDKPRAAPGKLLVRVMAAGVNRADLMQREGRYPPPPGASPLMGLEVAGVVEEAVGDSAFQPGDAVFGLVEGGGYAEYALLDQSLAIAKPDQLSWVEAAGLPEAWMTAWFNLVVKAGLQAGERALIHAGASGVGVAAIQLARLLGAEAFASAGSAEKLAFCRELGASQVFNYHETPAFGERVKAWGGADVVLDPVGASHLAENLQALNPDGRLVNIGLMGGLKAELDFGRLLMKRISLIGSTLRPQPLAVKAELAAALRDLILPALLEGRARAVVDSSYPWTQVRDAHAYVADNRNLGKVVLTLFPVMAGG

SEQ ID NO: 21628 - protein, 296 aa, Chromobacterium violaceum ATCC 12472
MENIAFIGLGNMGGPMAVNLLNKGFKVSAFDLSADALAKVAAAGGRAASSAADAAESASVVISMLPAGKHVAGLYLGDNGLFARLPKGALVIDCSTIDAGTARKVAEGAREKGLSMLDAPVSGGTAGAAAGTLTFIVGGAAEDLAHARPVLEAMGKNIFHAGGAGAGQTAKICNNMLLGILMAGTAEALALGVKNGLDPKVLSEIISKSSGRNWATELYNPWPGVMDNTPASRGYAGGFMSELMLKDLGLAEETALQSHAANPLGALARNLYEEHVHQGNGKLDFSSIVKHFHSLN

SEQ ID NO: 21629 - protein, 500 aa, Chromobacterium violaceum ATCC 12472
MSQSVPNIKLLIGGEFVESQTTEWRDIVNPATQEVLARVPLATADEVNAAVAAAKEAFKTWKKTPIGTRARIFLKYQQLIRENMKELAAILTAEQGKTLADAEGDIFRGLEVVEHAANIGTLQMGEYAENVAGGVDTYTVQQPLGVCAGITPFNFPAMIPLWMFPMAIATGNTFVLKPSEQDPMVTMRLVELALEAGIPKGVLNVVHGAASVVDAICDHPDIKAVSFVGSTKVGTHVYQRATLSGKRAQCMMGAKNHAIVLPDANKEQALNQLTGAAFGAAGQRCMALSVAVLVGEAQQWIPELVAKAKGLKVGPGKDNPDLGPVISCAALDRVKSLIARGVEEGAKLELDGRGVKVAGFESGNFVGPTIFSGVKPEMAIYHQEIFGPVLCLMAADTLDEAIAIINANPNGNGTAVFTQSGAAARKFQEEIDVGQVGINVPIPVPVPLFSFTGSRASKLGDLGPYGKQVVAFYTQTKTVTSRWFDDEASSGKVHTTISLR

SEQ ID NO: 21630 - protein, 227 aa, Chromobacterium violaceum ATCC 12472
MRTFRIAPSILSADFARLGQEVKDVVAAGADIIHFDVMDNHYVPNLTMGPMFCEAIRPHSSAPIDVHLMVKPVDALAAAFAKAGADIITFHPEGSEHIDRTLGLIKDAGCKAGLVFNPATPLSYLDHVMDKLDMILIMSVNPGFGGQSFIPHALEKIKLARRRIDEYTAKHGGEIWLEVDGGVKVDNIAQVAAAGADTFVAGSAIYGQKDYKAVIDAMRAELARVQA

SEQ ID NO: 21631 - protein, 400 aa, Chromobacterium violaceum ATCC 12472
MDRTFWQAGHRPTLVSAFLYFDLSFMAWYLLGPLQVPIAAALQLSTQQRGLMVATPILAGALLRPLMGMLVDRIGAKRAGLLGQIVVIAALLGAWLANLSSLGGMLALGALLGVAGASFAAALPLASRWYPPRHQGTALGIAGAGNSGTVLAALFAPALAAAFGWRNVFGLACLPLLLVLAIYAVWAREAPAAAGPKRLSDYLSVLKEKDAWWFMFFYSMTFGGFAGFAGALPGYFHDQFGFDAKAAGLYTAACVFAGSVMRPLGGMLADRMGGTRSLLAVYLACALLMAAAALNAGGAGAALALFVLAMLCLGAGNGAVFQLVPQRFGRELGVMTGLVGMAGGIGGFLLAAGLGAVKQASGDYAPGLWLFAGLCLLAWLSLAGVQRHWRDNWAVAAARV

SEQ ID NO: 21632 - protein, 393 aa, Chromobacterium violaceum ATCC 12472
MQSIMSSLERLPLRGGRIPRLNDMPAPDLFSPLQAGALPLPSRIVMAPMTRCRTDQPGDIPNAMMARYYAQRAGAGLIVSEATQISRQGQGYSFTPGIYSQDQIDGWRRVTDAVRQAGGRMVLQLWHVGRMSHPMFHDGAPPVAPSAIAPDAQVWVADETGAGRMVDCPTPRALETAEIAAIVGDYRQAARNAMAAGFDGVEIHAANGYLIDQFLRSTSNRRDDAYGGSLENRLRFLMEVAAAVADEIGAARVGVRLAPYITARGMNCPEIVPAILEAAVRLNGLGIAYLHLSEADWDDAPQVDDAFRHALRARFRGAIIVAGRYDQPRGERLLAEGLADLIAFGRPFIANPDLPERLARGWPLADFDPSALFGGDGRGYDDYPRYREMATAR

SEQ ID NO: 21633 - protein, 357 aa, Chromobacterium violaceum ATCC 12472
MSEERLKQHRNAIDAIDVEVLKLLNQRASHAREIGEIKGGGVIYRPEREAQVLRRLKDLNPGPLPSESVARLFREVMSECLALEKPLSIAYLGPEGTFSQLATIKHFGHAARAVACSSIDEAFRLVESRALDYVVAPVENSTEGAVGRTLDLMVSSPLKICGEVVLRIHHHLLRKVEGVDGIRRVYAHAQALAQCHEWLNKNLPADVERVSVASNAEAARLAAEDDTAAAIAGQAAAERYALVKLAENVEDEPNNTTRFLVLGLQDVGPSGQDKTSIVVSAPNRPGAVHQLLEPVAANGVSMSKFESRPSRAGLWDYVFFIDLEGHRQDERVLKALAGLGERTSFVKVLGSYPTAVL

SEQ ID NO: 21634 - protein, 398 aa, Chromobacterium violaceum ATCC 12472
MAWTKEQKQTVFACYLGWTLDAFDFFLMVFVLKDVAKAFGADIEAVSWAIMLTLAARPIGALIFGRLADRFGRRPVLMANIVLYSVLGFSSAFAPNLLALLALRTLFGVAMGGEWGVGSSLTMESIPKESRGFVSGLLQAGYPSGYLLATLAFGQLFEHIGWRGMFMLSLLPALLTLYIRRNVPESPSWEASKHHDKPGLLQAISAQWRLSLYAIILMTCFNFFSHGTQDMYPTFLRVQHKFDPHTVQLIAICLNVGAIVGGLTMGSLSEKIGRRNAITLAALFALPVLPLWAFTSTPLPLAIGAFLMQISVQGAWGVIPAHLNEISPPAVRATFPGLVYQLGNLLASVNSPLQAHMAKTNGGDYGLAMAIVAGIVALAIAILIRFSHERRGEAMQAH

SEQ ID NO: 21635 - protein, 475 aa, Chromobacterium violaceum ATCC 12472
MDAIKMPPQEEAALLDAFARLKAVARAAPNPSLETRKSWLNALERLIQENRQALVDTVNQDFGQRSSVETRLAELFPSLEGIRHARRHLKSWMRPRRRGVSLWFAPARASVHPQPLGVVGVVVPWNYPLFLAFGPITAALAAGNRVMVKMSEYTPATGELLQRLARQHFGEDLLAVVNGGPELAQAFVRLPFDHLLFTGSTAVGRHVMRAAAESLTPVTLELGGKSPALVARGANLRRAAEAIVAGKMMNAGQTCVAPDYLLVNDKDCALLLDEIRAAAKRAYPTLARNPDYSAIVNDRHYQRLRGWLEGARQAGARIDEINPAGEDLAAVRKLPLALVQRCPDDCALMQEEIFGPILPVVAYDKFDEALAYINARPRPLALYLFDDDPLRIDRVLQETISGGVSINDTLLHVVQEDLPFGGVGPSGMGHYHGREGFLTFSKLKPVFRQSRLSGAWLTRPPYGAAVEWLLKLMLR

SEQ ID NO: 21636 - protein, 508 aa, Chromobacterium violaceum ATCC 12472
MSKKQDAPELRRSLQARHLSMIAIGGSIGTGLFLASGATISGAGAGGALLAYALVGLMVYFLMTSLGEMAAFMPVSGSFQAYGSRFVDPAFGFAQGWNYWYNWAITVAVELAAAAIIMNYWYPGIPGVVWSGGFLAIIFALNYFSVKGFGEAEFWCSMLKVATIIAFIVIGFLMILGIMTEPNPSRIAPGLQVMMQGEGPFVGGLAAFVGVAMVVGFSFQGTELIGVAAGESANPGRTIPRAVRQIFWRILMFYMLSILIIGLILPHNDPSLLKNDMKDVGASPFTLVFNRAGLAFAASLMNAVILSAILSAGNSGMYASTRMLYAMAKNGMAPKVFGKLTDNGVPRNALYATTLVACLCFLTSLFQSNAVYMWLLNSSGMTGFIAWLGVAISHYRFRRAYVKQGYSLDDLPYKAKWFPLGPLFAFALCLLIMLGQNYTAFTAAKVDWNGVIATYLGIPLFLALWWGYRVKHNTRMVPLEKVELAEAHRNALMQREENRGGKPAAAQA

SEQ ID NO: 21637 - protein, 262 aa, Chromobacterium violaceum ATCC 12472
MSRIANCFAELAGKKALIPFITAGDPHPGLTVSLMHGLVDGGADIIELGVPFSDPMADGPVIQRASERALKHKVGLRHVLEMVAEFRRDNATTPVVLMGYLNPLCAMGYTEFASRAKAAGVDGVLTVDCPPEEAAELESALDAHGLDTVFLVAPTTPPSRVAEIAKLARGYVYYVSLKGVTGAGHLDIEDVARKIAALRQQLPLPIGVGFGIRDAATAKAIAAAADAVVVGSRLVQEIEAATPETAREQLTRLVAELKAAIR

SEQ ID NO: 21638 - protein, 229 aa, Chromobacterium violaceum ATCC 12472
MKSYGAEFLGTFWLVLGGCGSAVLAAGFPNLGIGFAGVALAFGLTVVTMAYAIGHISGCHLNPAVSIGLWAGGRFPAGQLAPYIVAQVLGAIAAGAVLYVIASGGAGFDVAKGFASNGYAEHSPGGYSLLAALVCEVVMTMFFLLVIMGATDKRAPAGFAPLAIGLALTLIHLISIPVTNTSVNPARSTGVALFVGGWAVQQLWLFWLAPIIGAVLGAKVYRLIAGESE

SEQ ID NO: 21639 - protein, 316 aa, Chromobacterium violaceum ATCC 12472
MIKTELNYGDVYLVPKKTVVDSRKECDTSVQFGPRRFAMPVYPSNMKSVVSAETCELFAREGWFYTLHRFNVDAVAFTRYMQEQGLFASISVGVNDDTYEQLDALKAAGLSPEYMTLDIANAWCVKAERMIKHIKQHFPNTFLIGGNVATAEAARDLEAWGCDAIKAGIAGGRVCITKNKTGFHRPMVSTVRDCVAAVTIPVIADGGIVEHGDIAKALVCGATMVMAGSLFAGYDESAGDIVEIAGKHYKEYFGSASQFNKGAYVNVEGKKILVEYKGSMGKLLRELQEDLQSSVSYAGGTTLAALREVEMIQVYR

SEQ ID NO: 21640 - protein, 453 aa, Chromobacterium violaceum ATCC 12472
MAKNKTVFSCTECGGQSPKWQGQCPHCSAWNTLVEAVAAPAAASPRFQSWAANVTKVQKLSEVQTEETPRDPSGIDELDRVLGGGIVRGAVVLIGGDPGIGKSTLLLQALSQIGRSRKVLYVSGEESAQQIALRASRLALDTSSVDLLAEICIENILETLKREQPEVVVIDSIQTLYTEQVTSAPGSVSQVRECAAQLTRMAKQSGITVLLVGHVTKEGSLAGPRVLEHMVDTVLYFEGDSHSSYRMIRAIKNRFGAVNELGVFAMTDRGLKGVSNPSAIFLSSYRDDVAGSCVLVTQEGTRPLLVEIQALVDDCHGFQPKRLTVGLEQNRLSMLLAVLHRHGGVACFDQDVFLNAVGGVKINEPAADLAIILAMVSSLRNKALPEKLVVFGEVGLAGEVRPVTRGQERLKEAAKLGFTRAIVPTANKPRQEIEGLKVLAVDRLDQAVEYCRE

SEQ ID NO: 21641 - protein, 296 aa, Chromobacterium violaceum ATCC 12472
MYKHLEDFVGGTPLVRLKRLPGDNGNVVLLKLEGNNPAGSVKDRPALSMIRRAEARGDIRPGDTLIEPTSGNTGIALAMAAAMMGYRMVLIMPENSSAERVQAMRAYGAEVILTPAAGSMPAAIDLARSMEAAGEGRILDQFSNPDNPQAHYEGTGPEIWAETEGRITHFVSSMGTTGTIMGTGRFLKEKNPAIRIVGVHPEPGSQIAGIRKWEDPYVPKICDFSRIDEILHVGQKEAEDTARLLARREGILAGPSSGGALAVALRLDAQLRDAVIVSVVCDRGDRYLSTGLFDPA

SEQ ID NO: 21642 - protein, 480 aa, Chromobacterium violaceum ATCC 12472
MIPCILSGGAGTRLWPVSRMELPKPFIRMADGHSLLQKTFQRAARLPGVRRVMAVTNQQAMFRTLEECSEVNERQLALELLLEPAGRNTAPAIAAAALDMLERQEGSEAILLVLPADHLVTDEEAFAAAVQEAWELAEAGRIVAFGLKPSRPETGFGYIEQGEPLAGKGFEVARFVEKPDAAAAQAYLDDGRYWWNSGMLCFSALVMCDALARLAPEVLDGVEACLRASPCLSGAGRRQRELDKASFALCPDISIDYAVMEKTDNAAVVPCDLGWSDIGNWDSLMGEFPADGNGNSSSGEVLLCDTRRSFVQSRGRLIATLGVDDLLIIDTPDALLVADRKRSQDVRDIVAELKRRGHPAYLQHRTSQRPWGHYTVLEDGPRYKIKRIVVKPGATLSLQMHHHRSEHWVVVSGTALVVNGEDEKLVHCNESTFIPAGVRHRVANPGVIDLVMIEVQSGDYLGEDDIVRFSDHYGRSESAG

SEQ ID NO: 21643 - protein, 488 aa, Chromobacterium violaceum ATCC 12472
MDGGPILSLEALRRLEKAAAGDGLDLMRRAALAAADWVTRHCPPASSLLVCAGPGNNGGDALYAALELQKRGHPLTVLQPVAPASDACRAARLQAESAGIAILAELPDNAPTPALLIDGLFGIGLSRPLDASWQDLIARLNRLDCARLALDCPSGLDAYTGHALGAAIRADHTLTFLCHKPGLFGGPGADFAGRVELAALDCPAALYPEAEGELNRPSAAALARSRDSHKGSYGSVSVIGGAPGMLGAALLAGRSALAGGAGKVYLCALDDRLPVDPAAPELMMRPADESADIPAADVLAIGPGLGQQELAERLLELAISRACPLVLDADALNLLAVRRDLAARIAARGAPTVLTPHPAEAARLLKLDTREIQADRVGHARRLAALFNCVVVLKGAGSLIARPDGYYRVNDSGGPELASAGQGDVLTGLVAALLAQGLDAFDAASLAARLHGLAGDGYRAESGGPIGLTASATVPRLSRALNHLHAEG

SEQ ID NO: 21644 - protein, 218 aa, Chromobacterium violaceum ATCC 12472
MRLILLGAPGAGKGTQANYIREKFGIPQISTGDMLRAAVKAGTPLGLEAKAIMDAGGLVRDDIIIGLVKERIAQDDCANGFLFDGFPRTIPQAEAMIAAGVDIDYVVEIDVPDAAIVERMAGRRVHLASGRTYHVTFNPPKAAGKDDVTGEDLVQRDDDKEETVKKRLAVYHEQTAVLVGFYGKLAESGSAKAPKYVKIDGTRAVETVRDDVLKALGA

SEQ ID NO: 21645 - protein, 507 aa, Chromobacterium violaceum ATCC 12472
MKSIKPVLLLILDGFGHRTEGDDNAILHARMPVWSRLREQYAYGTINASENFVGLPSGQFGNSEVGHLNIGAGRIVQQDISRIDCDIEDGRFSSNDTLQQAMSKAQGSALHILGLLSDGGVHSHENHIHALIRAAQAAGVPKIYVHAFLDGRDTPPRSAETYLKRLDAALAECPNARLVSVTGRYWAMDRDKRWERVEPAYRLLVDGEGLFHAETGLDALKAAYERDENDEFVKATGIGAPVKMQDGDALIFMNFRADRARQLTSALTDPAFDGFKARQPKFGYYATLTSYGEAYSALPVAYAPQKIHNGMGEYLSSKGLKQLRIAETEKYPHVTYFFNGGEEQVYPGEDRILVPSPKVATYDLQPEMSAGEVTDKIVAAIQSGQYQAIFCNYANGDMVGHSGVFDAAVKAVEALDGCIERCVDAMLAAGGEVLITADHGNCEQMYDGEHHQPHTQHTTNQVPFLYIGRPAKIRAGGSLRDISPSLLAMMGLEQPAEMTGQSLIDFQ

SEQ ID NO: 21646 - protein, 456 aa, Chromobacterium violaceum ATCC 12472
MQDNSVLSLIGNTPLVRVSHLDTGPCELYLKLESHNPGGSIKDRIALTMIEAAERDGKLKPGGAIIEATAGNTGLGLALVAAQKGYPLTLVVPDKMSREKILHLQALGAQVVLTRSDVGKGHPEYYQDLAARIASETPGAYYIDQFNNPANPLAHETTTGPEIWRQMNGEVDAVVVGVGSSGTLTGLTRFFRAKAPATAFVLADPVGSVLADYVETGSFGQAGSWLIEGIGEDFIPPQTDLSMVKRAFRVSDQESFDTAQQLLRSEGILAGSSSGALLAAALRYCREQTEPKRVVTLVCDSGNKYLSKMYNRDWLVDQGMLRLPEVGGLTDLIVRRHQDGSTVSCHPDEPLNVAYQRMRLHDVSQMPVLDDDKVVGVLDEWDLLLSVHGEPENFRQTVATAMSSHVRTLSPQASLQDLLQVFNDGHIALIVDKGRYLGLITQADLLSFWRRQPRAA

SEQ ID NO: 21647 - protein, 202 aa, Chromobacterium violaceum ATCC 12472
MDAAGYVAGQDVMIALDCAASEFFRDGKYHLTAEKLSLSSEEFADYLENLVNKYPIISIEDGMAEQDWAGWKLLTDRLGQKVQIVGDDVFVTNPKILAEGIAKGVANSLLVKVNQIGTLSETLKAVDLAKRSRYTCVMSHRSGETEDSTIADLAVATNCMQIKTGSLSRSDRMAKYNQLLRIEEELGDAAHYPGRAAFYHLK

SEQ ID NO: 21648 - protein, 364 aa, Chromobacterium violaceum ATCC 12472
MNADKLLTPLTMGAVALSNRVVMAPLTRLRNIEPGDVPGPLAKEYYRQRASAGLIVAEGTHISPTAKGYAGAPGIYSEEQVRAWSEVTGAVHQDGGKIALQLWHTGRISHRSLQPNGDAPVGPSAIQADSRTNIRAADGSLVREQCDTPRALEIEEIEDIIEDYRRAADNARRAGFDMVEIHGAHGYLIDQFLSPAANVRTDQYGGSVENRARFLLEVVDAVVAEWDADHVGIRISPLGIFNGVSNTDQLDMALYLAEQLAKRKLAFLHISEPDWAGGPTLDDGFRAELRQRYPGVIIGAGGYSAEKAETLLKKGFIDAAAFGRSYIANPDLVERLKQNAPLNPPKPDTFYGGGAEGYTDYPTL

SEQ ID NO: 21649 - protein, 158 aa, Chromobacterium violaceum ATCC 12472
MSIYDFSFRRLDGSEQAMADYRGSVLLLVNTASRCGFTSQYAGLEALHRRFGPQGLAIIGFPCNQFGAQEPGDAGEIGAFCQKNYGVDFAMADKVDVNGANAHPLWQYLKRQKRGLLGQAIRWNFSKFLVDRQGRVVARFAPFTRPEKLAARIEALLK

SEQ ID NO: 21650 - protein, 310 aa, Chromobacterium violaceum ATCC 12472
MRIANTITDLIGNTPLVKLNRVTEGVGATVVAKLEFFNPAHSVKDRIAVAMLDAAEQAGKIGPNTVIVEPTSGNTGIGLAMVCAARGYKLVITMPETMSKERRQLLKAYGAELILTPGPDGMGGAIAKAKALVDEFPDTYFMPQQFENPANPEIHRHTTAEEVWNDTDGKVDIFVAGVGTGGTITGVGEVLKARKPGVQIVAVEPDASAVLSGSPKGPHPIQGIGAGFVPAILNTGIYDEIIRVKNEDALQTAREVATKEGILVGISSGAAVWSALQLAKRPENAGKLIVVVIPSFGERYLSTVLFEHLG

SEQ ID NO: 21651 - protein, 273 aa, Chromobacterium violaceum ATCC 12472
MTPLLQAPRLMPGLSLKLEYLNPSLSIKHRSLPKTLLARAEAGRIGRGTTLAIMTAGSAGVSVAWAASQIGCKALLLMPESAPDSVVNYARWLGAAVERRPHPQLQELLDAHRGMPDSHVVEQLSDAELIGHYRAVGEELLRQSPGLAAVTVPAGTCASLMGIAEALAPAGIPVYAAEPAEAAVLSGEPWRPHDIPGLAPPAPTKLFRREAVAGIVPVASALAWSTAREALAACGEPVGPSSGAAIAAARALRRQGVDGDIAAVCSSHMATSL

SEQ ID NO: 21652 - protein, 442 aa, Chromobacterium violaceum ATCC 12472
MSARQLDVGDLINRQRFSARQWRILMLCFLIVLCDGFDTAAIGYIAPAVIRDWGVARTQLGPVMSAALWGLAAGALLAGPLADRIGRKRVLLGAVLLFGAMSVATSAAADLAALAWLRFATGLGLGAAMANAVTLTSEYSPEPRRAFIVSAMFCGFPLGAACGGLLASWLVPHAGWRSVLLLGGIAPLLLLPPMWLSLPESLRFLILRGREGEARRILRRLLPDAPLRDGDRLVLREAERMPGLRLVWSADYRTGTLLLALAYFMGLLIFYLLTSWLPILISDSGMDLRQAALLTALFPFGGLLGSTLTGWLMDRCDAHRVLALAYLLTGALVFCIGQALNNHGLLAAVICLAGIAMNGAQASMPSLAAGYYPTAGRASGVAWMMGMGRFGGIAGAMLGATLLKLQLGLPLFFALLSLPALLAAAALLLKRRSIAMARRAWA

SEQ ID NO: 21653 - protein, 319 aa, Chromobacterium violaceum ATCC 12472
MFTWLKNRLQRNGLTAYVTHPDCLQHNMGVGHPECPERLTAIRDQLMASQIFDSLQEIEAPEVSYEQLARVHPPRYVEYLEACAPSVGTFRMDPDTAMSPGTLKAARRAAGAVVKAVELVAEDKAPNAFCAIRPPGHHAESDKAMGFCFFNNLAVGVTHALAHYKFERVAVVDFDVHHGNGTEEILHDDPRVLMVSVFQHPFYPYSGDEPMGPNMHNVPLKAGSGGREFREAVENVWLPQLHEFQPQMLFISAGFDAHREDDMGSLGLTESDYEWVTRHLVQIADQYCAGRVVSVLEGGYDLSALGRSVAAHIRVLSDG

SEQ ID NO: 21654 - protein, 432 aa, Chromobacterium violaceum ATCC 12472
MQLLESFFKLKEHGTTVKTEVIAGFTTFLTMAYIVLVNPLILSSTGMDLNAVFVATCLAAALGTAIMGLVANYPIALAPGMGLNAYFTFSVVKGMGLSWETALGAVFISGIVFLAVSLFKVREAIVNAIPQSLKFAISAGVGMFLAIIALKNAGVIAAHPATYLTLGDIHNPTTLLAILGFFLIVALEYRKVPGSIIIGILVVTVLSIAFGLSPFKGIVAPVPSMAPTFMAMDIKGALNAGLIGVIFVFFFVDLFDTTGTLVGVSHRAGLLDKDGKLPRLKRALMADSIAITAGAVMGTSSTTAYIESAAGTAVGGRTGLTAMVVALLFLAALWLSPLAATVPPYATAPALCYVAVLMARGLAEIEWNDLTESAPAVMTALAMPFTFSIADGIAFGFISYAVIKILAGRFSDLRPAVLIIALLWIFKLAFFH

SEQ ID NO: 21655 - protein, 159 aa, Chromobacterium violaceum ATCC 12472
MTTLYDFSAQRADGAEQALSAYEGRVALLVNTASECGYTRQYAGLQELQDYFAGQAFVVLGFPCNQFGGQEPGGEDEIVDFCRSRFGVSFPLFAKLQVNGDGAHPLWRWLTQADSDRPHPIKWNFTKFLVDGRGRVVKRYEPAVEPHELVDDIKALLAR

SEQ ID NO: 21656 - protein, 316 aa, Chromobacterium violaceum ATCC 12472
MTHNVVFLDRDSLPVPVPVFGFPVHYREYPATASEQLAAHAAGADIVISNKVPLSREAIAALPELRLVAIAATGYNHVDLDACRERGVAVCNIRHYGDHTVAEHAFMLMMALMKNLPAYQRDVAAGVWSQSRQFCHFGAPIREVRGATLAIVGSGGIGGRLAQMARAFGMEVLFAERKGATRVREERVPFDEALARADVVSLHCPLTEETRGMIAQPELMAMKPGAILINTARGGLVDEADLVAALKYGQLGGAGFDVLSSEPPSPDNPLLKARLPNLIVTPHVGWASGEAMRRLAAQLVANIEAFVDGRKVNRLI

SEQ ID NO: 21657 - protein, 108 aa, Chromobacterium violaceum ATCC 12472
MSELIIEELQVGEGAEAVTGQEVTVHYTGWLTDGTKFDSSKDRMQPFSFPLGAGYVIKGWDQGVQGMKVGGKRKLTIPSELGYGARGAGGVIPPHATLVFEVELLQVG

SEQ ID NO: 21658 - protein, 445 aa, Chromobacterium violaceum ATCC 12472
MSRKYFGTDGVRGEVGKFPITPEFVMKLGYAAGRVLVNHDQDSRPTVLIGKDTRISGYMLEAALQAGFTAAGVNVLLTGPLPTPGIAYLTRALRLEAGVVISASHNPFQDNGIKFFAEGGNKLDDALELEIEAMLDQPMATNPSLELGRARRIDGAAERYIEFCKSTFPNELSLKGLKLVVDCANGATYHIAPKVFHELGAELVEIGCEPNGYNINDKVGATYPKTLQMAVLEHQADFGIALDGDGDRLIMVDAAGRVYDGDQLIYVIAKARAARGELKGGVVGTVMTNMAMELALQKQGVPFGRAKVGDRYVLEMLHADGWQVGGEASGHILCLDKHSTGDGIISSLQVLASLKQLGLSLAEICADWRPFPQTLINVRHNGCDWKAASAAPLAEAEAALQGRGRVVLRPSGTEPVVRVMVEADDKALADTWAKAIAAAIEKVSA

SEQ ID NO: 21659 - protein, 1018 aa, Chromobacterium violaceum ATCC 12472
MQVTRRQLFKLTAAQLGASSLVAMGFAPQQALAEVRQFKLLGARETRNTCTYCSVGCGLILYGLGDGAKNAHGEIYHIEGDPDHPVSRGSLCPKGAGLLDFIHSPKRLKYPEVREPGSGEWKRIGWDEAISRIARLMKDDRDAHIVEKNAAGVPINRWLSTAMLTASAGSNETGIISQKFIRSLGIVATDAQARVCHGPTVSALASTFGRGAMTNSWVDIKNADFILVMGGNAAEAHPVGFKWAIEAKKTRGTRLIVVDPRYNRTASVSDLYLPIRVGSDIAFLGGVINWLIQHDKIHWDYVKAYTNAALIVRDDYRFDEGLFSGYDAAKGKYDKSSWNYELGDDGYAKTDPSLQHPRCVWQLLKQHYSRYTPEMVNTICGTPVDGFLQVCKELGETARPDKAGTILYALGWTQHTTGSQNIRTMAMIQLLLGNIGMPGGGVNALRGHSNIQGLSDLGLLSTQLPGYLTLPSEADHPDLATYLAKTTPKALQANQFNYWSNTPKFFVSLMKWMWGDNAGKDNDWGYDWLPKWDKMYDVLHMAELMYQGKMNGFIVQGFNPLASFPDAAKVTEAFSKLKYMVIIDPIATETSTFWQNHGDAHDVDPAKIQTTVFRLPSTCFAEEDGSIVNSARWLQWHWKGAQPPGEARGDNEIIGELFVAIRDLYRKEGGKLADPILKVNWNYRNPKAPTPSELAMEMNGKALADLPDPADPSKTLVKKGEQLPGFAALQDDGRTACACWIFSGCWTQAGNQMARRDNTDTGLGNTPGWSWSWPANRRILYNRASCDPAGKPWDPARKLISWNGEKWVGGDVPDFKADAAPDSGMQPFIMNPEGVGRLFCADKLVDGPFPEHYEPMESPIGTNPLHPKVVSSPAVRLFDSDRKRLGTHKDFPYVGTTYRLTEHFQFWTKSVLLSAIAQPEQFVEIGEALAREKGIAQGDMVKVSSNRGFVKAKAVVTKRLMALKVNGQTVHQIGIPLHWGWEGVARPGYLTNALPPAVGDCNTQTPEYKAFLVKLEKL

SEQ ID NO: 21660 - protein, 288 aa, Chromobacterium violaceum ATCC 12472
MRIGYIGLGIMGRPCVLNLLKAGLPVSVWARRRESAASLLEAGAAWADSPAELAGQVDVLVTNVSDTADVEAVLLGEQGAIHGAKPGLVCVDMSTISPNGARRIAAALAEKGVDFLDCPVSGGEVGAINGTLTIMAGGREEALEKARPALQAMGQTITHIGASGAGQVAKACNQIAVAVGVAAVAEIVKLAKACDVDPAPVRAALMGGFAQSRVLDVHGQRMIDDNYAPGFKAKLHAKDMHIVIDTAREQGISLPAAERTMRLIDQLVEQGDGELDSSAIARLIWQQN

SEQ ID NO: 21661 - protein, 180 aa, Chromobacterium violaceum ATCC 12472
MPNIAEARGLINSSDVLFTAEQVSAAVDRMAVEITEKLGEEYPLVLSVMGGAVVFTGQLLPRLAFPLDFDYVHVSRYGDKTHGGELVWKQAPKEDVRDRVVLVLDDILDEGHTMAAIRDKVMSMGAKAFYSGVFANKLISKEKPLAADFVGLDVPDRYVFGYGMDVRGAWRNLPAIYALK

SEQ ID NO: 21662 - protein, 395 aa, Chromobacterium violaceum ATCC 12472
MAASTQRAPFAWEDPLLLQDRLTDDERLVQQSAHEYCQERLLPRVLMANREERFDREIISEMGELGFLGCTIEGYGCAGLSHVAYGLVAREVERVDSGYRSAMSVQSSLVMHPIWAYGSDAQKDKYLPRLASGEWLGCFGLTEPDSGSDPASMKTRARKVDGGYLLSGSKMWITNSPAADVFVVWAKDDDDEIRGFILEKGMKGLSAPAIHGKFSLRASITGEIVMDDVLVSEDQLLPGVKGLKGPFGCLNKARYGIAWGAMGAAEFCWHAARQYTLDREQFGRPLAANQLIQLKLANMQTEIALGLSAALQVGRLMDEGRAAPEMISLIKRNNCGKALDIARVARDMHGGNGICDEFHVIRHVMNLEAVNTYEGTHDVHALILGRAQTGIQAFA

SEQ ID NO: 21663 - protein, 421 aa, Chromobacterium violaceum ATCC 12472
MSQQQLMQRKSDATPRGVGVMCSFFADRAKNAEVWDTEGRRYIDFAGGIGVLNTGHLHPKVEAAVAEQLSRFSHTCYQVVPYESYISLAEKLNALAPGKHAKKTAFFTTGAEAVENAVKIARAATGRPGVIAFGGAFHGRTLMGMALTGKVAPYKLGFGPFPSDVYHAPYPNTLHGVSVQDSLVGLEKLFKFDIDPARVAAIIYEPVQGEGGFYAAPAEWVKALRELCDRHGILLIADEVQSGFARTGKLLASEHFDAVPDLITMAKSLAGGFPLSAVTGRAEVMDAPAPGGLGGTYAGNPLALAAAHAVLDVIDSEKLAERAQRLGDALKEKLNGLKSAVPQIAEVRGLGAMIAVEFNQPGSHQPDPDFAKKVQQHALANGLILLTCGIYANVVRFLFPLTIEDEIFAEALGKLEAALKA

SEQ ID NO: 21664 - protein, 486 aa, Chromobacterium violaceum ATCC 12472
MLNLQDPSLLRQQCYLGGEWLDADGGQHIAVHNPATGEKIGQVPKMGAAEAERAVAAAARAFPAWKAKSAKERAAILRRWFDLIIAHQQDLAIILTSEQGKPLAEAKGEIAYGASYIEWYAEEAKRVYGDIVPGPAGDRRVLVTKEPIGVTAAITPWNFPSAMITRKAAPALAAGCTMVVRPASQTPLSALALAELAERAGIPAGVFSVITGGSSEIGAVLTGSDTVKKFSFTGSTEVGRKLIAQCAGTVKKVSMELGGNAPFIVFDDADLDAAVEGALISKYRNAGQTCVCANRIYVQDGVYDAFAEKFAAAVATLKVGNGLEAGVSQGPLIDHNAVAKVEEHIADALAKGGRLIAGGKRHALGHTFFEPTLIADVTRDMKVAREETFGPLAPLFRFKTEEEAIRLANDTEFGLASYFYARDVGRIFRVAEGLEYGMVAVNSGLLSNEAAPFGGVKQSGLGREGSKYGIEDYLEIKYVLLGGLDR

SEQ ID NO: 21665 - protein, 476 aa, Chromobacterium violaceum ATCC 12472
MGENKMSDVFQFMKLSRNPGEKVEASVRKVEFKEIYQPLHAVDAADQAGRCLSCGNPYCEWECPVHNYIPNWLKLVEEGRLFEAAELSHQTNSLPEICGRVCPQDRLCEGACTLNQGGFGAVSIGSIEKYITDEAFKAGWRPDMSKVVWTDKTVGIIGAGPAGLACADVLVRNGVKAVVYDRYEEIGGLLTFGIPEFKLEKSIVHRRREILEGMGVEFVLNTEVGKDISFDKLMIKHDAVFMGMGAYKAMRGGFPGEDSKGVLQALPYLINNVRQSMGTLPVDEAAISMKGKRVLVLGGGDTAMDCNRTAIRQGAKRVICAYRRDEANMPGSRREVSNAREEGVEFLWNRQPLAIEPMIGGTLAVKLGETRLSEAGAKGRSAVELVPGGGEVLECDHVIIAFGFQAEAAAWFDACGVRTENGSGRTKVSRGGKYPYQTSNPKVFAGGDQVRGADLVVRAVFEGRQAAESLCAYLFD

SEQ ID NO: 21666 - protein, 304 aa, Chromobacterium violaceum ATCC 12472
MNLQALIEDIRQQVLPFYDQGRVADYIPALASVPPHQFGIAIHTLDGREHACGDADTPFSIQSISKAFMLALTLQADGEQLWRHVGKEPSGNPFNSLVQLEYEHGIPRNPFINAGALVVTDRAIGHFGDAHARLLAWLREETGNAGLMADQAIAASERAHGDRNAALAHFMKSYGNLGHPVETVLDQYFHNCSIAMSCRELARAGLFLANHGLSPQTGTQYLSRSQAKQVNAVMLTCGTYDAAGEFAYRVGLPVKSGVGGGLLAVIPGKMAIAAWSPQLDARGNSVLGLEALDRFTTRTGLSIF

SEQ ID NO: 21667 - protein, 448 aa, Chromobacterium violaceum ATCC 12472
MSNQAWLERSFAAVWHPCTQMKRHERLPIVPIASADGVWLTDFDGKRYLDGVSSWWVNLFGHGHPRIKQAVRKQLDSLEHVMLAGFTHRPVVELSERLAALSGLGHAFYGSDGASATEIALKMSFHYWKNVGRPQKTRFVSLENSYHGETVGALAVTDVPLFSSTYAELLKPGLRAPSPDARQAVPGERAADVALRAARSLENLLAKHGGEIAAVIVEPLVQGAAGMAMHDPIYLTELRRLCDQYQVHLIADEIAVGFGRTGSFFAYQQAGITPDFLCLSKGITGGFLPLSCVLTRDEIYQAFYHDDVARGFLHSHSYTGNALACAAALAVLDIFDDEDVLEANRVKAEGFTRQMRPLAERPEIRHFRQRGMIWAFDVDTARSDFALAYFSAMLNRGCLLRPIGKSVYFMPPYTLKSEEMDWLASASVDALDEVLAGESVGGDPTALP

SEQ ID NO: 21668 - protein, 456 aa, Chromobacterium violaceum ATCC 12472
MSEAHTGLQRELKNRHIQLIALGGAVGTGLFLGSASVLKSAGPSMILGYAIAGFIAFMIMRQLGEMVAEEPVAGSFSHFAYRYWGRFPGFLSGWNYWVLYVLVSMAELTAVGAYVQYWWPHVPAWLTALVCFVCINGINLANVKSYGETEFWFALIKVAAVIGMILFGGYLLLSGSGGPQASVSNLWNDGGFFPHGVKGLFMMMAVIMFSFGGLELIGMTAAEANDPQKTIPKAVNQVIYRILIFYIGSLVVLLSLYPWNKVAAGGSPFVMIFEQIGAGFTAHALNFVVLTAALSVYNSCVYATSRMLFGLARQGNAPRALGKLDTRGVPVYATLFSAAATFACVILNYLLPGEALGLLMSLVVAALVTNWAMISLTHLKFRRAKGGQKLVFPSFWFPLSNWICLAFMVMILGILLFTPGMAVSVYVLPVWLGLLWLGFRLKKPSPAEARLAGENA

SEQ ID NO: 21669 - protein, 421 aa, Rhizobium leguminosarum bv. viciae
MTRRFTRRGGKMSKIIIVGGGECGARAAFALREQGFNGDITLIGAEPHLPYERPPLSKTGLASAAPPQYVAGPARYEEARITILTGVPVDTVDRQSKLVRLSDGRKFPYDQLLLATGARPRPFAGVSGDPGLGRICMLRNHGDAVAIHEALAPGKSLAVVGGGFIGLEIAATARKLGAEVLLIESSPRVLSRGVPAEIAKVVTERHRQEGVNILCGEQITSIATENDKVQILFANGTTRLADIVVVGIGVIPNVELAEAAGLLIDNGIAVDATLRTSDPDIFAAGDCCSFPLSHYRERRVRLEAWRNAQDQGMLVAANLLGRGLAIASVPWFWSDQYELTLQIAGLSDGAATTVRRDLDQGAFILFHLDGEDRLIAASGIGPGNAVARDIRLAEMLIAAKRRLDPEALASPKTNLKKLLAA

SEQ ID NO: 21670 - protein, 174 aa, uncultured marine gamma proteobacterium EBAC31A08
MNKFYIFGLLFFTLNAFSCSDLLDTDMRVLDSAESRNLCEFEGKALLVVNVASRCGYTYQYAGLQKLYESYKDEDFLVIGIPSRDFLQEYSDESDVAEFCSTEYGVEFPMFSTAKVKGKKAHPFYKKLIAESGFTPSWNFNKYLISKEGKVVSTYGSKVKPDSKELISAIEGLL

SEQ ID NO: 21671 - protein, 416 aa, uncultured marine gamma proteobacterium EBAC31A08
MPGGVNSPVRAFKNINGNPIFFERASGAYLYDADHNEYIDYIGSWGPMIMGHSHPDIVGAIKNQVALGTSYGAPTSLESDVARLIKKCIPSIEKIRMVNSGTEATMTTIRLARGFTGRNKIIKFDGCYHGHVDSLLIKAGSGVATFGLPDSPGVPADLAKYTFSCEYNNKEQFLEIFNEIKDDLAAVIVEPVAGNMGFVPGHEDFLKLLRETTSANNSILIFDEVMSGFRVSLGGAQEIYNITPDLTALGKVIGGGLPVGAFGGKEEIMNYLAPSGPVYQAGTLSGNPLAMAGGTALLQLLIKENPFKELERNASVLLDGMKTLMIESGIPFSINRIGGMFGFFFSEELPNNINDVAKTDDVLFSNFLNSCIRSGIYFAPSKYEAGFISAMHKDQEINRTLETVKQIIQKGITHEI

SEQ ID NO: 21672 - protein, 425 aa, uncultured marine gamma proteobacterium EBAC31A08
MSCLVLKILEIFGHLIFELKPRYNIFMKEIIKEYTNYMVPFYAPADFVVKKASGSHVWDLNNKKYIDFTAGIAVTNLGHSNKDLIKILKKQSEELWHLSNLYINEPSVTLARKLCKNSFADKVFFCNSGAESIEAAVKIARKFCSSTVNKNKNEVISFSTSFHGRTMLGIALAKAKHLTDGFAPLPRGIKNHPYNDITNLEKVFSDKTAAVILELVQWQSGITKADKKFIAKIKKLAKKHKALVIIDEVQSGIGRTGTLFAYEQFNITPDILCFAKGISNGFPLGGILTSDKVSKHMSAGSHGTTFGGGPIACAIGNEVIDTISKKSFLNKVLKKEVRFINLLNKINEKHKCFEKITSAGLWVGVEVSKDSKIQIDDLIKKSHHNGLMILKANASTVRFSPSLIIENELVDEGLKIFEKSIISLL

SEQ ID NO: 21673 - protein, 351 aa, uncultured marine gamma proteobacterium EBAC31A08
MKSYQVFENAQPIKEVELDTPIPEGDEVLIKTIACGVCHTDIHIHDGFFDIGNGKKMTSRMVQPLAMGHEVFGEVVSFGQNVKNIEVGKKFVVYPWIGCGECEPCQADNEHECGPLTAENIGVAVDGGYGEYVLVKHSKYLFDAGNTPDDLAGSYACRGLTAYSSLKKANLKPNENKLVIISAGGLGLLALKIAKAAFNVSPIVVDIDDSKLEIAKAAGASEVINSSHEGAKKRIMDLTEGGATTVIDYVGAEASIQFGYDLFGFNKNGLYILVGMLGGKFEVQLPLMTFSSRVLQGSYLGSIQEMKELMDLVRAGKIEPVPVEARHVSMANDTIADLKAGNIPGLVCLKH

SEQ ID NO: 21674 - protein, 444 aa, Streptomyces coelicolor A3(2)
MTALPQERRVVTAIPGPKSQELQARRTAVVAQGVGSTLPVFVARAGGGVIEDVDGNRLIDFGSGIAVTSVGASAEAVVRKASAQLADFTHTCFMVTPYEGYVAVAEALAELTPGDHAKKSALFNSGAEAVENAVKIARAYTKRQAVVVFDHGYHGRTNLTMALTAKNMPYKHGFGPFAPEVYRVPVAYGYRWPTGAENAGPEAAAQAIDQISKQVGAENVAAVIIEPVLGEGGFIEPAKGFLPAIREFASDNGIVFVADEIQSGFCRTGQWFACEDEGIVPDLITTAKGIAGGLPLSAVTGRAEIMDAAHSGGLGGTYGGNPVACAGALGAIETMKELDLNARAKDIEAVMKSRLAAMAEKFDVIGDVRGRGAMIAIELVKDRETKEPNPAATAALAKACHQEGLLVLTCGTYGNVLRFLPPLVIGEDLLNEGLDIIEQAFTRV

SEQ ID NO: 21675 - protein, 395 aa, Medicago sativa
MDRKLSITTIVLSLLFATLGIAQPNIFDIKSFGGASHADITMAFTNAWKAACGSTTASKVMIPRGVYKMHAVDVKGPCKAPIEVQVDGTIQAPQNPDELNDAYQWIKFGYVDYFTLSGKGVFDGNGETAWRQNDCGKNSTCKRRSMNFGFNFLKHSIVRDITSKDSKNFHVNVLGCTNFTFDSVTITAPVTSINTDGIHIGRSTDVKVLNTNIATGDDCVSLGDGSRQITVQNVNCGPGHGISVGSLGKYPKEEAVEHVLVKNCTITNTDNGVRIKTWPSSPGTSPITDMHFEDIIMVNVLNPVIIDQEYCPWNQCSKLVPSKIKISKVIFKNIRGTSKTKDGVVLICSKSFPCDAVELNNVALTFNGAPVNAKCVNVKPILTGPTPKCTTAAEA

SEQ ID NO: 21676 - protein, 250 aa, Streptomyces coelicolor A3(2)
MSKLRVAVLGAKGRIGSEAVRAVEAAEDMELVAALGRGDGLEALAESGAQVAVELTTPASVMDNLDYCLRHGIHAVVGTTGWTDERLARLNAWLDASPGTGVLIAPNFSIGAVLTMKFAQIAAPYFESVEVVELHHPNKVDAPSGTATRTAQLIAQARQKAGSAPAPDATATALDGARGANVDGVPVHAVRLRGLLAHQEVLLGAEGETLTVRHDSLHHSSFMPGILLGARRVVTTPGLTFGLEHFLDLN

SEQ ID NO: 21677 - protein, 302 aa, Arabidopsis thaliana
MSSKDKKLSKPTSGRTGGIRTLSDLNRRSEPDSDSDSDGPQEYFTGGEKSGMLVQDPTKEPKHDDVDEIFNQARQLGAVEGPLEHPSSSRSFTGTGRLLSGESVPTALQQPEPVIHNIIFWSNGFTVDDGPLRKLDDPENASFLDSIRKSECPKELEPVDKRAPVHVNLMRRDEKCPEKEKLKVSFQGVGRTLGGASSSTASSQSNLTDVAAVQSPLQSLVVDETLPSTSIQLRLADGTRMVAKFNNHHTVNDIRGFIEFSRPGNPNNYTLQVMGFPPKPLTDPSQTIEQAGLASSVVIQKF

SEQ ID NO: 21678 - protein, 237 aa, Arabidopsis thaliana
MAILSASSTIVRAALDTQPKLRYNPNAPRNVKKNSNLSSFVPPSSPSSSSPATNLSVSVSDLLKRPASKDIGDGFDDTCVGYEKWFPSPPKVEKPRSVFNAASLAYIGDSIYEIYARRHFLFPPLSIEEYNDRVRAVVRCEAQYALLQKLVDDDFLTKDERDILRWGKNVGSVKTRSTRRAGVAVYNKASSLETLIGYLYLSNGKRLEEMMQKLGFSSGSSTERMVKEAGSNKPSFK

SEQ ID NO: 21679 - protein, 432 aa, Saccharomyces cerevisiae
MTVNDKKRLAIIGGGPGGLAAARVFSQSLPNFEIEIFVKDYDIGGVWHYPEQKSDGRVMYDHLETNISKKLMQFSGFPFEENVPLYPSRRNIWEYLKAYYKTFIANKDAISIHFSTEVTYLKKKNSQWEITSKDELRTTKSDFDFVIVASGHYSVPKLPTNIAGLDLWFDNKGAFHSKDFKNCEFAREKVVIVVGNGSSGQDIANQLTTVAKKVYNSIKEPASNQLKAKLIETVQTIDSADWKNRSVTLSDGRVLQNIDYIIFATGYYYSFPFIEPSVRLEVLGEGVTGDKHSSVNLHNLWEHMIYVKDPTLSFILTPQLVIPFPLSELQAAIMVEVFCKSLPITTTFDSNACGTHNFPKGKDLEYYAELQELLNSIPRRVGHFEPVVWDDRLIDLRNSSYTDKEERNVLLAEHAQALKKKKAPYFLPAPHT

SEQ ID NO: 21680 - protein, 379 aa, Sorghum bicolor
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCRSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEARKFGCTEFLNPKDHKKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHSVPFTEINKAFDLMAKGEGIRCIIRMEN

SEQ ID NO: 21681 - protein, 343 aa, Xanthomonas axonopodis pv. citri
MGIRIHRLRKQFETFTALDNIDLEVRQGELLALLGPSGSGKTTLLRIMAGLEHADGGQVLFGDEDATRMSVQSRRVGFVFQHYALFKHMDVFENIAFGLRVRRGNARWAEARIRARVEELLALVQLQGLEQRYPTQLSGGQRQRVALARALAIEPRVLLLDEPFGALDAQVRRDLRRWLRELHERTGLTTVFVTHDQEEALELADRVAILNRGRIEQLDTPAMIYDKPASPFVYSFVGAVNRIPGVLAQGQIQVAGHALPLANAALAAGPVEVYVRPEDLVPDQAGWPATVAWSQRSGSRLRLRATLEPSGNEVEVELPASAGSFQPGQQVRLAARQYGIFPA

SEQ ID NO: 21682 - protein, 346 aa, Agrobacterium tumefaciens str. C58
MEVKVSGITKQFDRFPALNDVSLDIRSGELIALLGPSGSGKTTLLRLIAGLEQPTQGQIFFGDEDASHRTVQERNVGFVFQHYALFRHMTVADNIAFGLKVRPSASRPPKAEIRRRVSELLDMVHLTGLEKRYPTQLSGGQRQRVALARAVAIEPKVLLLDEPFGALDAKVRKELRRWLREFHDRTGHTTVFVTHDQEEALELADRVVVMSQGKIEQVGTADDVYDTPNSPFVFSFIGESSSLPVTIRDGHVLFQGESIGINEGGTGEGELFFRPEDVVLTDEKDALYGKVTTCRRLAGTRIAEIDIANNGHEPYHLEIEVPLNAAVAVGAELRFRPTRWKVFGKK

SEQ ID NO: 21683 - protein, 339 aa, Caulobacter vibrioides
MTIAIRSVEKQFGRYPALNKVDLEIADGELLALLGPSGSGKTTLLRTIAGLEFPDAGQVLFDGQDVTYASAAARRVGFVFQQYALFKHMTVAKNIAFGLDVRKGKDKPSKAEIARRVEELLKLVELEGLGGRYPSQLSGGQRQRVALSRALAVQPSVLLLDEPFGALDATVRKSLRRELRRVHDATGVTTIFVTHDQEEALELADRVAILNNGRIEQIGTPDQVHDAPETAFVCGFVGEANRFDGQVSGGRFKAGALTVPASALKDGAATAYVRPHDFALDEAGFEVLIERAQVQGALTAVTALTSDGRRLEISASRADADRFTGAVKIVARKAHVYAA

SEQ ID NO: 21684 - protein, 350 aa, Cucumis sativus
MSIEVRNLSKRFGQFRALNDVSLHIETGELVALLGPSGCGKTTLLRIIAGLESADNGSVLFAGEDATSVDVRQRQVGFVFQHYALFKHMTVFENVAFGLRVKHRSQRPSEDQIQRKVHDLLGLVQLDWLADRYPAQLSGGQRQRIALARALAVEPRVLLLDEPFGALDAKVRKELRRWLRRLHDELNVASVFVTHDQEEALEVADRVVLMNAGRIEQVGTPREVWEGPATPFVYGFLGDVNQLQGVASRGVWEGAGLSLPAPELAQAENQRATAYVRPHEFLYTPAAQEIIAKNYYRPIDKTVAAKYESKFPKVKLVTIDDKIFGGWRKAQKDHFSDGGTFDQIYQPQKK

SEQ ID NO: 21685 - protein, 262 aa, Schizosaccharomyces pombe
MSIVNILSVNVLNNPAKFSDPYKFEITFECLEPLKSDLEWKLTYVGSATSQSYDQILDTLLVGPIPIGINKFVFEADPPNIDLLPQLSDVLGVTVILLSCAYEDNEFVRVGYYVNNEMEGLNLQEMDDAEIKKVKVDISKVWRSILAEKPRVTRFNIQWDNPDFDDAPPVQPDADEEEEEEEADEMEEEFDEEGEGDEEEEEEDDGDGDGEGDGDGEGENDGKGSEEEEEEEIDIEEEEEESALANASAAEEKPEEKPETSQ

SEQ ID NO: 21686 - protein, 295 aa, Pseudomonas putida
MRIAFIGLGNMGAPMARNLIKAGHQLNLFDLNKTVLAELAELGGQISPSPKDAAANSELVITMLPAAAHVRSVYLNDDGVLAGIRPGTPTVDCSTIDPQTARDVSKAAAAKGVDMGDAPVSGGTGGAAAGTLTFMVGASAELFASLKPVLEQMGRNIVHCGEVGTGQIAKICNNLLLGISMIGVSEAMALGNALGIDTKVLAGIINSSTGRCWSSDTYNPWPGIIETAPASRGYTGGFGAELMLKDLGLATEAARQAHQPVILGAVAQQLYQAMSLRGEGGKDFSAIVEGYRKKD

SEQ ID NO: 21687 - protein, 425 aa, Chromobacterium violaceum ATCC 12472
MSRNLELFERGKQVIPGGVNSPVRAFGQVGGTPRFVARAEGAYFWDADGKQYLDYVGSWGPAIVGHAHPEVVKAVQDAAVGGLSFGAPTEGEVVIAEEICKLLPSVEQVRLVSSGTEATMTAIRLARGFTGRDLIVKFEGCYHGHSDSLLVKAGSGLLTFGNPSSGGVPADFTKHTLVLQYNDVEQLSRTFAEIGDKIACVILEPIAGNMNLIQPSREFVQALRQLTEKHGAVLIYDEVMTGFRVAKGCAQGLHGVTPDLTTLGKVVGGGMPLAAFGGRADIMGKIAPLGTVYQAGTLSGNPLSVAAGLATLKLIQQPGFYETLGSRTARLAQGLAEEARKAGVTLSTDSVGGMFGFYFSDKAPKSYAEATGCDIERFKRFFHAMLDEGVYFAPSAYEAGFVSAAHSEQMIESTLAAAGRAFARL

SEQ ID NO: 21688 - protein, 324 aa, Chromobacterium violaceum ATCC 12472
MSQAIVFAETGGPEVLRLQSAEVGQPGPGQARVRHTAIGVNFIDTYQRSGLYPTPLPSGLGSEAAGVVEAVGEGVAGLRPGDRVAYAGGPLGAYSTERLIAAEHLVKLPDGIADETAACAMLQGMTVEYLVQRTFPVQPGQTVLWHAAAGGVGQIALQWLSAMGVQVIATVGSQAKAEIARSLGAAHVILYREEDVAARVREITGGRGVPVVFDSVGKDTFESSLDSLAPRGMMITFGNASGPVPALSPLELTKRGSLFLTRPKLGDYIASRTDLEASSAALFSRLRDGTIKLSPSHRYPLAEAAQAHRDLEARRTTGSIILQP

SEQ ID NO: 21689 - protein, 268 aa, Chromobacterium violaceum ATCC 12472
MVSPGPAIAWVNDDLVHGGGYPVPVRIYHPEPGAALPVLVFLHGGGHMAGGVSVYDGIHRRLAAASRHIVVAAEYRLSPENPYPAGLDDALCVARHVWDTLDGRGLAYRRRLSLAGDSAGGALCASVSGLAGRDPSLDIARQALIYPCVDYTLDQPSVAENGEGFFLTRARTDWYFDNYFQHGEDRRQASPLHWEAHGQMPATLLITAGHDILRDQGQQYARKLQAAGAEVALLHLEDQVHAFLNMEALVPEVCELAYRRIGAFLNAG

SEQ ID NO: 21690 - protein, 272 aa, Chromobacterium violaceum ATCC 12472
MSTDNFIEFRNVSFAYGDRPILKNLTLSVPRGKLVAVMGGSGSGKTTLLRLISGQIRPQSGEVLVDGRDIARMSQAELYQHRRRMGMLFQFGALFTDLSVADNVAFPLREHTRLPESMIRDLVTMKLEAVGLRGTQKLMPAELSGGMARRVALARAIALDPQLMLYDEPFTGLDPISLGVIALLIKKLNDALGTTSVMVTHDVHQSLAIVDHVLFVAGGRIIAQGTPDEVRGSDSPWVRQFINGEADGPVHYNFPAATSLAADLGLQGGGHA

SEQ ID NO: 21691 - protein, 496 aa, Triticum monococcum
MARKMLKDGEAPLVADDGGTYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAEAKNDLLVYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 21692 - protein, 471 aa, Chlamydomonas reinhardtii
MSAGMAYGALPKFPNFKVHKLLGKGSYGKVYKVERESDKQLYALKEADLGSMSQAERADAVNEVRLLVSITHHNVIRYNEAFLLGNKLCTVMEYAPFGDLRYYISKGAKLRTPFPEEAVWRIFLQLCKGLQALHSQNIIHRDIKPANIFLCANDLLKIGDLGIAKALTSMNFARTQIGTPCYMAPEVWSGRPYSYSSDMWSLGAVLYEMMTFRTPMEGRTMADLRNRIKGGRYTPIPAGRYSAELTNICHSLLATDPAKRPSPTSILGSSAAAKWMHILPAAGPPVARRWTSDGAPPKSGGASLMDTIVVPRDLKQLHKRLPPPSYDSDIVRPSVPPPSSSGAGGPPGVQRSSSWSQGAGIQVPAAASSGGAQGIAPKLPSLPGSKAPSRENSRAPSPDVRALQDNRKGPSGSGAPLPPLFPRVPSGGLNPAAAAAAAAVAAYGQRWTPNAPPLAFAVPRVQVPSRRVSYS

SEQ ID NO: 21693 - protein, 372 aa, Campylobacter jejuni
MEISYYEILEITQNADKETIKKAYRKMALKYHPDRNQGDKEAEDKFKLVNEAYEVLSNDEKRAIYDRYGKMLKGGGFGSSSSGFGGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNESKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRMGNQIVQISIKFPTSLNDEQKELLEKLSESFGIKDGMHQEQKGLFEKITNWFKS

SEQ ID NO: 21694 - protein, 471 aa, Herbaspirillum seropedicae
MARTAAEVLKMVKDNEVKFVDFRFADTRGKEQHVSVPVSHFDIDKFESGHAFDGSSIAGWKGIEASDMLLIPDPNTANIDPFMEETTLFMQCDVIEPSDGKGYDRDPRSIAKRAEAYLKSSGLGDTAYFGPEPEFFIFDGVRWGADMSGSFVKIDSEEASWSTGAKIEGGNSGHRPTVKGGYFPVPPVDSFQDMRSEMSLIIESLGIPVEVHHHEVAGAGQNELGTKFSTLVERADWTQTMKYVIWNVAHTYGKTATFMPKPLVGDNGSGMHVHQSVWKDGKNLFAGDGYAGLSEFALYYIGGIIKHAKALNAITNPGTNSYKRLVPGFEAPVKLAYSARNRSASIRIPHVANPKGRRIETRFPDPLANPYLCFSALLMAGLDGVQNKIHPGEAATKDLYHLPPEEDKLIPTVCSSLDEALEHLDKDREFLTRGGVFTDSMIDAYIDLKMQEVQRFRMTTHPIEFDMYYSL

SEQ ID NO: 21695 - protein, 199 aa, Arabidopsis thaliana
MGEAAKDQTEEVIQAWYLDNKEEDQKLPHHKDPKEFVSLDKLAELGVLCWRLDADNYETDEELKRIRESRGYSYMDLCEVCPEKLPNYEEKVKMFFEEHLHIDEEIRYCLAGSGYFDVRDLNDIWIRVWVKKGGLIVFPAGIYHRFTVDSDNYMKAMRLFVGGPVWTAYNRPHDHLPARKAYMKKFLKVIGDRNIDASA

SEQ ID NO: 21696 - protein, 119 aa, Arabidopsis thaliana
MHDFCFTIPYGMLLIGGGFIGYMKKGSITSFAGGAGTGLLLILAGYISLKAFEKKKNSTIAMVLQTVIAAALTLVMGQRYLLTGKIMPAGLVAGISALMTCFYVYKIATGGNKFPAKAE

SEQ ID NO: 21697 - protein, 230 aa, Arabidopsis thaliana
MADLSFYVGVIGNVISVLVFLSPVETFWRIVQRRSTEEYECFPYICTLMSSSLWTYYGIVTPGEYLVSTVNGFGALAESIYVLIFLFFVPKSRFLKTVVVVLALNVCFPVIAIAGTRTLFGDANSRSSSMGFICATLNIIMYGSPLSAIKTVVTTRSVQFMPFWLSFFLFLNGAIWGVYALLLHDMFLLVPNGMGFFLGIMQLLIYAYYRNAEPIVEDEEGLIPNQPLLA

SEQ ID NO: 21698 - protein, 378 aa, Aspergillus aculeatus
MHLNTTLLVSLALGAASVLASPAPPAITAPPTAEEIAKRATTCTFSGSNGASSASKSKTSCSTIVLSNVAVPSGTTLDLTKLNDGTHVIFSGETTFGYKEWSGPLISVSGSDLTITGASGHSINGDGSRWWDGEGGNGGKTKPKFFAAHSLTNSVISGLKIVNSPVQVFSVAGSDYLTLKDITIDNSDGDDNGGHNTDAFDIGTSTYVTISGATVYNQDDCVAVNSGENIYFSGGYCSGGHGLSIGSVGGRSDNTVKNVTFVDSTIINSDNGVRIKTNIDTTGSVSDVTYKDITLTSIAKYGIVVQQNYGDTSSTPTTGVPITDFVLDNVHGSVVSSGTNILISCGSGSCSDWTWTDVSVSGGKTSSKCTNVPSGASC

SEQ ID NO: 21699 - protein, 369 aa, Aspergillus aculeatus
MHSFQLLGLAAVGSVVSAAPTASRVSDLVKKSSSTCTFTSASEASETSSSCSNVVLSNIEVPAGETLDLSDAADGATITFEGTTSFGYEEWDGPLIRFGGKQLTITQSDGAVIDGDGSRWWDSEGTNGGKTKPKFMYVHDVEDSTIKGLQIKNTPVQAISVQATNVYLTDITIDNSDGDDNGGHNTDGFDISESTGVYISGATVKNQDDCIAINSGENILFTGGTCSGGHGLSIGSVGGRDDNTVKNVTISDSTVTDSANGVRIKTIYGDTGDVSEITYSNIQLSGITDYGIVIEQDYENGSPTGTPSTGVPITDVTVDGVTGSIEDDAVQVYILCGDGSCSDWTWSGVDITGGETSSDCENVPSGASC

SEQ ID NO: 21700 - protein, 384 aa, Aspergillus aculeatus
MVRQLALACGLLAAVAVQAAPAEPAHPMVTEAPDASLLHKRATTCTFSGSEGASKVSKSKTACSTIYLSALAVPSGTTLDLKDLNDGTHVIFEGETTFGYEEWEGPLVSVSGTDITVEGASGAVLNGDGSRWWDGEGGNGGKTKPKFFAAHDLTSSTIKSIYIENSPVQVFSIDGATDLTLTDITIDNTDGDTDDLAANTDGFDIGESTDITITGAKVYNQDDCVAINSGENIYFSASVCSGGHGLSIGSVGGRDDNTVKNVTFYDVNVLKSQQAIRIKAIYGDTGSISDITYHEIAFSDATDYGIVIEQNYDDTSKTPTTGVPITDFTLENVIGTCADDDCTEVYIACGSGACSDWSWSSVSVTGGKVSSKCLNVPSGISCDL

SEQ ID NO: 21701 - protein, 493 aa, Frateuria sp. ANA-18
MSKKFIEQHGLWTDVQKAAAVEVLKQADQAGLQMIRLSWPDQYGLLRGKMLSIAALRSAFGSGSEITMAPFFFDTASAIVFNPFSADGGFGSAELAGSPNVVMVPDPTTFHILPWADRTGWMLADLYMTSGRPFPLSPRAILKKGLRELEALGYDFQAGLEVEWYLTRIVDPCLDPETIGSPGTPAAPPKVMPVAKGYSYLLENHLDEVEPIMAEVRHHLLALGLPLRSIEDEWAPSQMETTFDVMPGLDVADSMVLFRNAVKQICRRRGYLASFMCKPAINGFYASGWHLHQSLTARDTGFNAFIPQQGEPLSQLGQAYVGGLLEHACAASSFTTPTINGYRRRRPYSLAPDRVTWAKDNRAAMARVISAPGDPASRVENRIGEPAANPYLYLASQVFSGIDGIRRQRDPGPLQETPYASRCDDFDRTTCPRALEALESSSFFREAFGDEFIHYWLHLRRSEWKRFTEAEGEVDMAADPVTHWEHREYFELF

SEQ ID NO: 21702 - protein, 430 aa, Penicillium chrysogenum
MSSGGDVNQAEKSVFGMPGFVVDFLMGGVSAAVSKTAAAPIERIKLLIQNQDEMHKQGRLDRKYNGIVDCFRRTAAAEGVVSLWRGNTANVIRYFPTQALNFAFRDTYKSMFAYKKDRDGYAKWMMSNLASGGAAGATSLLFVYSLDYARTRLANDAKSSKGTGERQFNGLVDVYRKTHNGIVDCFRRTAAAEGVVSLWRGNTANVIRYFPTQALNFAFRDTYKSMFAYKKDRDGYAKWMMSNLASGGAAGATSLLFVYSLDYARTRLANDAKSSKGTGERQFNGLVDVYRKTLATDGIAGLYRGFGPSVLGIVVYRGLYFGMYDSIKPVLLVGPLEGSFLASFLLGWTVTTGAGVASYPLDTVRRRMMMTSGEAVKYNSSMDAARQIVAKEGVKSLFKGAGANILRGVAGAGVLSIYDKAQMLLLGKKF

SEQ ID NO: 21703 - protein, 438 aa, Penicillium chrysogenum
MPISKIHARSVYDSRGNPTVEVDVVTETGLHRAIVPSGASTGLHEVVELRDGDKTKWGGKGVLNAVKNVNDVIGPALIKENIDVKDQAKVDEFLNKLDGTPNKGKLGANAILGVSLAVAKAAAAEKGVPLYAHISDLAGTKKPFVLPVPFQNVLNGGSHAGGRLAFQEFMIVPDTAPTFSEGLRQGAEVYQELKALAKKKYGQSAGNVGDEGGVAPDIQTAEEALDLITEAIEQAGYTGQIKIAMDVASSEFYKEDAKKYDLDFKNPESDPTKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADGWGVMVSHRSGETEDVTIADIAVGLRAGQIKTGAPARSERLAKLNQILRIEEELGANAVYAGEKFRTAVNL

SEQ ID NO: 21704 - protein, 371 aa, Penicillium chrysogenum
MFRQSVRRFATTAARAAEGSTAYCTRVSTAQGVVNGLTEAIGNTPLIRLKKLSEQTGCNVLGKAEFQNPGGSVKDRAALFVVKNAEEKGLLKPGGTVVEGTAGNTGIGLAHVCRSKGYKLVIYMPNTQSQGKIDLLRLLGAEVYPVPAVAFDNPQNYNHQARRHAESLDNAVWTNQFDNVANRQAHIETTGPEIWAQTQGKIDAFTCATGTGGTLAGTTRYLKTVSDGRVKSFLADPPGSVLHSYIQSGGTLIDRSGSSITEGIGQGRVTDNLQPDIDLLDGSVNISDEKTIEMVYRCLDEEGLYLGASSAMNVVAAKEVAEKLGKGNTVVTILCDGAYRYADRLFSSKWLESKNLLGSIPKHLQKYVVLP

SEQ ID NO: 21705 - protein, 485 aa, Bacillus halodurans
MWENKFQKEGLTFDDVLLVPAKSEVLPRDVSVKTKLTETLQLNIPIISAGMDTVTEAKMAIAIAREGGLGIIHKNMSVEEQAEQVDRVKRSESGVITNPFFLTPDRQVFDAEHLMGKYRISGVPIVDEDQKLVGILTNRDLRFIEDYSTLIDDVMTKENLVTAPVGTTLKEAEEILQKHKIEKLPLVDESGTLKGLITIKDIEKVIEFPNSAKDSQGRLIVGAAVGVSADTDVRVAALVEAGVDVIVIDTAHGHSKGVLEKVKAIREQYPDLTIIAGNVATAEATRDLIEAGANVVKVGIGPGSICTTRIVAGIGVPQITAVYDCANEARKHGVPIIADGGIKYSGDIVKALAAGGHAVMLGSLLAGVSESPGEREIFQGRQFKVYRGMGSLGAMEKGSKDRYFQENNQKLVPEGIEGRIPYKGPLHDTIHQLVGGIRAGMGYCGTKTIDELRENTQFIRITGAGLRESHPHDVQITKEAPNYTL

SEQ ID NO: 21706 - protein, 504 aa, Porphyromonas gingivalis W83
MIGIFTGARIKELDRYTIEHEPVSSIDLVERAAATWVYEFERLYTQQRRIVVFAGPGNNGADALCAARILGENGYSVDAFLFNVSGSLSPECNECRVRLLETSGIRLTEVVDNFIPPELSSQTIVVDGLFGVGLNRPLQGGFAKVVEFLNQSGAEIVSIDIPSGLFEEDNFGNNPNAIIRATHTLTFEYPKLSFLFSENADYVGKWKVLNIGLSVEGKQTIKTEYFLNTDFDISGIIRQRPRFAHKGTFGHALLIAGSRGKMGAACLAAKACLRSGIGLLTTHIPACGEAVMQTAVPEAMVHADEKTDIVCDYSSPLVFQAVGIGPGIGRAEGTVLLVEKILSTPNGPLVLDADALNIIAENRSWLDRLPINSILTPHSRELERLTTHCNTDYERLRQARFLACHHHVYVVLKGAFSATCMPGGMVVFNNTGNPGMATGGSGDVLMGIITGLLGSGYLPASACVLGNYIHGLAGDIYAGRYSQESLIASDIIDNLGTAFRQVRD

SEQ ID NO: 21707 - protein, 248 aa, Porphyromonas gingivalis W83
MKRIVLIRHGESLWNKENRFTGWTDVDLSEKGIEEAKKAGELMKKEGFQFTKAYTSYLKRAVKTLNGVLDVMDLDWIPVEKTWRLNEKHYGMLQGLNKAETAEKYGDEQVLIWRRSYDVPPTPMEKEDPRSPFMDPRYKGVCEKDLPLTEALCDTVNRILPYWNETIFPTLKEHDEVLVAAHGNSLRGIIKVLKNISDEDIISLNLPTAVPYVFEFDDNLRLVKDYFLGDPEEIKKLMEAVANQGKKK

SEQ ID NO: 21708 - protein, 461 aa, Porphyromonas gingivalis W83
MAKEKTIYVCRSCGTKYAKWQGNCNACGEWNCIDEEKVPAPASGKHAAKSFMPREQDNRPRLLQDVESGDEERIRLGDEEFDRVLGGGIVKGAFVLLGGEPGIGKSTLILQTVLRLPQLRTLYVSGEESARQLKMRAERLGQAMNGCYVYCETNIERILSRAEELTPDLLVIDSIQTVYTEEMESSAGSVGQIRECAALLLKYCKTTGIPVIVIGHITKEGSIAGPKVLEHIVDTVLLFDGDKHHLYRILRGQKNRYGSTSELGIYEMRQDGLRGVENPSEHLITRNREDLSGIAIAVAMEGIRPILIEAQALVSSAIYANPQRSATGFDIRRMNMLLAVLEKRAGFKLIQKDVFLNIAGGIKIADPATDLAVISAVLASSLDIVIPPAVCMTGEVGLSGEIRPVSRIEQRITEARRIGFKEILVPADNFRQEDAGRFGIRLVPVRKVEEAFRHLFSKGRE

SEQ ID NO: 21709 - protein, 498 aa, Porphyromonas gingivalis W83
MAVFINEVSRTFGEYLLIPGLTTEQCTPQNISLQTPLIKFNRDESPRIKLNIPFVSAIMQSVSNDTLAIELARNGGLSFIFGSQSIESQAEMVRRVKKFKAGFVTSDSNLRPDNTLADVLDLVKRTGHNNIGITHDGSSNGRLMGIVTSRDYRVSTDSPSKPVKDFMTPFERLTVGKVGITLSEANDIIWENKLNTLPIIDENQNLQYFVFRKDYDSHKNNPLELSNYTDKTLLVGAGINTRDYKERVPALVEAGVDVVCIDSSDGYSDWQSNTIRWIKEKYGDSLPVGAGNVVDRDGFNFLTEAGADFIKVGIGGGSICITREQKGIGRGQATAVIDVAKARDDYYRRTGTYVPICSDGGLVHDYHMVLALAMGADFLMMGRYFARFDESPTKKMKIGSNIVKEYWGEGSNRAQNWQRYDSGGTETLKFEEGVDSYVPYAGKMKDNLLITLGKIKATMCSCGVITIPELQEKAKITLVSSTSIVEGGAHDVILKDRG

SEQ ID NO: 21710 - protein, 251 aa, Porphyromonas gingivalis W83
MRKNIVAGNWKMNKTLQEGLALAKELDAALKGRTINCDVIIGTPFIHLASIAAAIDTTRIGVAAENCADKESGAYTGEVSAAMVASTGARYVIIGHSERRAYYHETSPILMEKVKLALSNGLTPIFCVGEVLEEREAGKHFEVVARQVEEALFTLDQTDFAKLILAYEPVWAIGTGKTATADQAQEMHAHIRKSIAAKYGKEVANGCSILYGGSCNAANAKELFSRADVDGGLIGGASLSVDKFLPIIEAF

SEQ ID NO: 21711 - protein, 253 aa, Porphyromonas gingivalis W83
MIIAGLAFLVAGLSAFAKKPPKKDEVQTVKPIVTSADSVAYAFGISGAINFNDYTGRMPGDSLDRALILRAFEEVLMGKSTAISSQNADEMIKKYFKEVQDRLKAENLAAGKAYQEEYRKQPGVKATESGLLYRVLKEGEGPRPTVQDTVVVHYVGKNIEGKEFDSSYSRNEPAKFSLLQVIPGWTEGVCLMQKGAKYEFVIPTELGYGERSMGELLKPNSTLFFEVELLEIKPFVEKPAKPIPAKPTPNKKN

SEQ ID NO: 21712 - protein, 195 aa, Porphyromonas gingivalis W83
MDKVSYALGLSIGNNFKSSGIDSVVMDDFMQGLSDVLEEKAPQLSYDEAKREIEAYFMDLQQKAVKLNKEAGEEFLKINAHKEGVTTLPSGLQYEVIKMGEGPKPTLSDTVTCHYHGTLINGIVFDSSMDRGEPASFPLRGVIAGWTEILQLMPVGSKWKVTIPSDLAYGDRGAGEHIKPGSTLIFIIELLSINK

SEQ ID NO: 21713 - protein, 178 aa, Porphyromonas gingivalis W83
MRTIKLKDKEFEIYIPATRIHEAIKRMAAEIKRDLHEDNPLFVCIMNGSFMFAAELMQALDESYQVDFARYSSYCGMQSTFVLKEIMPVTADMRGRTVVIVEDLIDSGYTMSCVKENFYELGAKEVRIAAMLTKPAALKCDIHTDYVGLEIGNDFIVGHGLDYDDLGRMYQDIYKIKE

SEQ ID NO: 21714 - protein, 449 aa, Porphyromonas gingivalis W83
MRYDLAIIGGGPAGYTAAERAAKGGLKTLLIEKNALGGVCLNEGCIPTKTLLYSAKVLHQIATASKYAVSGTADGLDLGKVIARKGKIIRKLTAGIRSRLTEAGVEMVTAEATVTGCDADGIIGITAGEAQYKAANLLLCTGSETFIPPIPGVEQTEYWTNREALQNKEIPTSLVIIGGGVIGMEFASFFNGIGTQVHVVEMLPEILNGIDPEHAAMLRAHYEKEGIKFYLGHKVTSVRNGAVTVEYEGESKEIEGERILMSVGRRPVLQGFESLGLVLAGKGVKTNERMQTSLPNVYAAGDITGFSLLAHTAVREAEVAVDQILGKTDETMSYRAVPGVVYTNPEVAGVGETEESLRKAGRAYTVRRLPMAFSGRFVAENEQGNGECKLLLDEENRLIGAHLIGNPAGELIVTAAMAIETGMTDRQIERIIFPHPTVGEILKETLAGG

SEQ ID NO: 21715 - protein, 433 aa, Porphyromonas gingivalis W83
MKTWQSILGFNPEKHSVRTEFIAGVTTFLTMSYILAVNPDILAAAGMDKGAVFTATALSSAVATLLIAFLAKLPFAQAPSMGINAFFAFTLVQGMGYSWQTALAAVFVEGIVFILLTAFNIREKIVDCIPYNLRYAISAGIGMFIAFIGLKNAGIIVSHPATLVALGPFTPIFLLAILGIILSAALVVRKVRGALFYSIAICTIVGIPLGVTAIPEGFAPISSPQSLSPTFLQMDFAPLLSFDMAMTIFALVFMDIFNTIGTLIGAAAKTEMMDEKGNVKNIKQAMMADAIGTSLGAILGTSTVTTYVESGSGIAEGGRTGLTALVTGSFFLLALFLSPLFLLVPGAATTGALVMVGVFMLGSISMIDLSDLSETFPVFITLLTMVLTYSIAEGMALGMLAFVFVKLLSGQYRSISLPLYILAVLFILRYAFA

SEQ ID NO: 21716 - protein, 244 aa, Porphyromonas gingivalis W83
MIEVREVSKQFEDKKVLNNISATFETGKTNLIIGRSGAGKTVLLKCIIGLIAPTSGEVLYDGRDITIMSESELKILRREVGMLFQGSALFDSMTVMENVMFPMNMFSSDKPAVRRERAKYLLHRVGLSDARHKYPSEISGGMMKRAAIARAIALGPKYLFCDEPNSGLDPKTSLVIDDLIHSLTQEHGITTVVNTHDMNSVKTIGDKIIYIRHGSKEWEGSSATLNSSDCTSLKNFVFAKTMEY

SEQ ID NO: 21717 - protein, 214 aa, Porphyromonas gingivalis W83
MNKAISAEKLSALFKDGMTIMVGGFLANGTPERIIDELVKSGVKDLTLIANDTSYPDRGCGRLIANHQVKKLIASHIGTNPMTGDQMNTGELVIEFSPQGTLAERVRAGGAGLGGVLTPTGLGTVIEEGKQKIEIDGEVFLLEKPIRADFAFIKGSVGDEFGNLIYKGTTQNFQPLMAMAADCVVAEIEEIHPIGQIPMEQIHTSGIFVDYILR

SEQ ID NO: 21718 - protein, 220 aa, Porphyromonas gingivalis W83
MEKDQIREVIAKRVALELKDGDVVNLGIGLPTMVPNYLKPGVQVYLQSENGMIGMGPAPETGKEDPYLINAGGGSITAIPGAASFDSATSFAIIRGGHVDVSVLGALQVDENGDLANWLIPGKKAPGMGGAMDLLIGTRKVILAMEHTAKGNPKIMKKCSLPLTAKGQVNLIITEMCVIEVCPEKGLVVTEIHPDFTAEQVQAATEASLTFASEIIPMQQ

SEQ ID NO: 21719 - protein, 483 aa, Porphyromonas gingivalis W83
MPKPNFDTASLLPILSRIASYPFPLGGKGVLSQHAMDATTQKTGHYGALLRLGLPIIIGQLGIIFVSFADNIMVGQHSTAELAAASFVNNILGLLLILGIGFAYGLTPLVASAEHRGQYFKAGILLRHSLRLNIAIGLFLAGVAAVMVPLFDTFNLPPSLRPLAIPYYWVQVGGLFLVTVFNAFKQFYDGMSDTRTPMYITISGNLFNVGLNYLLIFGKGGLPEMGLLGAGYATLLSRLLMLVTIVLFLYRRPSWTAIRHAFCRQMHIRRAYRRLFSVGLPVAVQMGLESASFTIAVLFVGRLGDQALAAHQIVCVITTLGYLVYYGLGAATTIRISHFKLHGKPDEVRRVAATAYRMAALTACVVVVLLLLTRHSFSFLFTPDEEVAHIVALTLIPVVVYQFGDALQAIYSNALRGMERVRFLAPAAAFCHVLLAPILSYLLGFVFILGNTPMQLAGIWSAFPISLTLLGILFYSYFRKVTR

SEQ ID NO: 21720 - protein, 409 aa, Porphyromonas gingivalis W83
MVLSEKAKYYVDLEHRYGAHNYHPLEVVLSRGQGAYVWDVDGKRYFDFLSAYSAVNQGHCHPKIIAALKEQAEKICLTSRAFYNDCLGEYEEFMHHYFGYDKMLPMNSGAEAVETALKLSRRWGYRVKGIPEEKAVIIVCDGNFHGRTISIVSMSSDPDSYTDYGPYTPGFVNIPYNNIEALEKALEEHKDHVAAFVVEPIQGEAGVFVPDDGYIRRAAELCRKYHALFVADEVQTGIARTGRMLCCDHDDVRPDIVVLGKAISGGVLPVSCVLADDEVMLTIKPGEHGSTFGGFPLACKVAMAALTVVKEERLPERAEELGQYFRGELLKIKSPLLKLVRGRGMLNAIVIEPHNRHEAWDVCEAMAERGLLAKPTHRHIIRLAPPLCITREELAQAVEIIKESIKVLE

SEQ ID NO: 21721 - protein, 445 aa, Porphyromonas gingivalis W83
MERIRLDLSKTGSSVASYGETAEKFNALLDNGTGRGSDFLGWVHLPSSITEEELNAVEAAATILRERCDYVINVGIGGSYLGARAVIEALQNSFEAYRSDRENPVILYAGNNIGEDYLSELLQFLRDKRFGIIYISKSGTTTEPAIAFRLLKGLLESQVGREDARERIVAVTDSAKGALRRMADEEGYRSFVIPDNVGGRFSVLTPVGLLPVAVAGFDIRQLVRGAADMQAMTASDIPFSDNPALRYAAARNALYAEGKKIEILANFHPKMHYIGEWWKQLFGESEGKEEKGIFTATVDLTTDLHSMGQWMQEGERTIFETVISVENQDTCLTIPSDSADLDGLNFLAGKRVDEVNKMAELGTRLAHVDGGVPNIRIILPQLDAYYIGQLFYFFEKAVGVSGYMLGVNPFDQPGVEGYKNNMFALLNKPGYETESAAMAGRLKEC

SEQ ID NO: 21722 - protein, 508 aa, Porphyromonas gingivalis W83
MRVMEKVIRRALISVYHKEGLAEILAELNRQGVEFVSTGGTHEFITSLGYACRAVDDLTRYPSMLGGRVKTLHPMIFGGILARRGHESDVREVGEYGLPLIDLVIVDLYPFEATVASGASEEDIIEKIDIGGISLIRGAAKNFEDVVIISSRAQYAGFYSLLKEQGARTSLAERRHYAREAFAVSSAYDSAIFRYFDDGEQTAFRMSADSPKVLRYGENPHQRGFFFGNFDRYFDKLQGKEISYNNLQDIEAAVSLISEFSAPTFAILKHTNACGIASRGTLIEAWQAALAGDPVSAFGGILVTNTPIDRETAQEIDKIFFEVIIAPDYDNAAMEYLTRKTNRIILLQKEPVREQWQFRSMFGGVLMQQVDGVTAKTVDFKPVTPVVPTADETDDLIFANKVVKHSKSNAITLVKDSQLCASGVGQTSRVDALRQAIDKARNFGFDLNGAVMASDAFFPFADCVEIAAEAGIRAIIQPGGSIKDNLSIEEATKKGIAMVMTGVRHFKH

SEQ ID NO: 21723 - protein, 218 aa, Porphyromonas gingivalis W83
MQPIVSPSLLSADFLHLADDVEMINRSEADWLHIDVMDGVFVPNLSFGFPILEAIRPICKKPLDVHLMIVEPMKFVDRLAELGVYMMNVHYEASPHLHRSLAAIRKAGMKSGVTLNPHTPVEVLTDVLEEADMVLLMSVNPGFGGQKFIERTIDKTQRLRRMIDSQGLDTIVQIDGGVNAATGKRLIEAGADSLVAGSYVFGAEKPEEAISLLKSYSR

SEQ ID NO: 21724 - protein, 219 aa, Porphyromonas gingivalis W83
MIDIKGIHKTYPGAQPLHVLKGIDLHIAKGEMVSIMGASGSGKSTLLNILGVLDTYDEGEYRLHGELIRNLSENRAAEIRGRLIGFVFQSFNLISFKNAVENVALPLYYQGMSRRKRNEMAMEYLRRVGLEDWADHLPNELSGGQKQRVAIARALAAKPQVILADEPTGALDSVTTVEVMELLRSVNRDGITMVIVTHEQSVADSTDRIIHIKDGIIGA

SEQ ID NO: 21725 - protein, 418 aa, Porphyromonas gingivalis W83
MTIEQFNFAGKKAFVRVDFNVPLDDNFKITDDTRIRAALPTLRKIIADGGMTIIGSHLGRPKGVAPEFSLRHILPHVSELLGVDVLFADDCIGADAMDKAAKLKAGQVLLLENLRFYAEEEGKPRGLSDDASDEEKAAAKKAVKAAQKEFTQKLASMADCYVNDAFGTAHRAHASTALIADYFDRDHKMFGYLMEKEVKAVERVLHDIKRPFTAIMGGSKVSTKIEIIENLLNKVDNLILTGGMTYTFTKAAGGRIGLSIVEDDKLDLARDIVKKAAEKGVNLILSVDTKVADRFDNDAATQVCSNMEIPDDWMGMDIGPRSIEKFRKVILESKTILWNGPTGVFEFDNFSIGSKAVGEAIVEATANGAFSLVGGGDSVACVNKFGLADKVSYVSTGGGALLEAIEGKTLPGIAAIQG

SEQ ID NO: 21726 - protein, 425 aa, Porphyromonas gingivalis W83
MEIAKIIGREILDSRGNPTVEVDVHLACGIIGRAAVPSGASTGENEAIELRDQDKARYCGKGVLKAVKNVNEVIDPALCGMSVLEQTAIDRKLIELDGTKTKSNLGANAMLGVSLAVAKAAAAYLDIPLYRYIGGSNTYVLPVPMMNIINGGSHSDAPIAFQEFMIRPVGACCFREGLRMGAEVFHALKKVLHDRGLSTAVGDEGGFAPALNGTEDAIESILKAVEAAGYVPGKDITIAMDCASSEFFKDGIYDYTKFEGEKGKKRSIDEQVAYLTELVGKYPIDSIEDGMSENDWEGWKKLTVALGDKVQLVGDDLFVTNVEFLRRGIAEKCGNSILIKVNQIGTLTETLNAIEMAHRHGFTSVTSHRSGETEDTTIADIAVATNSGQIKTGSLSRTDRMAKYNQLLRIEEELGPCAVYGYKKV

SEQ ID NO: 21727 - protein, 462 aa, Porphyromonas gingivalis W83
MSRPRAEMPELDPLYRSSKINEEVNRGLSREAAMAEASRCLDCPQPSCMEGCPVSINIPTFIKQIEVGDILAAASTLRETSSLPAVCGRVCPQEKQCESRCIYTKMNKPAVAIGFLERFAADYEREQGALKVPEMAPRNGIKVAVIGSGPAGLSFSGDMAKLGYDVTVFEALHEIGGVLKYGIPEFRLPNSIVDSEINLLEEMGVRFETNTIVGRTIAYDDLHEAGFRGVFVGSGAGLPNFMNIPGENLVGVMSSNEYLTRVNLMHASQADSDTPVFKGKNVAVIGGGNTAMDSVRTAKRLGAERAMIVYRRSEEEMPARLEEVKHAKEEGIEFLTLHNPIEYIGNERGRVTAMRLQKMELGEPDAGGRRRPVAITGAIEEIPVDEVIVSIGVSPNPLVPRTISGLEVTSKGTIVVNESNQTALPDVFAGGDIVRGGATVILAMGDGRKAAAAMHEYLKAES

SEQ ID NO: 21728 - protein, 433 aa, Porphyromonas gingivalis W83
MTIDEMLRLDRNHLWHPYTSTIDPLPVFPVKRAEGVRIYLEDGRELIDGMSSWWAAIHGYNHPRLNAAVERQLREMSHIMFGGFTHRPAVELAELLLSILPSELNKIFYADSGSVAVEVAMKMALQYQQACGQSRRTRFATIRSGYHGDTWHAMSVCDPVTGMHGIFSGALPVQYFLPQPKSRFGGEWLPADIEPLRDLLSAKGAELAALILEPIVQGAGGMYFYYPRYLVEARRLCSEAGVLLIFDEIATGFGRTGELFALRHAATVPDILCLGKSLTGGYMTLSATITTEAIARTICSGEAGCFMHGPTFMGNPLACAVAAESIRLLLESPWQERVRAIEAQLREELSPAISFDGVAEVRVLGAIGVVEMKRPVDMATLQQRFIREGIWVRPFGRLCYLEPPFIISPEDLRILTHGLLRVLGQDRSISFTR

SEQ ID NO: 21729 - protein, 361 aa, Porphyromonas gingivalis W83
MAVKDNYCVIMGGGIGSRFWPFSRESHPKQFLDFFGTGRSLLQMTYDRFARFIPRENILVVTNELYVDKVREQLPEIEPDQILREPTRRNTAPCIAYASYHIYARNPKANIIVAPSDHLILREDEFVRAASEALEFVADHEHLVTLGIRPSRPETGYGYIQMAEEKTGDFIRVKTFTEKPNAEMASIFLASGEFLWNSGMFVWNVESILAAFRKHLPEVTSSLENGLAHFNTPEERRFIDQAFPYCPSISIDFGVMEKADNVLVMPVDFGWADLGTWGSLYELAQKDDAGNASLKTRTLFYEAERNIVTTDNPQKLVVVQGINDCIVAESGNVLLICRAEEEQRIKHFVADAALKYDKEYN

SEQ ID NO: 21730 - protein, 198 aa, Gossypium hirsutum
MSASRFIKCVTVGDGAVGKTCLLISYTSNTFPTDYVPTVFDNFSANVVVDGNTVNLGLWDTAGQEDYNRLRPLSYRGADVFLLAFSLISKASYENVAKKWIPELRHYAPGVPIILVGTKLDLREDKQFFIDHPGAVPITTAQGEELRKLIGAHFYIECSSKTQQNVKAVFDAAIKVVLQPPKKKKKKKRKAQKACSIL

SEQ ID NO: 21731 - protein, 301 aa, Klebsiella variicola
EAVMSDRDTGAAAEPRAPVVTIMGHVDHGKTSLLDYIRSTKVASGEAGGITQHIGAYHVETDNGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDDLLDAILLQAEVLELKAVRNGMASGAVIESFLDKGRGPVATVLVREGTLHKGDIVLCGFEYGRVRAMRDELGREVLEAGPSIPVEILGLSGVPAAGDEVTVVRDEKKAREVALYRQGKFREVKLARQQKSKLE

SEQ ID NO: 21732 - protein, 293 aa, Klebsiella variicola
TGAAAEPRAPVVTIMGHVDHGKTSLLDYIRSTKVASGEAGGITQHIGAYHVETDNGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDDLLDAILLQAEVLELKAVRNGMASGAVIESFLDKGRGPVATVLVREGTLHKGDIVLCGFEYGRVRAMRDELGREVLEAGPSIPVEILGLSGVPAAGDEVTVVRDEKKAREVALYRQGKFREVKLARQQKSKLE

SEQ ID NO: 21733 - protein, 302 aa, Klebsiella variicola
EAVMSDRDTGAAAEPRAPVVTIMGHVDHGKTSLLDYIRSTKVASGEAGGITQHIGAYHVETDNGMITFLDTPGHAAFTSMRARGAQATDIVVLVVAADDGVMPQTIEAIQHAKAAQVPVVVAVNKIDKPEADPDRVKNELSQYGILPEEWGGESQFVHVSAKAGTGIDDLLDAILLQAEVLELKAVRNGMASGAVIESFLDKGRGPVATVLVREGTLHKGDIVLCGFEYGRVRAMRDELGREVLEAGPSIPVEILGLSGVPAAGDEVTVVRDEKKAREVALYRQGKFREVKLARQQKSKLEN

SEQ ID NO: 21734 - protein, 284 aa, Raoultella planticola
APVVTIMGHVDHGKTSLLDYIRSTKVASGEAGGITQHIGAYHVETENGMITFLDTPGHAAFTSMRARGAQATDIVVLVVAADDGVMPQTIEAIQHAKAAQVPVVVAVNKIDKPEADMDRVKNELSQYGVMPEEWGGESQFIPVSAKAGTGIDDLLNAILLQAEVLELKAVRNGMASGAVIESFLDKGRGPVATVLVREGTLHKGDIVLCGFEYGRVRAMRNELGQEVLEAGPSIPVEILGLSGVPAAGDEVTVVRDEKKAREVALYRQGKFREVKLARQQKSKL

SEQ ID NO: 21735 - protein, 294 aa, Raoultella terrigena
RDTGAAAEARAPVVTIMGHVDHGKTSLLDYIRSTKVASGEAGGITQHIGAYHVETENGMITFLDTPGHAAFTSMRARGAQATDIVVLVVAADDGVMPQTIEAIQHAKAAQVPVVVAVNKIDKPEADMDRVKTELSQYGVMPEEWGGESQFIPVSAKAGTGIDDLLNAILLQAEVLELKAVRNGMASGAVIESFLDKGRGPVATVLVREGTLNKGDIVLCGFEYGRVRAMRNELGQEVLEAGPSIPVEILGLSGVPAAGDEVTVVRDEKKAREVALYRQGKFREVKLARQQKSKL

SEQ ID NO: 21736 - protein, 168 aa, Amborella trichopoda
MPRSRINGNFIDKTSSIVANILLRIIPTTSGEKEAFTYYRDGMSAQSEGNYAEALQNYYEATRPEIDPYDRSYILYNIGLIHTSNGEHTKALEYYFRALERNPFLPQASNNMAVICHYRGEQAIRQGDSEIAETWSDQAAEYWKQAIALTPGNYIEAQNWLKITRRFE

SEQ ID NO: 21737 - protein, 475 aa, Amborella trichopoda
MSPKTETKASAGFKAGVKDYRLTYYTPDYETLATDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKSFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQRNHGIHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREASRWSPELAAACEVWKEIKFEFEAMDVL

SEQ ID NO: 21738 - protein, 269 aa, Mangifera indica
NHGISHDLMDGVEKVNKEQYNKCREQKFNEFANKALENADSEIDHLDWESTFFLRHLPVSNISEIPDLDDQYRKAMKEFAAAIEKLAERLLDLLGENLELEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKA

SEQ ID NO: 21739 - protein, 199 aa, Carica papaya
EQAWNEACSSRTPVQFVVPKNKNYLLKQITFSGPCRSSISVKIFGSLEASSKISDYKDRRLWIAFDSVQNLVVGGGGTINGNGQVWWPSSCKINKSLPCRDAPTALTFWNCKNLKVNNLKSKNAQQIHIKFESCTNVVASNLMINASAKSPNTDGVHVSNTQYIQISDTIIGTGDDCISIVSGSQNVQATNITCGPGHG

SEQ ID NO: 21740 - protein, 268 aa, Carica papaya
NHGISHDLMDTVERLTKEHYKKCMEQRFKEMVESSGLEAVQSEINDMDWESTFFLRHLPASNMHEIPDLEDDYRKAMKEFAVGLQKLAEQMLDLLCENLGLEKGYLKKVFYGSKGPNFGTKVSNYPPCPKPDLIMGLRAHTDAGGIILLFQDDKVSGLQLLKDDQRVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKA

SEQ ID NO: 21741 - protein, 447 aa, Wolinella succinogenes
MKKKNPLFECQHCGFQSPKWLGKCSQCGAWESFIELSASQISTLKSLSPSSPKSTPIPITQIEQERVDKFSSCEEELDIVLGGGIVPGGLYLVGGSPGVGKSTLLLKMAGNLARSGRPILYVSGEESLGQIRARAERLGVMSDALYLLNEIALENILEALETRSFELMVIDSIQTLYSQKVSSAPGSVSQVREVTFELMRLAKERGVSVFIIGHITKEGSIAGPRVLEHMVDSVLYFEGDPSRELRMLRGFKNRFGTTSEVGIFEMTQGGLVSAKDASRLFFKKRAPQAGSAVTVVMEGSRALVLEVQALVGESSFGAPKRVATGFDGNRLNMLLALLERKLEIPLNRYDVFVNIAGGIKIMETSADLAVIAAVVSSFRNRPLSHTTVFIGEVSLTGDVREGNRIDLRLKEAISQGFERALVPQKPQQPLGIKCFEVNEVTKVIDWM

SEQ ID NO: 21742 - protein, 229 aa, Wolinella succinogenes
MNTLLDGIDWEKHPLLPAIVQERGSGEVLMLAYMNQEALNLTLSTQVAHYFSRSKGRIWKKGESSGHIQKIHEIFLDCDSDTILLQVEQVGVACHTGRKSCFFQKVELDSSLSLTSEAPDTSALYGVVDRLYHELLARQGADPQSSYTAKLFSKGENTIGKKIVEEAAELSFAIKDSSESEIVYEAADLLYHALVGLAFRGIHPDKIKQELQRRQGVSGIAEKNSRKDS

SEQ ID NO: 21743 - protein, 250 aa, Wolinella succinogenes
MLELKGVAKSFGAKKVLTDITLEAKEGKTTVIFGLSGSGKSTIIKLIVRLLEPDGGDILLHNESILSASPKRLYELRKEIGFLFQSGALFDSKNVYENVAFPLREHTRLSEREIRAKVLSRLEMVGLKPDEVALLYPDELSGGMKKRVGLARSIILDPKVILYDEPTSGLDPITSDLITQMIIHLQKELQTTSILISHDLKESFKAADYMAMLFEGRIIECSSKEQFAKSENPRVRQFLEGSSAGPINLN

SEQ ID NO: 21744 - protein, 307 aa, Wolinella succinogenes
MDRINALFPLWAILFSALAYAMPSLFVPLKEMIVPLLGFIMFCMGMTLLPKDFKEVVRRPKVIALGIVLQFTLMPLGAYVIAHLLGFPALLIAGFILVGTAPGGTASNVMAFLAKGDVALSITLTACSTLLGVILTPYLTLFLTQEVVEVNALAMLMSIVKIVFFPVALGVGVNYFLCQKVEKVQRLLPTLSIVGIVLIIAIVVALNQSKILEVGAWVALGVVMHNTLGLVLGYFLSKMAGFEEKIARTIAIEVGMQNSGLAVALAAKYFGALAALPGAIFSVWHNVSGSLIASYWGSRSEKEQEQG

SEQ ID NO: 21745 - protein, 289 aa, Wolinella succinogenes
MGFADFFKTFTRERAKEGESPSHWIKCPSCSALMYYKEVIAQHHVCPKCNFHMRIALEDRIEMLCDEGTLIEHDASLEPTDPLTFVDKKSYKKRIEEGKQKTGRASSVLSGECRINGVSTQIVLFNFAFMGGSLGSVEGEKIVRAVNRALEKHQGLVILSTSGGARMQESTYSLMQMAKTSAALARLSQAKLPFISLLTDPTMGGVSASFAFLGDIIIAEPGAMVGFAGARVIKQTIGADLPEGFQTAEFLLEHGLIDMITPRKEMKKTLGDLLRFFNPYDENPCLLHL

SEQ ID NO: 21746 - protein, 213 aa, Wolinella succinogenes
MLVAPSILSADFGKLSLEVGSICEAGCDYVHVDVMDGHFVPNLTMGPLVVQAVKKAATKPLDIHLMVQNNPFFVDLFAPLEPEFLSFHIEEEKHLHRLIQQTRKHGIRPAVALNPHTDESLLEYILSDIDMVLVMSVNPGFGGQKFIPSALEKIRRLKERIERRNPSCLIEVDGGVSDQNIHALKEAGVDMVVAGSYLFGSPDYRAAIASLRV

SEQ ID NO: 21747 - protein, 432 aa, Wolinella succinogenes
MDNKTLAQEDLRYLWHPCTQMKDHEQFPLIPIARGKGVYLYDFEGNAYIDGVSSWWVNLFGHSHDYINSQIVEQMGRLEHVILAGFTHEPIIKLSKRLVEMTPHGLEKCFYADNGSSAIEVALKMSFHRHKIEGKKRALFLSLSNSYHGETIGALSVGDVALYKETYGEILLATLQTPVPRDLTQEATQEALEALEVILENRGEEISAFVLEPLVQCAGGMHMYSADYVKGASQLCRARGIHLIFDEIAVGFGRTGTLLALEQCGVVPDFLCLSKGITGGYLPLSVVMMSQETYDCFYAPYHENRAFLHSHSYTGNALACAAANATLDLLEDGSVLKNNRLLGERIDTHLKRLALHPRIGNARRTGMIAALDLLGFDPKERVGLRVYSEALKRGILLRPLGNVIYFMPPYVITLTEIDQVFEALEEVLGRIL

SEQ ID NO: 21748 - protein, 246 aa, Wolinella succinogenes
MSQKIVQMTNVHKYFGDFHALNNVNFSVRKGEIVVVCGPSGSGKSTLIRCINALEEIDEGDIIIDGQNLYDRSTDINKIRSEVGMVFQHFNLFPHLTILENISIAQIKVKGLSKKEADANSMEILKKVQLEHKAQGYPNELSGGQKQRVAIARTVAMKPKVVLFDEPTSALDPEMIGEVLDVMRQLAREHYTLVCVTHEMGFAKEVSDRIIFMDHGVIMEDTTPEEFFASPKTERAKKFLNEILTH

SEQ ID NO: 21749 - protein, 394 aa, Wolinella succinogenes
MMGEALDKEYVLHSYGRNYVQFTQGKNATLWDSEGKDYIDFASGIAVCSVGHGNERLAGAICDQAKKLIHTSNLYYIEPQARLAEKLVKLSGYDMRVFFANSGAEANEGAIKIARKFGESHEGEVKRYKIITLESSFHGRTITALKATGQEKMHHYFGPYPDGFVYAKNLDHVFKLVDEKTCAVLLELVQGEGGIEPQDREGIKKLERFLKERGVLLMVDEVQTGIYRSGELFASQAYGIVPDVITVAKGLAGGVPIGAVMTTLKDIFAPGDHGSTFGGNFLSTRAGLEVLSILESLYQEGTLQKSIDRFSAELRALCVEFPSLFECEVGLGLMRGIRAKSAEIQKSVIDEAFKKRVLVLRSGRNTVRFLPPLTLSEREMQEGFSRLREALKGI

SEQ ID NO: 21750 - protein, 355 aa, Wolinella succinogenes
MDLQKFREEIDSVDDQILRLLNQRMEVVKLIGRHKKMEGSVIYRPEREREIIARLNSLNQGLLNEAAIEAIYLEIFAVSRNLELPERVAYLGPLGSYTHQAAESRFGAMSEYLSMNNIASVFKTVESKRAKYGVVPIENNKNGIVGETLDLLGKSSLKIVAELTMPIHHTFATQCDSLKEIRRIYSKDIAFGQCLNFLSEYNLEEVERIPVDSTAKAAQLAASEPHTAAICSHIAAKLYHLPILFENIEDSSHNKTRFVIISDFKNQASGSDKTSIFADISHTDKPGALLGLLKDISGLGLNMTKIESRPRIDAAKDFAFCFFIDFEGHIDDENVQELLKRRGDEIKWLGSYVRG

SEQ ID NO: 21751 - protein, 263 aa, Wolinella succinogenes
MSVKKISVGLFLLACLVSQGIASDLKTDVQKESYSIGASMGAYVSNQLFEQSQLGAKADVQALIDGFVDALKKQQKLSDDEIITHLNNRAEGLNKISQERFKQQLDQRLKEGKKYLANNAKNKKVLTTKTGLQYEELVAGKGERPKKESIVMIHYKGTLVDGTPFDSTYERQTPAHLSMVNVIDGLQEGLMLMKEGEKARLVIPSDLAYGNADVQAIPAGSTVVFEVELLKVLKPGELADSAKPLSDEVKKEVEEMGKKPIKG

SEQ ID NO: 21752 - protein, 232 aa, Wolinella succinogenes
MILAANFKTNHTRKSTRHYLERLSNFLFETSCEHDIFLFPPPLALDFFDDIGGVCIGTQNAYPAPSGAFTGEVGSEQLEELAIQTILIGHSERRGILGESQAFCAEKFRYYASLGYTIFYCIGESLEVRRAGIEATIRHNLSQLEGIDLSYPKLIIAYEPIWAIGTGVSASLEQIQETHAALKAHLSCPLLYGGSVNLSNIAEILALPEVDGALIGSASLKVEDFCQMIQKI

SEQ ID NO: 21753 - protein, 407 aa, Wolinella succinogenes
MFDEIQFDKIKRLPKYVFAAINEIKLEMRRNNEDVIDFSMGNPDGITPAHIIDKLCEAAQKPKNHGYSASRGIYKLRLAICNWYKRKYNVDLDPELEACAVMGSKEGYVHLVQAIANFGDSAVVAEPVYPIHYYAFIIVGANVTKFGLKWNDRFELDEDDYFENLKRSLRETMPKPKFVVVNFPHNPTTVVVKKSFYERLVALAREERFYIISDIAYADLTFDGYSTPSILEVEGAKEVAVESYTLSKSYNMAGWRVGFVVGNPKLVGALQKIKSWIDYGMYAPIQVAATIALDGPQECVEEIKGKYEKRMDVLIKSFSEAGWEMDKPQASMFIWAKLPECAQGLGSLEFSKRLLREAKVAVSPGVGFGEHGEGYVRIALIENEKRIRQAARNIKQFLKTLQNTKEA

SEQ ID NO: 21754 - protein, 374 aa, Wolinella succinogenes
MEEFDYYEILEIERSASGEEIKKAYRKMAMKYHPDRNEGSSEAEEMFKRVNEAYQVLSDEGKRQLYDRYGKQGLESQGYSGFSGRGFEDVFDDLGSIFDSVFGGGFSSSSRKRSGPKYNLDLAMELDLSFKEAIFGCKKEIKIRYKDACPDCKGTGAKEGKIETCPDCGGRGQVFIRQGFMTFAQTCPKCGGSGERIKEKCPKCNGKGHENKEENLEVSIPEGVDTDNRIRVSRKGHVGKNGERGDLYLVVRVEEDEHFMRHGNDIYLHVPLFFSTVPLGTTLKIPSLRGELELKIPPNTKDKEQFVFKNEGVKDVHSAKKGNLIAQVKIVYPAKINDEQRELLEKLSRSFGVEGTPHEKGFEGVFEKIKGWFS

SEQ ID NO: 21755 - protein, 427 aa, Wolinella succinogenes
MRIFEQLESQVRSYIRSFPVIFERSKGAYLYDEQGKAYIDFFAGAGTLNYGHNHPKIIEAMIAYLQNDGILHGLDKATSAKKAFLQTLSETILEPRHMDYKVQFTGPTGTNAIESALKLARMVKGRSNVIAFTNAFHGLTMGSMAVTGNAFYRDEAFVNRANVSFMPFDGYFGEEVDTSLYLRRFLEDGSSGVDLPAAIILETIQAEGGVNVARDEWLRSVEKVCRDFDILLIVDEIQVGNGRTGRFFSFEESGIRPDIITLSKSIGGGLPLALVLLRPELDQWKPGEHTGTFRGNNLAFVAAKEALEYWSDSVLGEWVKHNSAILKEGLEALVQAFPELGMSARGRGLIYGLEIPLSGMAKEVSANCFQKGLVIELAGASDTVLKFLPPLIIEEETLREGLGIIKEAIGEVLREREARMGEVFGDR

SEQ ID NO: 21756 - protein, 462 aa, Wolinella succinogenes
MQPLFLEVSTLDSAAVELFGMSHELLMENAARSLAELIRARFRAGSVVRIVSGSGNNGADGIALARMLWGDYRVRLWLPLGCASDLAKLQLRRAQALGIEGVEKLGQGDVLVDALFGSGLSRDLGLDSLEVIREMNEARGYKIACDIPSGIDSKGNPRPIAFKADLTCAMGAIREALLSDSTKEFVGELVVGNLGISQRLYEQNQPPSAYLLGREDVRLPWRVREDSHKGSYGHLAVVAGEREGAAVLAALAGLHFGAGLVSLVGEVKNPPYELMQGVSVPKGASALACGMGLGERECPKDAWELPSVLDADILGREEILSLLEKNPSLVLTPHPKEFANLLGVLGIAQVSTLEVQKDRMGWARIFGERYPRAVLLLKGANPIILQGERLYINPLGGAMLAKGGSGDVLGGIIASLLAQGRSPLESAIEGSLAHTLAASRVEKANYALTPLDLIQALGKLSL

SEQ ID NO: 21757 - protein, 407 aa, Wolinella succinogenes
MRGFTTRALHVPKAKRDVHGALRTPVYDNAAFEFENSDEIAQVSLGRALGHVYSRSSNPTVEDLEQRLKNLTGALGVLALGSGMAAISTAILTLARAGDSVVTTDRLFGHTLSLFQKTLPSFGIEVRFVDVMDSLAVEHACDETTKLLFLETISNPQLQVADLEALSKVVHAKGIPLVVDTTMTPPYLLEAKRLGVDIEVLSSTKFISGGGTSVGGVLIDHGLFEWKSLPSLAPYYAKAGPMAFLYKARKEVFQNLGPSLSPHNAYLQSLGLETMALRIERSCQNAQELAHWLLSIPQVKCVNHPSLPDSPFYAIAKRQFRYAGSILTFELESKEASYRFMDALKLIRRATNIHDNKSLILSPYHVIYALNSHEERLKLEISPAMMRLSVGIEEIEDLKEDILQALC

SEQ ID NO: 21758 - protein, 432 aa, Wolinella succinogenes
MPAHKDETALLHAGYTIDPVTKSRAVPLYQTTSYQFDNTEHAANLFGLKEFGNIYTRLMNPTTDVLEKRINALDGGVGALALASGQAAIAAAIFNIAQVGDEVISLDNLYGGTYNLFKHTLKKSGITVKFADSSRLEGVQALITPKTKAIYAESIGNPKLNVTDIEKLSKIAHEHHIPLIIDNTLTPYIFKPLLHGADIVVYSATKFLGGHGTSLGGIIVDGGKFDWSVKGEDGELKFPLIAAPDESYHGAEFISALEPLGNIAYIIKARISVLRDLGAAISPFNSFLILQGVETLHLRMERHVENAQKVSAFLSNHPKIERVIYPGVGDKVESERAQRYFKFGAGAIVGFEIKGGVEAGRRFIDSLQLFSHLANVGDAKSLAIHPASTTHQQLSKEERLSTGVSDGFVRLSVGIEHIEDILGDLEQALAKA

SEQ ID NO: 21759 - protein, 420 aa, Wolinella succinogenes
MLEFQHFFTASFSDEEREALLGRVKKEREEGVSAYYDLPFQRRALEDSDRYMKANAALLERLETILVVGVGGSSLGLKAIDSLLSHLPERRAIDLHFLEHTDPIAIEKSLRGIQTKSSLFIVISKSGSTIETSSLTKYVLKRFELLKEENRSHLLVITDEGSPLEQWSKQEDVACVTIHPKVGGRFSVLSAVGILPLSLLGYPANEILEGAKGMAVEFFAGRATQILDKALFYAKERNRLSINVLFSYASAFKEFNAWYVQLWGESLGKLNAQGNRTGMTPAALIGSIDQHSFLQLIVQGPLDKSVTFLSIKEPLKEPIEIPNWSMEFLEGTDFVNGSSFKDLLRHQREATMETVIEEGVPTDLILIDRLEGRSVGALLYYYELLTSCVGTLLEINTYDQPGVEFGKRRLREKFHSKDTL

SEQ ID NO: 21760 - protein, 401 aa, Wolinella succinogenes
MVAGINLMQETKSIRDVEIEGKRVLIRVDFNVPMDSDFNISDDTRIREAIPTINHCIDNGAKSIVLVSHLGRPRGKSSEFSLKHILKRLERLLNRSVIFVESLEGVSSVMATLPQKSVILLENIRFLEGEEKNDEKLSKNLASLCDIYINDAFGASHRKHASTYGVAKFAPVKVAGLLLKKEIDSFAKALASPLKPVLLIVGGSKVSSKITLLSNILDVVDKIVIGGAMSNTFLKSLGYDMQRSLVEDPLVPEAAKILGLAKQKGVKIYLPVDVVCTDDIKNPKEIKITPAQDVPENFLAADIGPASVKLFGEVIRDCETIIWNGPMGVYEVQNFSRGTFQLAHVVADTYAYSVIGGGDTADAIDRAGEKDNMSFTSTGGGASLELLEGKILPAFEVLERK

SEQ ID NO: 21761 - protein, 332 aa, Wolinella succinogenes
MYNPPRLIAQESFKKIKTLNEGEKMKVAQNVQELIGKTPLVRLNFASKESGANVIGKCEFMNPSGSVKDRIALGMINAAIGAGKITPETIVIEPTSGNTGIGLASVCAAKGIKLILTMPSSMSIERRKLLAALGAQIELTPAEKGMKGAVERALELAQETKNSFVPQQFENPANPEYHRVTTAVEIWEDLDGKVDVLVAGVGTGGTITGVGEVLKAKNPNLKIYAVEPIDSPVLSGGKPGPHKIQGIGAGFVPKALNTALYDEVIQVKVSDAYEMSRRLGKEEGILVGISAGANIWASKEIGKKYPGKTVVTILCDTGERYLSTELFDLQPS

SEQ ID NO: 21762 - protein, 460 aa, Wolinella succinogenes
MQNFLQVERSNPKKRQALERVKDYSEIYQPYSSDEATPQASRCVQCGDPYCHNKCPLHNFIPQWLKKVSEKDFRLAFELSHATSPFPEIMGRVCPQDRLCEGDCTLNDGYGAITIGAIETFISEKGMELGYKPKFATKSVGKSVAIVGSGPAGLSAATFLLREGFKVELFERQDRAGGLLTYGIPGFKLEKSVIERRLDQLTQAGLKLHLGKEIGKEMSFEKLLKGFDAIFLGIGATAPKKARISGEEAEGCYSAIDFLTAIQKRNFGVESSILLPELKGKSVVVVGGGDTAMDCVRTAIREGAEEVKILYRRDENNMPGSHKEYVNAKEEGVEFEFFAAPKQVILREGKATGIESYRTELCDMDEKGRQKCVVVEGSEFVVEADVIIFSLGFDPARPSFLEQHQIALHPWGGIIVDNSYETSLPNVFAGGDCYRGADLVVNAALDGREAAKAIIKKLLG

SEQ ID NO: 21763 - protein, 422 aa, Wolinella succinogenes
MIYIDNIVAQEVMDSRGNPTVKATVTLSDGNSASAIVPSGASTGKREALELRDGDSRYLGKGVLQACENVNTKLSEELIGLSPFDQSEIDAIIQELDGTENFANIGANAALGVSMAVARSAAKSLNIPLYRYLGGANALTLPVPMLNIINGGSHADNTVDFQEYMIMPLGFENFSESLRASAEVYHHLKKILKDSKHITSIGDEGGFAPNLKTNEEPIQIIIQAIEKAGYRPGEEIALALDVASSEFVNEQGLYHLEGEGRTLSSEELVGYYESLIAKYPIVSIEDGLSEDDWKGWKYLTERLGGKVQLVGDDLFVTNAKILQEGISQGIANAILIKPNQIGTVSQTMQTVRLAQRNHYRCVMSHRSGESEDSFIADFAVALNTGEIKTGSTARSERIAKYNRLLAIESELCRSEYLGRSLF

SEQ ID NO: 21764 - protein, 255 aa, Wolinella succinogenes
MESFGVLSMKKLVAYITAALPDKEFTIDLALALSASGVDSLELGVPFSDPVADGPIIEHANLLALQKGFSLQDLYEITEKISPSIDTLWMGYLNPFHKVGFEQTCQKAKSLGVSGLIIPDVPFEESAPFEEQCLQNNLALIRFIAPTLGTSRIATIAPMARKFIYLVAYAGITGSGREEPLSPLIEEIRAINPEIPLYLGFGVNEHNAKEKSKEVDGVIVGSALVKVLLDERLTNTQKMTTICALAKSIKESINS

SEQ ID NO: 21765 - protein, 510 aa, Wolinella succinogenes
MNALLSVSDKTGIVEFAQELCALGYTLLSTGGTLKLLQEHNIKAKEVGEYTQSPEMFEGRVKTLHPKIHGGILHRRHLKEDVKTAKEHGIEPIDIVCVNLYPFKATIERTDDFEEIIENIDIGGPSMVRAAAKNYRDVLIITDPKDYASVIESLKKGENDEEFRRDMMIRAFEHTAAYDSLIANYMNTRFNNGFGAKRFLVGERVCMTRYGENPHQMGALYEFERFWRDSFKTLKGEASFNNFTDLSGAVKIASAFGDSPAVCIIKHGNPCGFAIKENLLSSYQAALACDPISAYGGVVAINGVLDERLALEINQIFIEVIVAGRITPEALAVFETKKRIKLFECGADRLNFPRDEIDFKHIEGGFVFQEADRVKDEEIQGAKLMGQIEATPAQKRDLEIAYKVAALVKSNCVVYVKDSAMVAVGMGMTSRVDASKAALAKAKESGLEVKGAVLASEAFFPFKDSIEAAHEAGVSAVIEPGGSIRDDEVIQAANEFGMALYFTGVRHFLH

SEQ ID NO: 21766 - protein, 431 aa, Wolinella succinogenes
MERINSINDFNEAKQVIPGGVNSPVRAFRAVGGTPPFIKEAKGSYLVDEDGNRYIDFVQSWGPLLFGHADLDIQKAVEEAIKRGLSFGAPTTSETLLAKEIIALYEGIEKIRFTSSGTEATMSAIRLARGYTGRDDIIKFEGCYHGHSDALLVQAGSGLATFGNPSSPGVPQSFTKHTLLARYNDLESVRECFKKSSGVACVILEPIAGNMGLVPATQEFIQGLRKLCDEQGSVLIFDEVMSGFRASFGGAQALYGVIPDMATFGKVIGGGMPVGAFGGRSDIMACLSPEGAVYQAGTLSGNPVAMAAGIASIRKIKQGGEALFSRLESLALRLMEGFKKCAQKHQIPLQTTVRGSMFGFFFNHAPVSNFEEALQSDTALFAKFHQAMLERGVYLACSQFETGFICASMDESLVDEVIAKIDEALEEIGRG

SEQ ID NO: 21767 - protein, 422 aa, Wolinella succinogenes
MHPKTLAIQAGYEKGKGEKSIAVPIYQTTAYKFDDTEHGANLFDLKELGNIYTRIMNPTTDVLEKRVALLEGGVAALASASGMASIFYAVANLAQSGENIIATTQLYGGTLNQFTHTLSRFGIEVRFFDGNHPQEARALIDSKSRALFFESLTNPSIDVPEIDTLAKIADEYGIVSIVDNTVATPAICRPIEHGVDVVVHSASKYMGGQGLAIGGVLVESARVAEKLRGNPRYPHFNTPDPSYHGLVYASAPLPPFVLRARLALLRDIGATLSPFDSWLFIQGIETLSVRMREHSLSAMKIAHYLQNHPKVQAVYYPGLESDKNHANAVKYFDEGMFSGLLSFEVGDFELAQKIADSVKIFTLATNIGDTKSIITHSASTTHRQVSAEGLKKAGVTPGLVRLSIGLEDYRDLIEDLAQAIDG

SEQ ID NO: 21768 - protein, 481 aa, Wolinella succinogenes
MKIRKRALTFEDVLLIPKYSEVLPKEVNLSSKLTRHIDLNAPIISAAMDTVTEYRAAIAMARLGGIGVIHKNMDIEAQVEQVKKVKKSESGVIIDPIYISPENTLAQAKALTDNYKISGVPVVDKEGILIGILTNRDVRFETDLSRLVGEVMTKAPLIVGKVGTSLEEAREIMHQHKIEKLPIVNEKGILKGLITIKDIQKRIEYPNSNKDDFGRLRVAAAIGVNQLDRAKALVDAGVDVLVLDSAHGHSKGIIETVKKVKEQLVVDIIAGNIATAEAAEALIAAGADGIKVGIGPGSICTTRIVAGVGVPQVSAIDEVAQVAKKHGVPVCADGGIKYSGDVAKALAVGASSVMIGSLLAGTEESPGDMVIFQGRQYKSYRGMGSIGAMNKGSTDRYFQEGTAADKLVPEGIEGRVPYRGKMGDVIHQMLGGLRASMGYLGAKDIPTLWEQAEFVEITSAGLRESHVHDVVITQEAPNYHV

SEQ ID NO: 21769 - protein, 252 aa, Wolinella succinogenes
MNLIEVEHLCTHYEGRAIHEDISLTIRQGEIYGLLGGSGSGKSTLMRSMILLKRPTSGVVRIHGEDIWALPLERQAKLRLSWGVLFQFGALFSSLSVLENVSILLKEYSSYPKEVIESVAMMWIDRVGLPPHAARLYPSELSGGMKKRAALARALALSPEVLFLDEPTSGLDPNSAEKFDRLILELRDTLGITVVMVTHDLDTVMDAMDRFVILHDCKVLMEGTLEELKQRDFPELKNFYKTNRGGKLWRTV

SEQ ID NO: 21770 - protein, 492 aa, Wolinella succinogenes
MAQKTLLIITDGIGHKPSSPHNAFTQAKKPTYDSLFASAPHALLSTHGLSVGLPEGQMGNSEVGHMCIGAGRILYQDLVKISLALKDGSLEKNPTLLGFSSRAKRIHLAGLASDGGVHSHMEHLLGLAQIFSRLGHEVLLHLITDGRDVSPTSSKEFIAQALALESDLIKIATISGRYYAMDRDKRWDRIKRAFGVIARGDSPTSLTPQEYIQAQYQAGITDEFIEPAALGGYQGFEPSDGFVFANFRSDRAREIVSALGGASFEGFDRGAYQPPKTLAMTSYDDSFPFPILFPKEKVEPTLAQVISEAGLSQLHVAETEKYAHVTFFFNGGIETPWENESRVLIPSPSVATYDLKPEMSAPEVAEATLSGMRQGYDFIVVNFANGDMVGHTGNTEAAISAVESVDRELGRLLEEAKKSGYAVILTSDHGNCEEMRDERGSMLTNHTVGEVWCFILAQGVTEIREGGLNQVAPTVLKIMGLPTPKEMDSPLF

SEQ ID NO: 21771 - protein, 498 aa, Wolinella succinogenes
MLKCPHQFTFSIRQSSSHSRRKDMADQSKVKEFFRFCQENEVEFVDFRFTDIKGVWHHVSYSMASIDEESFNGLPFDGSSIPAWQPINRSDMQLIPDPVSYFLDPFTADTTVVVFCDVWDIYKNQPYEKCPRSIAKKALKYLESTGLGDVAYFGPENEFFVFDSIKIQDSINCQSYEVDVEEGTWNSNRAYENGYNLGHRPGTKGGYFPVAPVDSMVDIRAEMVKVLNQVGLETFVVHHEVAQGQGEIGVRFGDLIKAADNVQKLKYVVKMVAHMNGKTATFMPKPLYGDNGSGMHTHISIWNKGENTFAGDAYQGLSETALHFVGGVLNHAKSAAAFTNASTNSYKRLIPGFEAPSILTYSAQNRSASVRIPYVQGAKAKRVEFRFPDSSANPYLAFSALLMAGIDGIQTKANPGEPMEMDLFELSLDEIREKGIKQMPHTLRSAVENMLADKDYLKKGDVFSEDFLQTYKAYKFETEIWPWEARPHPFEFISTYSC

SEQ ID NO: 21772 - protein, 430 aa, Wolinella succinogenes
MLEGFFKLKEHQTNVKTEALAGFTTFLTMMYIVPVNAIIMSQTGMPMDALITATALITILSTLLNGVWANTPVAMSVGMGLNAYFTFGLVLGMKIPWENALGIVFLSGILFLVVSFTNFRRWIMESIPHDLRRAISAGIGAFIAFIGLKQMGIIADNPATLVGLGNLADTNVLVGIFGLLVVLALSAWRIKGAFILSVAITSILGWILGIKAMPEAIFSMPASIAPIMFKLNILEVLTLSMLPVILAFMITDMFDSLGTLAGVGYRAGIFREKGSKELEKTLQVDAVATVGGSLLGLSTTTSFLESASGVEEGGRTGLTAIFTAFCFILTLFMLPLFGAIPDNAIYPVLVAVGILMFAELRHVDFSDFSISVAAFAIVLFMPLTYSITNGLAAGLLLYFFMRLIKGEFKELSGGLLFLALISLIPFVFHA

SEQ ID NO: 21773 - protein, 496 aa, Medicago truncatula
LKKFNSYDPNHIPVKAKINVTVICSCGNSQISKDFGLFVTYPLRSDDTLAKIATKADLDEGLLQNFNQDANFSKGSGIVFIPGRDENGVYVPLPSRKAGHLARSLVAAGICIRGVCMVLLLAICIYVRYFRKKNGEESKLPPEDSMSPSTKDGDKDSYSDTRSKYILVDKSPKFSYKVLANATENFSLAKKIGQGGFGEVYYGVLGGKKVAIKKMKTQATREFLSELKVLTSVRHLNLVHLIGYCVEGFLFLVYEYMENGNLSQHLHNSEKELMTLSRRMKIALDVARGLEYIHDHSVPVYIHRDIKSDNILLNKNFNGKIADFGLTKLTNIANSTDNTNHMAGTFGYMPPENAYGRISRKMDVYAFGVVLYELISAKAAVIMIDKNEFESHEIKTNESTDEYKSLVALFDEVMDQKGDPIEGLRKLVDPRLGDNYSIDSISKMAKLAKACINRDPKQRPKMRDVVVSLMKLISTIDDESRTDSAELSLDVEHDSN

SEQ ID NO: 21774 - protein, 485 aa, Streptomyces coelicolor A3(2)
MRTAYSVETVRNAERELMARLPEGALMQRAAAGLAAACAQVLARVAGRVYGSRVVLLVGSGDNGGDALYAGARLARRGAGVTAVLLAPDRAHGGGLTALRRAGGRVAEGGPAGSAEELIARADLVLDGIVGIGGSGGLRKEAGPLADAAARSRAAVVAVDLPSGVDADTGRVRGDVVRADLTVTFGTHKPGLLIDPAREYAGSVRLVDIGLPLPGEAAELEALQHPDVARLLPVPAGESDKYRRGVVGIAAGSARYPGAAVLAVAGALRGGAGAVRYVGPAGDAVIARFPETLVSDQGPKRAGRVQAWVVGPGAGDDAATVAQVLAAEVPVLIDADGLRLADADAVRARTAPTLMTPHAGEAAALLGVGREEVEAARLDSVRELAARYGATVLLKGSTTLVARAKGGPVRVNATGTSWLATAGSGDVLSGLAGSLLAAGLSAVDAGSVGAYLHGLAGRFAAEGAPAGAHDVAAAIPRAWRDVRGD

SEQ ID NO: 21775 - protein, 312 aa, Physcomitrella patens subsp. patens
MNWFEDKRRFGGLIGAFIEKATKGYILNERERDKYIKIDTTKGLWTRCDSCENMLYVRFLKQNKRICEECGYHLQMSSIERIELLIDHGTWQPMYEDMVARDVLKFSDEDSYKNRVIFYQKRTGLTDAIQTGIGKLNKNLVALGVMDFQFMGGSMGSVVGEKITRLIEYAFKESLPLIIVCSSGGARMQEGTLSLMQMAKITSLLQFYQVRKKLFYIAILTYPTTGGVTASFGMLGDIIIAEPKAYIAFAGKRVIEQTLRQKIPDGFQVAESLFYSGLLDLIVPRTFLKGVLGEIFELYSLGVYKESNSYLF

SEQ ID NO: 21776 - protein, 475 aa, Physcomitrella patens subsp. patens
MSPRPEIKAGVGFKAGVKDYRLTYYTPDYQTKDTDILAAFRMTPQPGVPAEECGAAVAAESSTGTWTTVWTDGLTSLDRYKGRCYAIEPVAGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKSQGETGEIKGHYLNATAGTCEEMIKRAQFARELGMPIVMHDYLTGGFTANTSLAHYCRDNGLLLHIHRAMHAVLDRQKNHGMHFRVLAKALRLSGGDHIHSGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFDTVDTL

SEQ ID NO: 21777 - protein, 168 aa, Physcomitrella patens subsp. patens
MPRSQKNDNFIDKTFTIVADILLRIIPTTQREKEAFTYYRDGMSAQSEGEYAEALQNYYEAMRLEIDPYDRSYILYNIGLIHTSNGEHAKALEYYFQALERNPSLPQAFNNMAVICHYRGEQAIQQGDSETSEAWFNQAADYWKQAIALAPSNYIEAQNWLKITDRLK

SEQ ID NO: 21778 - protein, 378 aa, Rhodococcus sp. NCIMB 9784
MDFRFTDEQQMWHETVHAFMEREVGIEYIRKHDEAREFPEEAYQKIADRGWLGLLIPEQYGGLEADPVMYAIFCEAIAKYSLDFAAAIMTSMFTATNIAFHGTDEQRQKYLPDFMEGKIKFSISITEPNAGSDAAGLRTRAVQDGDSWIINGNKVFCSGAHLPGTVIAVMARTSEDKHKGLSMILVPNTTEGVDVRKLDTIVRRSLGTTEIFFTDARVPVENIIGQPGDGWTVVGSHLEWERLSLAATYVGNARTALDDTIRYTKDRTQFGRPLSSFQVLKHRMAEDECEVEAARLLVYSAATKLARGEKALKEVSMAKVFAAKTAFRVATNGMQALGGYATLPEYDMERYFREAKHGMVGGGTNEIQHSIIAKQMGL

SEQ ID NO: 21779 - protein, 117 aa, Streptococcus constellatus subsp. pharyngis
MTKIYDFSIFDQNNRSISLEIYKGNVLLIVNTATGCGLTPQYKGLQHLYTRYQNQGFEILDFPCNQFMGQAPGTAEEINRFCSLHYQTTFPRFAKVKVNGKEADPLYIWLKEQQAGP

SEQ ID NO: 21780 - protein, 454 aa, Fusarium oxysporum f. sp. lycopersici
MLFNNVLSAVAVSVLVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNRPIGSTLSSTARTCLISDLELEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGTLSASTRRCSTSWLRILKSRFQGKKPPVYDCQNIDTSTLDITCRDPTNARDTTNG

SEQ ID NO: 21781 - protein, 486 aa, Hordeum vulgare
MGSHSLTQAASRRRRCGWLLPLVVGVAFLGEIAFLGRLDMSKNAAAVESWTTSFHRLSSTWGADAPPGSGDDDEECEERLERDDAVPYDRDFERHPVLVGGAAKDWNRCSVGCEFGFPASKTPDATFGIAPDPSVESILRSMESSQYYSENNINAARGRGYQIVMTTSLSSDVPVGYFSWAEYDIMAPVPPKTEEALAAAFISNCGARNFRLQALEMLESLDVKIDSYGSCHRNRDGKVDKVETLKGYKFSLAFENSNEEDYVTEKFFQSLVTGAIPVVVGAPNIQEFSPGEDAILHIKELDDVISVAKTMKHIASNPDAFNQSLRWKYDGPSDSFKALIDMAAVHSSCRLCIHIATKIHEKEEKTPKFMNRSCSCSSKRGTVYHLFVRERGRFKTENIYLRSDQLTLGALKSAVHDKFSSLKHVPIWKDERPSSIRGGDELKVYKIYPIGLTERQALYKFQFSDDAEVARYIKGHPCAKLEVIFV

SEQ ID NO: 21782 - protein, 487 aa, Triticum aestivum
MKGSHSQSQAASRRRRCGWLLPLLVGVAFVGEIAFLGRLDMSKNAAAVESWTTSFYRLSSTWGADAPPGSGDDDDECEERLEREDAVPYDRDFERDPVLVGGAAKDWNRCSVGCEFGFPASKTPDATFGIAPDPSVESILRSMESSQYYSENNINAARGRGYQIVMTTSLSSDVPVGYFSWAEYDIMAPVPPKTEEALAAAFISNCGARNFRLQALEMLESLDVKIDSYGSCHRNRDGKVDKVETLKRYKFSLAFENSGEEDYVTEKFFQSLVTGAIPVVVGAPNIQEFSPGEGAILHIKELDDVISVAKTMKHIASNPDAFNQSLRWKYDGPSDSFKALIDMAAVHSSCRLCIHIATKIHEKEERTPKFMNRSCSCSSKRGTVYHLFVRERGRFKTESIYLRSDQLTLGALESAVHGKFRSLKHVPVWKDERPSSIRGGDELKVYKIYPIGLTERQALYKFQFSDDAEVARYIKGHPCAKLEVIFV

SEQ ID NO: 21783 - protein, 160 aa, Bisgaard Taxon 7
KVAAGEAGGITQHIGAYHVETNGKMITFLDTPGHAAFTSMRARGAKATDIVVLVVAADDGVMPQTIEAIQHAKAASVPIVVAVNKIDKPEANPDRVEQELLQYDVVAEKFGGDVQFVYVSAKKGTGVDELLDAILLQSEVLELTAVKDGMASGVVIESYL

SEQ ID NO: 21784 - protein, 151 aa, Bisgaard Taxon 17
IPHIGAYHVEMDDGKMITFLDTPGHAAFTSMRARGAKVTDIVVLVVAADDGVMPQTIEAIQHAKAAGAPLVVAVNQIDKPEANPDRVEQELLQHEVISEKFGGDVQFVPVSAKQGLGIDELLDAILLQSEVLELTAVKDGMASGVVIESYL

SEQ ID NO: 21785 - protein, 149 aa, Bisgaard Taxon 14
TRGSGEAGGITPDIGAYHVQTDNGMVTFLDTPGHAAFTSMRARGAKATDIVVLVVAADDGVMPQTIEAIQHAKAPTCRLVVAVNKIDKPEADPDRVKNELSQYEVISEDWGGDTQFVHVSAKKGTGVDELLDAILLQSEVLELTAVKDA

SEQ ID NO: 21786 - protein, 153 aa, Bisgaard Taxon 14
TRGSGEAGGITPDIGAYHVQTDNGMVTFLDTPGHAAFTSMRARGAKATDIVVLVVAADDGVMPQTIEAIQHAKAPTCRLVVAVNKIDKPEADPDRVENELSQYEVISEDWGGDTQFVHVSAKKGTGVDELLDAILLQSEVLELTAVKRRHGSG

SEQ ID NO: 21787 - protein, 160 aa, Gallibacterium genomosp. 1
KVAAGEAGGITQHIGAYHVHTPNGDITFLDTPGHAAFTSMRARGAQATDIVVLVVAADDGVMPQTIEAIQHAKAANVPLVVAVNKIDKPEADPDRVKTELSQYGVISEDWGGDTQFVNVSAKKGIGIDELLDAILLQAEVLELKAVKDGMATGVVIESYL

SEQ ID NO: 21788 - protein, 153 aa, Pasteurella gallinarum
GITQHIGAYHVETDDGKMITFLDTPGHAAFTSMRARGAKATDIVVLVVAADDGVMPQTIEAIQHAKAAGVRIVVAVNKIDKPEANPDRVEQELLQHEVIAEKFGGDTQFVYVSAKKGTGVDELLEAILLQSEVLELSAVKDGMATGVVIESYL

SEQ ID NO: 21789 - protein, 161 aa, Volucribacter psittacicida
KVAAGEAGGITQHIGAYHVETDDGKMITFLDTPGHAAFTSMRARGAKATDIVVLVVAADDGVMPQTIEAIQHAKAAGVPIVVAVNKIDKPEANPERVETELLQHDVVAEKFGGDTQFVYVSAKKGTGVDDLLEAILLQSEVLELTAVKEGMASGVVIESYL

SEQ ID NO: 21790 - protein, 156 aa, Haemophilus parasuis
EAGGITQHIGAYHVETDDGKMITFLDTPGHAAFTSMRARGAKARDIVVLVVAADDGVMPQTIEAIQHAKAAGAPIVVAVNKIDKPEANLERVEQELLQHEVISEKFGGDVQFVPVSAKKGMGIDDLLEAILLQSEVLELSAVKEGMASGVVIESYL

SEQ ID NO: 21791 - protein, 145 aa, Mannheimia haemolytica
GAYHVETDDGKMITFLDTPGQAAFTSMRARGAKATDIVVLVVAADDGVMPQTIEAIQHAKAAGAPLVVAVNKIDKPEANPDRVEQELLQHEVISEKFGGDVQFVPVSAKKGMGIDDLLEAIILQSEVLELTAVKDGMASGVVIES

SEQ ID NO: 21792 - protein, 141 aa, Actinobacillus succinogenes
GINQHIGAYHVETKGKIITFLDTPGHAAFTSMRARGAKATDIVVLVVAADDGVMAQTIEAIQHARAAGVPIVVAVNKIDKPEANPERVEQELLQYDVVAEKFGGDVQFVYVSAKKGSGVDDLLDAILLQSEVLELTAVKDG

SEQ ID NO: 21793 - protein, 153 aa, Pasteurella aerogenes
  misc_feature (73)..(73): Xaa can be any naturally occurring amino acid
AAGEAGGITQHIGAYHVETEDGKMITFLDTPGHAAFTSMRARGAKATDIVVLVVAADDGVMPQTIEAIQHAKXAGVPIVVAVNKIDKPEANPDRVEQELLQHEVIAEKFGGDTQFVYVSAKKGTGVDELLDAILLQSEVLELTAVKDGMASGV

SEQ ID NO: 21794 - protein, 161 aa, Pasteurella trehalosi
KVAAGEAGGITQHIGRYHVETDDGKMITFLDTPGHAAFTSMRARGAKATDIVVLVVAADDGVMPQTIEAIQHAKAQGHHLVVAVNKIDKPEANPERVEQELLQHDVISEKFGGDVQFVPVSAKKGMGIDDLLEAIILQSEVLELTAVKDGMASGVVIESYL

SEQ ID NO: 21795 - protein, 155 aa, Pasteurella bettyae
AGGITQHIGAYHVETADGKMITFLDTPGHAAFTSMRARGAKATDIVVLVVAADDGVMPQTIEAIQHAKAAGAPLVVAVNKIDKPEANPERVEQELLQYEVISEKFGGEVQFVPVSAKKGTGIDELLDAILLQSEVLELTAVKDGMATGVVIESYL

SEQ ID NO: 21796 - protein, 147 aa, Actinobacillus rossii
AGEAGGITQHIGAYHVETNDGKMITFLDTPGHAAFTSMRARGAKATDIVVLVVAADDGVMPQTIEAIQHAKAAGAPLVVAVNKIDKPEANPDRVEQELLQYEVISEKLVGDVQFVPVSAKKGTGIDELLDAIMLQSEVLELTAVKDG

SEQ ID NO: 21797 - protein, 144 aa, Pasteurella caballi
AGGITQHIGAYHVETADGKMITFLDTPGHAAFTSMRARGAKATDIVVLVVAADDGVMPQTIEAIQHAKAAGVPLVVAVNKIDKPEANPDRVEQELLQYDVIAEKFGGDVQFVYVSAKKGTGVDELLDAILLQSEGLELNSVKDG

SEQ ID NO: 21798 - protein, 160 aa, Lonepinella koalarum
KVAAGEAGGITQHIGAYHVETKGKVITFLDTPGHAAFTSMRARGAKATDIVVLVVAADDGVMPQTIEAIQHARAAGVPIVVAVNKIDKPEANPERVEQELLQYEVVAEKFGGDVQFVYVSAKKGTGVDELLDSILLQSEVLELTAIKDGMASGVVIESYL

SEQ ID NO: 21799 - protein, 141 aa, Actinobacillus delphinicola
ETNGKMITFLDTPGHAAFTSMRARGRISTDIVVLVVAADDGVMPQTIEAIQHAKAAGVPLVVAVNKIDKPEANPDRVEQELLQYDVISEKFGGEVQFVPVSAKAGMGVDELLDAILLQSEVLELTAVKEGMATGVVIESYL

SEQ ID NO: 21800 - protein, 142 aa, Gallibacterium anatis
VHTPNGDITFLDTPGHAAFTSMRARGAQATDIVVLVVAADDGVMPQTIEAIQHAKAANVPLVVAVNKIDKPEADPDRVKTELSQYGVISEDWGGDTQFVNVSAKKGIGIDELLDAILLQAEVLELKAVKDGMATGVVIESYL

SEQ ID NO: 21801 - protein, 161 aa, Actinobacillus lignieresii
KSAAGEAGGITQHIGAYHVETEDGKMITFLDTPGHAAFTFMRARGAKATDIVVLVVAADDGVMPQTIEAIQHARAAGAPIVVAVNKIDKPEANPDRVEQELLQHEVVSEKFGGDVQFVPVSAKKGLGIDDLLEAILLQSEVLELTAVKEGMASGVVIESYL

SEQ ID NO: 21802 - protein, 377 aa, Ipomoea nil
IPSPKDSIFLASLSDSKPDPFQNLLGAFKKWDSKVGCAQFREKHGGGFGNGSGLISSYASLQGVDEGELECGELKMNHVSILVKGWTWIPDGMDNLYSCRCGLSCLWTKLPVMADKPDALLFETSTPPLKRRKGEPLRVYMDLEAGRTRSGYEDLFISYHAKDDVQSTYAGSIFHKNRNYHLSSYKRNDTLVYWSSSRCLPERNKLAKQLLRLLPTHSFGKCLNNVGGLDNALTLYPDCIKDPNEAPKWWDHLHCAMSHYKFVLAIENTMTESYVTEKLFYALESGSVPIYFGAPNVQDFVPPHSIIDGTKFKSLEELASYVKALANDPVAYAEYHAWRRCGVMGNYRKTRAASLDTLPCRLCEAVSKKNGRNAEAS

SEQ ID NO: 21803 - protein, 123 aa, Torulaspora delbrueckii
MPEVINHPETLPKWWKEASVYQIYPASFKDSNNDGWGDMKGIASKLEYLKDLGIDAIWISPFYDSPQDDMGYDIANYEKVWPTYGTNEDCFKLIEKTHEMGMKFITDLVINHCSSEHEWFKES

SEQ ID NO: 21804 - protein, 447 aa, Alvinella pompejana epibiont 6C6
MAQKAIREYDAKSILARHWDRYFPKFNYPYQTVLVETGEQLREASETTHPWLKEKPLVAKPDMLFGKRGKNSLVLFKVNKPGDVTLEDAANWIDEKRATQQKVYFSFDGDTPAGEPSEDYLTHFIVEPFTPHSQDEEYYISATVVGDDDVLYMSAEGGMEVEENWDKVIEVKFKINETEDDIEKKIRENIPADVKEEDKENFAEFAIGFFKAYRELNFAYLEINPFVMQDNKIELLDMVAKLDDTAGFMMVDHWGKIEFPMPFGMEAKSKEEQAVEEADSKTGASLKLTVLKPEARIWTMVAGGGASVVYADTIADFAGIADLANYGEYSGGPTTGETKFYAETILDLMTREKDTQGREKILIIGGAIANFTDVAKTFTGIIQAFEEYADKMKDVGVKIYVRRGGPNYEKGLRDIQDAANRLGLWIDVHGPDTHITDIVRMALEEKA

SEQ ID NO: 21805 - protein, 447 aa, Alvinella pompejana epibiont 7G3
MAQKAIREYDAKSILARHWDTYFPKFNYPYQTILVETGEQLKKAAETTHPWLKEKPLVAKPDMLFGKRGKNGLVLFKVNKPGDVTLEDAANWIDEKRATKQKVYFSFDGDTPAGEPSEDYLTHFIVEPFTPHSQDEEYYISATVVGDDDVLYMSAEGGMEVEENWDKVIEVKFKINETEDDIEKKIRENIPADVKEEDKENFAEFAIGFFKAYRELNFAYLEINPFVMQDNKIELLDMVAKLDDTAGFMMVDHWGKIEFPMPFGMEAKSKEEQAVEEADSKTGASLKLTVLKPEARIWTMVAGGGASVVYADTIADFAGIADLANYGEYSGGPTTGETKFYAETILDLMTREKDPQGREKILIIGGAIANFTDVAKTFTGIIQAFEEYADKMKDVGVKIYVRRGGPNYEKGLRDIRDAANRLGLWIDVHGPDTHITDIVRMALEEKA

SEQ ID NO: 21806 - protein, 394 aa, Alvinella pompejana epibiont 7G3
MNLEELDKQFVLQTYARDYTNFVRGENATLFSEDGRDFIDFASGIGVSSVGHGNRRLSDAVCEQVRNIIHISNLQVIEPQVKLAQKICELSGYDGAIFFANSGAEANEGAIKVARKYGEVNFDKKRYKVITLEHSFHGRTISTLKATGQKSFHTPSFSPYPDGFLYVKSIEDIYGSIDDETVAVLIELVQGEGGVEPFSIGEVQNLAKFLRENGILLIVDEVQTGVFRTGEMLASNIYQIEPDIITLAKGLGGGVPIGAILTKHRDILKAGEHGSTFGGNYLSTRAGLEVLSILNGLYESGELKETISYFEERLKGIRERFSNLFSQDVGVGLMRGLRAEEADIPSKVVKSSMDSGLIVLKAGRNTVRFLPPLTISKSEIDKGFERFEKAISSI

SEQ ID NO: 21807 - protein, 304 aa, Acinetobacter sp. CR1
MMAAQLKQGKIGFIGADPVQSRQAFDRQMQSILSTPTAVKRVEEIRLNLASGNIAARYYHPAPHKKLPLIVFYHGGGFVVGGLDSHDEFCRLMAVHAHAQVLSVEYPLAPEASPQQIIQVCEDALAWAYQHRREMKILKNRIAVAGDSAGGNIAAVVAQRSAQSAYAPNAQFLIYPALDFKSRHPSFFAYKDGLVLTGQDIDFVTQHYVTQHQVALDDPIISPTFGKLKKLAPAFVVTAGHDVLHDEAEIYAHKLRQNQVTVKYVEYLDQTHGFISMTFVSRRAKKISIELCKNFRKFWDRPRS

SEQ ID NO: 21808 - protein, 344 aa, Anisodus tanguticus
MATLVSNWSSNNVSESFIAPLDKRAEKEVPLGNDVPIIDLQQDHHFVVQQITKACKDFGLFQVINHGFPEKLMVETMEVCKEFFALPAEENEKLQPKGKPAKFELPLEQKAKLYIEGEQLSNEEFFYWKDTLAHGCHPLDEELINSWPEKPATYREVAAKYSVEARKLTMRMLDYICEGLGLKLGYFDNELSQIQMMLTNYYPPCPDPSSTLGSGGHYDGNLITLLQQDLPGLQQLIVKDDNWIAVEPIPTAFVINLGLTLKVITNEKFEGSIHRVVTDPTRDRVSIATLIGPDYSCTIEPAKELLSQDNPPLYKPYPYAEFAEIYLSDKSGYDAGVKPYKINA

SEQ ID NO: 21809 - protein, 111 aa, uncultured episymbiont of Alvinella pompejana
WTMVAGGGASVVYADTIADFAGIEDLANYGEYSGGPTTGETKFYAETIFDLMTREPDPQGRGKVLIIGGAIANFTDVAKTFTGIIQAFENYQDKLKEVGTKIYVRRGGPNY

SEQ ID NO: 21810 - protein, 111 aa, uncultured episymbiont of Alvinella pompejana
WTMVAGGGASVVYADTIADLAGIEDLANYGEYSGGPTTAETRFYAETILDLMTREKDPQGRDKILIIGGAIANFTDVAKTFTGIIQAFEEYADKMKDTGVRIYVRRGGPNY

SEQ ID NO: 21811 - protein, 111 aa, uncultured episymbiont of Alvinella pompejana
WTMVAGGGASVAYADTIADLAGIEDLANYGEYSGGPTTAETRFYAETILDLMTREKDPQGRDKILIIGGAIANFTDVAKTFTGIIQAFEEYADKMKDTGVRIYVRRGGPNY

SEQ ID NO: 21812 - protein, 111 aa, uncultured episymbiont of Alvinella pompejana
WTMVAGGGASVVYADTIADLAGVEDLANYGEYSGGPTTGETKFYAETILDLMTREKDPQGREKILIIGGAIANFTDVAKTFTGIIQAFEEYADKMKDVGVKIYVRRGGPNY

SEQ ID NO: 21813 - protein, 111 aa, uncultured episymbiont of Alvinella pompejana
  misc_feature (43)..(43): Xaa can be any naturally occurring amino acid
WTMVAGGGASVVYADTIADLAGIEDLANYGEYSGGPTTAETRXYAETILDLMTREKDPQGRDKILIIGGAIANFTDVAKTFRGIIQAFEEYADKMKDTGVRIYVRRGGPNY

SEQ ID NO: 21814 - protein, 111 aa, uncultured episymbiont of Alvinella pompejana
WTMVAGGGASVVYADTIADLAGIEDLANYGEYSGGPTTAETRFYAETILDLMTREKDPQGREKILIIGGAIANFTDVAKTFTGIIQAFEEYADKMKDVGVKIYVRRGGPNY

SEQ ID NO: 21815 - protein, 111 aa, uncultured episymbiont of Alvinella pompejana
WTMVAGGGASVVYADTIADFAGIDDLANYGEYSGGPTTGETKFYAETILDLMTREKDPQGRDKILIIGGAIANFTDVAKTFTGIIQAFEKYADKMKDVGVKIYVRRGGPNY

SEQ ID NO: 21816 - protein, 111 aa, uncultured episymbiont of Alvinella pompejana
WTMVAGGGASVVYADTIADMAGIDDLANYGEYSGGPTTGETKFYAETLLDLMTREKDPKGRGKVMIIGGAIANFTDVAKTFTGIIQAFENYADKMKEVDLKIYVRRGGPNY

SEQ ID NO: 21817 - protein, 111 aa, uncultured episymbiont of Alvinella pompejana
WTMVAGGGASVVYADTIADFAGIADLANYGEYSGGPTTGETKFYAETILDLMTREKDPQGREKILIIGGAIANFTDVAKTFTGIIQAFEECADKMKDVGVKIYVRRGGPNY

SEQ ID NO: 21818 - protein, 111 aa, uncultured episymbiont of Alvinella pompejana
WTMVAGGGASVVYADTIADLAGIEDLANYGEYSGGPTTAETRFYAETILDLMTREKDPQGRDKILIIGGAIANFTDVAKTFTGIIQAFEEYADKMKDTGVSIYVRRGGPNY

SEQ ID NO: 21819 - protein, 111 aa, uncultured episymbiont of Alvinella pompejana
WTMVAGGGASVVYADTIADFAGIADLANYGEYSGGPTTGETKFYAETILDLMTREKDPQGREKILIIGGAIANFTDVAKTFTGIIQAFENYQDKLKEVGTKIYVRRGGPNY

SEQ ID NO: 21820 - protein, 109 aa, uncultured episymbiont of Alvinella pompejana
WTMVAGGGASVVYADTIADLAGVEDLANYGEYSGGPTTGETKFYAETIFDLMTRYEDPRGKVLIIGGAIANFTDVAKTFTGIIQALENYADKLKAHNTKIYVRRGGPNY

SEQ ID NO: 21821 - protein, 111 aa, uncultured episymbiont of Alvinella pompejana
WTMVAGGGASVVYADAIADFAGIADLANYGEYSGGPTTGETKFYAETILDLMTREKDPQGREKILIIGGAIANFTDVAKTFTGIIQAFEEYADKMKDVGVKIYVRRGGPNY

SEQ ID NO: 21822 - protein, 111 aa, uncultured episymbiont of Alvinella pompejana
WTMVAGGGASVVYADTIADFAGIADLANYGEYSGGPTTGETKFYAETILDLMTREKDPQDREKILIIGGAIANFTDVAKTFTGIIQAFEEYADKMKDVGVKIYVRIGGPNY

SEQ ID NO: 21823 - protein, 111 aa, uncultured episymbiont of Alvinella pompejana
WTMVARGGASVVYADTIADFAGIADLANYGEYSGGPTTGETKFYAETILDLMTREKDPQDREKILIIGGAIANFTDVAKTFTGIIQAFEEYADKMKDVGVKIYVRRGGPNY

SEQ ID NO: 21824 - protein, 111 aa, uncultured episymbiont of Alvinella pompejana
WTMVAGGGASVVYADTIADFAGIADLANYGEYSGGPTTGETKFYAETILDLMTREKDPQDREKILIIGGAIANFTDVAKTFTGIIQAFEEYADKMKDVGVKIYVRRGGPNY

SEQ ID NO: 21825 - protein, 111 aa, uncultured episymbiont of Alvinella pompejana
WTMVAGGGASVVYADTIADFAGIADLANYGEYSGGPTTGETKFYAETILDLMTREKDPQGREKILIIGGAIANFTDVAKTFTGIIQAFEEYADKMKDVGVKIYVRRGGPNY

SEQ ID NO: 21826 - protein, 110 aa, uncultured episymbiont of Alvinella pompejana
WTMVAGGGASVVYADTIADFAGIADLANYGEYSGGPTTGETKFYAETILDLMTREKDPQGRKKILIIGGAIANFTDVAKTFTGIIQAFEEYADKMKDVGVKIYVRRGGPN

SEQ ID NO: 21827 - protein, 111 aa, uncultured episymbiont of Alvinella pompejana
WTMVAGGGASVVYANTIADLAGIEDLANYGEYSGGPTTAETRFYAETILDLMTREKDPQGRDKILIIGGAIANFTDVAKTFTGIIQAFEEYADKMKDTGVRIYVRRGGPNY

SEQ ID NO: 21828 - protein, 111 aa, uncultured episymbiont of Alvinella pompejana
WTMVAGGGASVVYADTIADFTGIADLANYGEYSGGPTTGETKFYAETILDLMTREKDPQGREKILIIGGAIANFTDVAKTFTGIIQAFEEYADKMKDVGVKIYVRRGGPNY

SEQ ID NO: 21829 - protein, 111 aa, uncultured episymbiont of Alvinella pompejana
WTMGAGGGASVVYADTIADFAGIADLANYGEYSGGPTTGETKFYAETILDLMTREKDPQGRKKILIIGGAIANFTDVAKTFTGIIQAFEEYADKMKDVGVKIYVRRGGPNY

SEQ ID NO: 21830 - protein, 111 aa, uncultured episymbiont of Alvinella pompejana
WTMVAGGGASVVYADTIADFAGIADLANYGEYSGGPTTGETKFYAETILDLMTREKDPQDREKILIIGGAIANFTDVAKTFTGIIQAFEEYADKMKDVGVKTYVRRGGPNY

SEQ ID NO: 21831 - protein, 111 aa, uncultured episymbiont of Alvinella pompejana
WTMVAGGGASVVYADTIADFAGIADLANYGEYSGGPTTGETKFYAETILDLMTREKDPQGREKILIIGGAIANFTDVAKTFTGIIQAFEEYADKMKDVGVKIHARRGGPNY

SEQ ID NO: 21832 - protein, 111 aa, uncultured episymbiont of Alvinella pompejana
WTMVAGGGASVVYADTIADFAGIADLANYGEYSGGPTTAETRFYAETILDLTTREKDPLGREKILIIGGAIANFTDVAKTFTGIIQAFEEYADKMKDVGVKIYVRRGGPNY

SEQ ID NO: 21833 - protein, 110 aa, uncultured episymbiont of Alvinella pompejana
WTMVAGGGASVVYADTIADFAGIADLANYGEYSGGPTTGETKFYAETILDLMTREKDPQGREKILIIGGAIANFTDVAKTFTGIIQAFEEYADKMKDVGVKIYVRRGGPT

SEQ ID NO: 21834 - protein, 111 aa, uncultured episymbiont of Alvinella pompejana
WTMVAGGGASVVYADTIADFAGIDDLANYGEYSGGPTTGETKFYAETILDLMTREKDAQGREKILIIGGAIANFTDVAKTFTGIIQAFENYADKMKDVGVKIYVRRGGPNY

SEQ ID NO: 21835 - protein, 111 aa, uncultured episymbiont of Alvinella pompejana
WTMVAGGGASVVYADTIADFAGIADLANYGEYSGGPTTGETKFYAETILDLMTREKDPQAREKILIIGGAIANFTDVAKTFTGIIQAFEEYADKMKDVGVKIYVRRGGPNY

SEQ ID NO: 21836 - protein, 111 aa, uncultured episymbiont of Alvinella pompejana
WTMVAGGGASVVYADTIADFAGIDDLANYGEYSGGPTTGETRFYAETILDLMTREKDPQGRDKILIIGGAIANFTDVAKTFTGIIQAFEEYADKMKDVGVKTCVRRGGPNY

SEQ ID NO: 21837 - protein, 111 aa, uncultured episymbiont of Alvinella pompejana
WTMVAGGGASVVYADAIADFAGIDDLANYGEYSGGPTTGETRFYAETILDLMTREKDPQGRDKILIIGGAIANFTDVAKTFTGIIQAFEEYADKMKDVGVKIYVRRGGPNY

SEQ ID NO: 21838 - protein, 110 aa, uncultured episymbiont of Alvinella pompejana
LMVAGGGASVVYADTIADFAGIDDLANYGEYSGGPTTGETRFYAETILDLMTREKDPQGRDKILIIGGAIANFTDVAKTFTGIIQAFEEYADKMKDVGVKIYVRRGGPNY

SEQ ID NO: 21839 - protein, 107 aa, uncultured episymbiont of Alvinella pompejana
MVAGGGASVVYADTIADFAGVKDLANYGEYSGGPTTAETQFYAETIFDLMTRHKDPRGKILIIGGAIANFTDVAKTFTGIINAFEKYADKLKEHGTKIYVRRGGPNY

SEQ ID NO: 21840 - protein, 111 aa, uncultured episymbiont of Alvinella pompejana
  misc_feature (13)..(13): Xaa can be any naturally occurring amino acid
WTMVAGGGASVVXADTIADFAGIDDLANYGEYSGGPTTGETKFYAETILDLMTGEKDPQGRDKILIIGGAIANFTDVAKTFTGIIQAFEKYADKMKDVGVKIYVRRGGPNY

SEQ ID NO: 21841 - protein, 111 aa, uncultured episymbiont of Alvinella pompejana
WTMVAGGGASVVYADTIADFAGIDDLANYGEYSGGPTTGETRFYAETILDLMTREKDPQGRDKILIIGGAIANFTDVAKTFTGIIQAFEEYADKMKDVGVKIYVRRGGPNY

SEQ ID NO: 21842 - protein, 111 aa, uncultured episymbiont of Alvinella pompejana
WTMVAGGGASVVYADTIADFAGIDDLTNYGEYSGGPTTGETKFYAETIFDLMTSEKDPQGRGKVLIIGGAIANFTDVAKTFTGIIQAFENYQDKLKEVDTKIYVRRGGPNY

SEQ ID NO: 21843 - protein, 101 aa, uncultured episymbiont of Alvinella pompejana
VVYADTIADMAGIDDLANYGEYSGGPTTGETKFYAETLLDLMTREKDPQGRGKVMIIGGAIANFTDVAKTFTGIIQAFENYADKMKEVDLKIYVRRGGPNY

SEQ ID NO: 21844 - protein, 111 aa, uncultured episymbiont of Alvinella pompejana
WTMVAGGGASVVYADTIADMAGIEDLANYGEYSGGPTTGETKFYAETLFDLMTREKDAEGRGKVLIIGGAIANFTDVAKTFTGIIQAFENYQDKLKEVGVKIYVRRGGPNY

SEQ ID NO: 21845 - protein, 112 aa, uncultured episymbiont of Alvinella pompejana
WTMVAGGGASVVYADTIADLAGGVEDLANYGEYSGGPTTDETRFYTETVLDLMTREKDPQGRDKILIIGGAIANFTDVAKTFKGIIQAFEKYADKMKDVGVRIYVRRGGPNY

SEQ ID NO: 21846 - protein, 111 aa, uncultured episymbiont of Alvinella pompejana
WTMVAGGGASVVYADTIADMAGIDDLANYGEYSGGPTTGETKFYAETIFDLMTREKDAQGRGKVLIIGGAIANFTDVAKTFTGIIQAFEEYADKMKDTGVRIYVRRGGPNY

SEQ ID NO: 21847 - protein, 109 aa, uncultured episymbiont of Alvinella pompejana
  misc_feature (56)..(56): Xaa can be any naturally occurring amino acid
  misc_feature (62)..(62): Xaa can be any naturally occurring amino acid
WTMVAGGGASVVYADTIADLAGVKDLANYGEYSGGPTTAETQFYAETIFDLMTRHXDPRGKXLIIGGAIANFTDVAKTFTGIINAFEKYADKLKEHKTKIYVRRGGPNY

SEQ ID NO: 21848 - protein, 112 aa, Nautilia sp. Am-H
WTMVAGGGASVVYADTIADMAGGVEDLANYGEYSGGPTTDETRFYTETVLDLMTREKDPKGRDKILIIGGAIANFTDVAETFTGIIQAFEKYADKMKDVGTRIYVRRGGPNY

SEQ ID NO: 21849 - protein, 111 aa, Candidatus Arcobacter sulfidicus
WTMVAGGGASVVYADTIADMAGIEDLANYGEYSGGPTTGETKFYAETLFDLMTREPDPQGRGKVLIIGGAIANFTDVAKTFTGIIQAFENYQDKLKAVDTKIYVRRGGPHY

SEQ ID NO: 21850 - protein, 503 aa, Panax ginseng
MAIRIPTRQLFIDGEWREPAKKNRIAIINPATEQIIGNIPAATSEDVDIAVEAARRALARNGGSDWASASGAYRAKYLRAIAAKITERKSELAKLETLDCGKPLEEAAWDIDDVAACFEYNADLAEALDGKQKSPISLPMETFKSYILKEPIGVVGLITPWNYPMLMATWKVAPALAAGCAAILKPSELASVTCLELGEVCKEVGLPPGILNILTGLGPEAGAPLASHPHVDKIAFTGSTATGSKIMTAAAQQVKPVTLELGGKSPILVFEDVDLDKAAEWTIFGCFWTNGQICSATSRLLVHESIAAEFLDKLMKWTKNIKISDPLEEGCRLGPVVSGGQYEKVMESISTAKKEGATILCGGARPKHLEKGFFIEPTIISDVTTSMQIWREEVFGPVLCVKTFRTEDEAIELANDTRYGLGGAVISNDLERCERVTKALQSGIVWINCSQPCFCQAPWGGKKRSGFGRELGEWGLDNYLSVKQVTQYVSDEPWGWYQSPSKL

SEQ ID NO: 21851 - protein, 266 aa, Pseudomonas savastanoi
MTEPLTEPPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIARYPGAELEAKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 21852 - protein, 444 aa, Brassica rapa
MATITAVKARQIFDSRGNPTVEVDVHTSSGVKVTAAVPSGASTGIYEALELRDGGSDYLGKGVSKAVGNVNSIIGPASIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTAECGDNVQIVGDDLLVTNPKGVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 21853 - protein, 444 aa, Brassica napus
MATITVVKARQIFDSRGNPTVEVDVHTSSGVKVTAAVPSGASTGIYEALGLRDGGSDYLGKGASKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGLHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNSKEENNNGSQKISGDALKGLYKSFVSEYPIVSIEDPFDQDDWEHYAKMTAECGDNVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 21854 - protein, 439 aa, Arabidopsis thaliana
MVTLTPSSASTPKTSFDFMKNNNSHSSLYVSSSSYLSSKEDALVTTKKLMEPSKTLNMSINPKQEEFGDEKKMVKKAPEDPEIGVFGAEKYFNGDMDSDQGSSVLSLTNPEVERTVVDSKQSAKKSTGTPSVRSESSWNSQSVLLQNKLVNSCNSSFKEKKNSNGQIQKVTNNKKSFLANLGCKCACSDGDSVDVEEKTSVKRSADPNISVITMRSSADMNTELIKIQKQEELSQRKSLEVFGSPVAIEKKSSVVQKKLPLPPWKSRTEEDDTKSEGSDSSSDLFEIEGLTGNPKPFLTRQGSDPASPTCYAPSEVSVEWSIVTASAADFSVMSECATSPVRRNRPTQIPRIPITAKSAPQRRKSSSSSGGNGFLMSCKSHKSVMVSGDLDRRSSMNKTQPSYVPRFPMETTKPKSFETRRRISNSSISHTQSSLLYSQ

SEQ ID NO: 21855 - protein, 169 aa, Oryza sativa
MASSATTVAPFQGLKSTAGMPVARRSNSSFGNVSNGGRIRCMQVWPIEGIKKFETLSYLPPLTVEDLLKQIEYLLRSKWVPCLEFSKVGFVYRENHKSPGYYDGRYWTMWKLPMFGCTDATQVLKELEEAKKAYPDAFVRIIGFDNVRQVQLISFIAYKPPGCEESGGN

SEQ ID NO: 21856 - protein, 175 aa, Fusobacterium nucleatum subsp. vincentii ATCC 49256
MNEGVISGIGEINGLKVSIACMDFNFMGGSMGSVVGEKITAALERAIEHKIPAVVVAISGGARMQEGLTSLMQMAKTSAAVKKMRLAGLPFISVPVNPTTGGVTASFAMLGDIIISEPKARIGFAGPRVIEQTIRQKLPENFQKSEFLQECGMVDVIAKREDLKATIFKVLNDII

SEQ ID NO: 21857 - protein, 400 aa, Fusobacterium nucleatum subsp. vincentii ATCC 49256
MEEKMKISDRVKNMKYSAVRKLAPLAAEAEKKGIKVYRLNIGQPNIETPKLFFEGLKNIPDQVIKYADSRGISVLLEQVIEVYARDGHILKKEDIIVTEGGSEALTFAMLAICNPDDEVLIPEPFYSNYKSFLDISGAKIIPIPTDIKNNFALPKKEEIQKLITSKTKAILYSNPCNPTGKVYTEVEVKLLADLAIENDLFIIADEPYREFIYDDKDKHHSLLDIEKAKENVIIIDSVSKHYSACGARVGFLISKNKDFMTYIMKLCQARLAAPTVEQYAVANLMKAPKEYFKEIKEIYRRRRDIIVDSLNKIEGVTCSTPKGAIYAFAKLPVESSEDFCKWLLTEFVYDNSTVMLAPGEGFYETEGLGKNEVRFSFCVGEDDIEKAMKVLEEALKVYKK

SEQ ID NO: 21858 - protein, 397 aa, Fusobacterium nucleatum subsp. vincentii ATCC 49256
  misc_feature (386)..(386): Xaa can be any naturally occurring amino acid
MSIKEFLFEDKELIKRIFKIAIPSLFDLLAQTLIATSDMIMVSSIGASAISSVGVGSAAFNAIIPALIAVAIGTTAILSRAYGAKNKEEGQKALMQSYFIAIPIGIFLMLLFFFFAEPIIKIVGNAKDLNLKDAIAYQKTTAIGFIFLSIGITTFYAFRALGKNKIPMIGNTMVLVINIIFNYLFIYILKWGVFGAALATSIARGSVVIMCVYLIFISKKQWISLNIKKMKFDYFTAKRIIKVGIPAAIEQLALRFGMLIFEIMVISLGNLNYAAHKIALTAESFSFNLGFAVSLAATALVGQELGRNSPKNALKNGYICTIIGLIIMSSMGLLFFIAPNLLISLFTDDPQVISLSTMALRLVSICQPFLAISMILSGALRGASNXNLYIITSRFAL

SEQ ID NO: 21859 - protein, 406 aa, Fusobacterium nucleatum subsp. vincentii ATCC 49256
MFRNMAANKPAIISKVGIGTFVDPDLEGGKVNTITKEDIVNKINVFGEEVLFYKCPKLDYAILRGTSSDEDGNISFENEALLLEGIHIASATKNAGGKVIVQVEKVVKRGSISPKEVKIPGILVDYVVVVEDIKNHMQTFDEQYNYGYINNNALFSDSVISFPLDERKIIARRCAINLRKDSKVLNYGIGMPESIALVLKEENQNMNFIPTVEPGAVGGIPMGGLSFGASFNPACILEQPTQFDFYDGGGLDMAFLGLAQCDQYGNINVSKFGSKLAGCGGFINITQNAKEVVFCGTFTAGGLEIAIENGKLKIIKEGKTKKFIKNVEQITFSAELAKKNEKKVLYITERAVFELRKEGLTLVEIANGIDIEKDILNNMEFKPILAKEIKFMNKEIFLNKPMGLIF

SEQ ID NO: 21860 - protein, 412 aa, Fusobacterium nucleatum subsp. vincentii ATCC 49256
MPYKKYSSSNDKNSADEIKEFKKLISSLHKNGIEVILDVVYNHTAEGGSGGKVYNFKAMDENTFYIKNKNNIFVNFSGCGNTLNCNHKVVKDMIIQSLLYWYLETGVDGFRFDLASVLGRDSNGQWAKHSLLHELIEHPILSHAKLIAESWDLGGYFVGAMPSGWSEWNGAYRDTVRQFIRGDFNQVPELIKRIFGTVDIFHANKNGYQSSINFICCHDGFTMWDLVSYNLKHNLLNGENNQDGENNNHSYNHGEEGLTENPQILSLRKQQIKNMLLILYISQGIPMLLMGDEMGRTQLGNNNAYCQDNPTTWVDWDRKKDFEDVFLFTKNMINLRKSYSVFKKETPLIEGEEVILHGIKLYQPDLSYHSLSIAFQLKDIETDTDFYIAFNSYSEQLCLELPILENSLVSSN

SEQ ID NO: 21861 - protein, 430 aa, Fusobacterium nucleatum subsp. vincentii ATCC 49256
MAKGSVYYCSECGYKSAKWAGKCPQCGAWSSFEEVDELPKDVKKATSSISVANRNSDIKVYEFKDVEYTSEDRYKTKYEEFDRLLGGGLLKGEVVLVTGNPGIGKSTLLLQVANSYKNYGDILYISGEESPAQIKNRGERLKISGESIYIMAEMDILNIYEYVVSKKPKVVIVDSIQTLYNSSMDSISGTPTQIRECTLKIIEIAKKYNISFFIVGHITKDGKVAGPKLLEHMVDAVFNFEGDEGLYYRILRSVKNRFGSTNEIAVFSMEENGMKEIKNSSEYFLSEREEKNIGSMVVPILEGTKVFLLEVQSLITDSGIGIPKRVVQGYDRNRIQILTAIAEKKLYVPLGMKDLFVNVPGGLAIEDPAADLAVLMSILSVHKGFAISQKIAAIGELGLRGEIRKVFFLERRLKELEKLGFTGVYVPESK

SEQ ID NO: 21862 - protein, 177 aa, Fusobacterium nucleatum subsp. vincentii ATCC 49256
MKKLITDLDLNNKKVLMRVDFNVPMKDGKITDENRIIQALPTIKYALEHNAKLILFSHLGKVKTEEDKATKSLKAVAEKLSELLGKNVIFIPETRGEKLESAINNLKSGEVLMFENTRFEDLDGKKESKNDPELGKYWASLGDVFVNDAFGTAHRAHASNVGISENIGNGNSANWFS

SEQ ID NO: 21863 - protein, 171 aa, Fusobacterium nucleatum subsp. vincentii ATCC 49256
MFTFLKSQEGKNIGASLVEDDKLDLAKDLLEKSNRKIVLPVDTVVANEFKNDTEFSTVDIDNIPDNKMGLDIGEKTVKLFDSYIKTAKTVVWNGPMGVFEMPNFAKGTIGVCESIANLTDAVTIIGGGDSAAAAISLGYADKFTHISTGGGASLEFLEGKVLPGVEAISNK

SEQ ID NO: 21864 - protein, 475 aa, Fusobacterium nucleatum subsp. vincentii ATCC 49256
MSSLKKTKIVCTIGPVTESVETLKELLNRGMNVMRLNFSHGDYEEHGIRIKNFRQAMSETGIRGGLLLDTKGPEIRTMTLKDGKDVSIKAGQKFTFTTDQSVVGDNERVAVTYENFAKDLKVGNMVLVDDGLLELDVTEIKGNEVICVARNSGDLGQKKGINLPNVSVNLPALSEKDIEDLKFGCQNNVDFVAASFIRKADDVRQVRKVLKENGGERIQIISKIESQEGLDNFDEILAESDGIMVARGDLGVEIPVEEVPCAQKMMIKKCNRAGKVVITATQMLDSMIKNPRPTRAEANDVANAIFDGTDAIMLSGETAKGKYPLAAVEVMNKIAKKVDATIPAFYVDGVINKHDITSAVAEGSADISGRLNAKLIVVGTESGRAARDMRRYFPKANILAITNNEKTANQLVLSRGVISYVDASPKTLEEFFILAEVIAKKLNLVENNDIIIATCGESVFIQGTTNSIKVIQVKA

SEQ ID NO: 21865 - protein, 434 aa, Fusobacterium nucleatum subsp. vincentii ATCC 49256
MTGIVDVIGREILDSRGNPTVEVDVILECGVKGRAAVPSGASTGSHEAVELRDEDKTRYLGKGVLKAVNNVNTEIREALLGMDALNQVEIDRVMLELDGTANKGRLGANAILGVSLAVSKAAAEALGLPLYKYLGGVNAKELPLPMMNILNGGAHADSAVDLQEFMIQPVGAKSFREAMQMGAEVFHHLGKILKANGDSTNVGNEGGYAPSKIQGTEGALSLISEAVKAAGYELGKDITFALDAASSEFCEKVNGEYQYHFKREGGIIRNTDAMIKWYEELINKYPIVSIEDGLGEDDWDGWVKLTKAIGDRVQIVGDDLFVTNTERLKKGIELGAGNSILIKLNQIGSLTETLDAIEMAKRAGYTAVVSHRSGETEDATIADVAVATNAGQIKTGSTSRTDRMAKYNQLLRIEEELGSVAQYKGRDVFYNIKK

SEQ ID NO: 21866 - protein, 183 aa, Fusobacterium nucleatum subsp. vincentii ATCC 49256
MKIYDFSVKNRKDEDISLKSYKGKVLLIVNTATRCGFTPQYDELENLYEKYNKEGFEVLDFPCNQFGNQAPESDEEIHTFCQLNYKVKFDQFAKVEVNGENALPLFQYLKEQKGFSGFDPKHKLTSVLTEMLSKNDPDFAKKSDIKWNFTKFLVDKSGNVVARFEPTTSVKVIEQEIKKLLEK

SEQ ID NO: 21867 - protein, 240 aa, Fusobacterium nucleatum subsp. vincentii ATCC 49256
MIEFKNISKSYGNQEIIKDFNLTIECGTFLTIIGSSGSGKTTILKMINGLIKADKGEVLINDKNIQDEDLIELRRKIGYVIQGNILFPHLTVFENIAYVLNLKKYDKKEIEKIVNEKMDMLNLSRDLKDRLPDELSGGQQQRVGIARALAANPDIILMDEPFGAVDAITRYQLQKDLKELHKKTEATIVFITHDITEALKLGTKVLVLDKGKIQQHDIPKNICSNPKNEFVKQLLKMAEM

SEQ ID NO: 21868 - protein, 393 aa, Fusobacterium nucleatum subsp. vincentii ATCC 49256
MAKRDYYEVLGIDKNASEDDIKKAFKKAAMKYHPDRFANASDAEKKDAEEKFKEINEAYQVLSDAQKKQQYDQFGHAAFEQGGAGFGGGFNAGGFDFGDIFGDIFGGGGSFGGFEGFSGFGGSSRRSYVEPGNDLRYNLEITLEEAAKGVEKTIKYKRTGKCEYCHGTGGEDDKMKTCPTCNGQGTIKTQQRTILGVMQSQSVCPDCHGTGKVPEKKCKHCRGTGTAKETVEKKINVPAGIDDGQKLKYAGLGEASQSGGPNGDLYIVIRIKPHDIFIRQGDNLYCEVPISYSTAVLGGEVEVPTLNGKKTVKVPEGTESGKLLKVSGEGIKSLRGYGKGDIIVKLTIETPKKLTDKQKELLQKFEESLNDKNYEQKSSFMKKVKKFFKDIID

SEQ ID NO: 21869 - protein, 175 aa, Fusobacterium nucleatum subsp. vincentii ATCC 49256
MKYRIENLIDKEAVEKRIKELARQIEKDYAGEEIYCVGLLKGSVIFLSDLVKELNIPVIIDFMSVSSYGSETVSSGDVKILKDTDLDLRGKHVLIVEDIIDTGLTLEHVIKYFKEGKGVKSLRTCTLLSKPERRKVDVKVEYIGFDVPDKFVIGYGLDYNQKYRNLPYIAVVIPE

SEQ ID NO: 21870 - protein, 459 aa, Fusobacterium nucleatum subsp. vincentii ATCC 49256
MESNQKMKFWSIVLLTINSIIGTGIFLSPGAVAKLVGDKAAIIYLAAAVFAAVLAVTFAAASKYVVKSGAAYAYAKAGFGDEVGSYVGITRVVSASIAWGVMATGVVKTTLSIFGQDSSNMKNVTIGFITLMLILLIINLIGTKLLTIISNISTIGKMGALGITIIAGIFILIFSGGNHIEELNLLKDAEGNNLIPEFTTSVFVTALIGAFYAFTGFESVASGSADMEKPEKNLPRAIPLAIAIIAAIYFGIVFVSMYIDPVAMVTSKDPVVLASIFKNQLLQKIIVIGALMSMFGINVAASFHTPRVFEAMAKEKQVPEFFAKRTKGGLPLTSFILTAAIAVVIPLAFNYNMAGIIIISSISRFIQFIIVPLAVIVFFYGKSKEEVLNANKNFMIDVVIPIIALLLTILLLIKFNWVQQFSTKLDDGTTTINLKAVISMIIGYLILPIILRIYMRAKK

SEQ ID NO: 21871 - protein, 339 aa, Fusobacterium nucleatum subsp. vincentii ATCC 49256
MGGRSMEKTKIIFFDIKDYDKEFFKKYEKDYNFEMTFLKVRLTEETANLTKGYDVVCGFANDNINKETIDIMAKNGIKLLAMRCAGFNNVSLKDIHNRFKVVRVPAYSPHAIAEYTVGLILAVNRKIHKAYVRTREGNFSINGLMGFDLDGKTVGIIGTGKIGQILIKILKGFDMKVIAYDLFPNQKVADELGFEYVSLDELYAKSDIISLNCPLTKDTKYMINRRSMLKMKDGVILVNTGRGQLIDSADLVEALKDKKIGAVALDVYEEEENYFFEDKSNQVIEDDILGRLLSFYNVLITSHQAYFTKEAVDAITVTTLNNIRDFIEGKPLVNEVLQN

SEQ ID NO: 21872 - protein, 230 aa, Fusobacterium nucleatum subsp. vincentii ATCC 49256
MDNREVLLEVKNVSKIYGDLHALKEVNFQVRKGEWVAIMGSSGSGKSTIMNIIGCMDKPTMGEVILDGQDITKESQTSLTKIRREKIGLIFQQFHLIPYLTALENVMVAQYYHSIPDEQEALQALERVGLKDRAKHLPSQLSGGEQQRVCIARALINSPEIILADEPTGNLDEVNEKIVIDILTQLHKEGSTIIVVTHDLEVGDVAERKIILEYGKIVDVVDQKQYGKKK

SEQ ID NO: 21873 - protein, 488 aa, Fusobacterium nucleatum subsp. vincentii ATCC 49256
MMNGKIVKEGITFDDVLLIPAKSDVLPNEVSLKTRLTKKITLNLPILSAAMDTVTESDLAIALARQGGMGFIHKNMSIEEQAAEVDRVKRSESGMITNPITLNKDSRVYQAEELMSRYKISGLPVIEDDGKLIGIITNRDIKYRKDLDQPVGDIMTSKGLITAPVGTTLEQAKEILLANRIEKLPITDQNGYLKGLITIKDIDNIIQYPNACKDKLGKLRCGAAVGIAPDTIERVSALVKAGVDIITVDSAHGHSQGVINMIKEIKKNFPDLDVIGGNIVTAEAAKELIEAGVSAVKVGIGPGSICTTRVVAGVGVPQLTAVNDVYEYCKDKNIGVIADGGIKLSGDIVKALAAGGDCVMLGGLLAGTKEAPGEEIILEGRRFKIYVGMGSIAAMKRGSKDRYFQAEEKDNSKLVPEGIEGRIAYKGSVKDVIFQLAGGIRAGMGYCGTKTIKDLQINGKFVKITGAGLIESHPHDITITKEAPNYSK

SEQ ID NO: 21874 - protein, 312 aa, Fusobacterium nucleatum subsp. vincentii ATCC 49256
MIFKKNKELYIFFNEFFYFFSFSYTIKLKIKFNRRVFMLANSVIDLIGNTPLVKINNIDTFGNEIYVKLEGSNPGRSTKDRIALKMIEEAEKEGLIDKDTVIMEATSGNTGIGLAMICAVKNYKLKIVMPDTMSVERIQLMRAYGTEVILTDGSLGMKACLEKLEELKKKEKKYFIPDQFTNVNNPKAHYETTAEEILKDMNNKVDVFICGTGTGGSFSGTAKKLKERLPNIKTFPVEPASSPLLSKGYIGPHKIQGMGMSIGGIPAVYDGSLADNILVCEDDDAFKMMRELSFKEGILGGISTGATFQSCS

SEQ ID NO: 21875 - protein, 224 aa, Fusobacterium nucleatum subsp. vincentii ATCC 49256
MANYSTNSVSQLTMTLLLNELTRAERLSQEVKQNKWEEISNKMDRYYHVDTEGKVLGILGHGNIGKRVEQYAKSFGMEVMIAKIPGREYTDNLENRFELDEVLEKCDIFSIHAPLTDLTRDLINLDRMKKMKKSAIILNLGRGPIINEDDLYYALKNNIIASAATDVMTSEPPKSDCKLLELDNFTVTPHLAWKSLKSVERLFAAIENNLNLFLENKLVGLESK

SEQ ID NO: 21876 - protein, 435 aa, Fusobacterium nucleatum subsp. vincentii ATCC 49256
MSAASKAKRIDKNLGITVYEMTDAISWGACGLPYYVGDFFSDSSIMVARTYEEFQKEGINIKIKHKVENIDFKNKKVFVRNLNENKVFEDNYDELVIATGASSVSPKDIKNLDAEGVYHLKTFNEGLEVKKEMLKKENENIIIIGGGYIGIEIAEAASKLGKNVRIFQHTDRILNRTFDKEITDVLEEHIREHKKVSLHLNESPVEVRTFENKVIGLKTDKKEYAANLIVVATGVKPNTEFLKNTGIELFKNGAIIIDRFGKTNISNVYAAGDCATVYHSVLEKNVYIALATTANKLGRLIGENLTGANKKFMGTLGSAGIKVLEFEAGRTGITEQEAKDNNINYKSVFVKGKDHTAYYPDREDVYIKLIYNADTKILLGAQVAGKRGAALRADSLAVAIQNRMTVQELANMDFLYAPPFSTTWDIINVAANVAK

SEQ ID NO: 21877 - protein, 434 aa, Fusobacterium nucleatum subsp. vincentii ATCC 49256
MVFKNSIDLYKKAVELVPGGVNSPVRAFKSVNREAPIFVKKGQGAKIWDEDNNEYIDYICSWGPLILGHNHPKVIEEVKKIIENGSSYGLPTKYEVDLAELIVEIVPSVEKVRLTTSGTEATMSAVRLARAYTQRNKILKFEGCYHGHSDALLVKSGSGLLTEGYQDSNGITDGVLKDTLTLPFGDIEKVKEVLKSKDVACVIVEPIPANMGVIETHKRFLQELRKITEETGTILIFDEVISGFRLALGGAQEFFGITPDLTTLGKIIGGGYPVGAFGGKKEIMDLVAPVGRVYHAGTLSGNPIASKAGFATISYLKKNPNIYKELEEKTNYLIDNIEILAKKYSINVCVNSMGSLFTIFFIDIDKVENLKDSLKSNTKNFSIYFNTMLENGIVVPPSQFEAHFLSMAHTKKELNRTLEVIEMAFKKIGEKSGK

SEQ ID NO: 21878 - protein, 211 aa, Fusobacterium nucleatum subsp. vincentii ATCC 49256
MINLNLVLFGAPGAGKGTQAKFIVDKYGIPQISTGDILRVAVANKTKLGLEAKKFMDAGQLVPDEVVNGLVAERLAEKDCEKGFIMDGFPRTVVQAKALDEILTKLGKQIEKVIALNVPDKDIIERITGRRTSKVTGKIYHIKFNPPVDEKPEDLVQRADDTEEVVVKRLETYHNQTAPVLDYYKAQNKVTEIDGTKKLEDITKDIFKILG

SEQ ID NO: 21879 - protein, 337 aa, Fusobacterium nucleatum subsp. vincentii ATCC 49256
MMGQEKMKYLENLVGKTPMLELIFDYKGEERRIFVKNESYNLTGSIKDRMAFYILKKAYEKNEIKKGAAIVEATSGNTGIAFSAMGVILGHPVIIYMPDWMSEERKSLIRSFGAKIVLVSREEGGFLGSIEKTKEFAKNNPGTYLPSQFSNPYNSEAHYYGIGLEIVNEIKSLNLNIDGFVAGVGTGGTVMGIGKRIKENFPNVKICPLEPLNSPTLSTGYKVAKHRIEGISDEFIPDLVKLDKLDEVVSVDDGDAIIMAQKLAKCGLGVGISSGANFIGALMLQNKLGKDSVIVTVFPDDNKKYLSTDLMREEKIKEDFLSKDITLKGIKNVLRIF

SEQ ID NO: 21880 - protein, 251 aa, Fusobacterium nucleatum subsp. vincentii ATCC 49256
MRRLVIAGNWKMYKNNKEAVETLTQLKNLTKDIKNVDIVIGAPFTCLSDAVKTVEGSNVKIAAENVYPKIEGAYTGEISPKMLKDIGVTYVILGHSERREYFKESDEFINQKVKAVLEIGMKPILCIGEKLEERESGKTFEVLSKQIKGGLADLSKEEAGKVIIAYEPVWAIGTGKTATPEMAQETHKAVRNVLAEMFGKDIADKMIIQYGGSMKPENAKDLLSQEDIDGGLVGGASLKADSFFEIIKAGN

SEQ ID NO: 21881 - protein, 504 aa, Fusobacterium nucleatum subsp. vincentii ATCC 49256
MKKRALISVYDKIGILDFAKFLVSKGIEIISTGGTYKYLKENNIEVIEVSKITNFEEMLDGRVKTLHPNIHGGILALRDNEEHMRTLKERNIDTIDYVIVNLYPFFEKVKENLSFEEKIEFIDIGGPTMLRSAAKSFKDVVVISNVKDYELVKEEMNKSNDVSYETRKKLAGKVFNLTSAYDAAISQFLSDEDFPEYLNLSYKKSMEMRYGENSHQKAAYYIDNMSDGAMKDFKQLNGKELSYNNIRDMDLAWKVVSEFDEICCCAVKHSTPCGVALGNNVEEAYKKAYETDPVSIFGGIVAFNREVDEATAKLLNEIFLEIIIAPSFSKSALEILTKKKNIRLIECKNKPSDKKELIKVDGGILVQDTDNKLYEDLEVVTKIKPTSQEEKDLIFALKVVKFVKSNAIIVAKNLQTLGIGGGEVSRIWAAEKALERAKERFNVTDIVLSSDAFFPFKDVVELAAKNGVKAIIQPGGSVKDKDSIDKCDKNNISMIFSKLRHFKH

SEQ ID NO: 21882 - protein, 267 aa, Fusobacterium nucleatum subsp. vincentii ATCC 49256
MLITIILMSKKIDAAVFFGLLITAIVGIVLGKFGIEGMPKFSNEIIKANTSLNHFGDFFYGLKSLITKPKSIFLIFTFFFVDFFDTAGTLVAITNKITSKTGKNYKMKKMLFSDAVGTIVGAILGTSTVTTLTESTSGVAAGGRTGLTAITTGIWFLIASIFTPLVAIASPITVDGMSFEPVIAPSLICVGILMATQLSSIDWHDFTAASAGFVTIMIMIVGYSIPDGIAAGFIVYVFSKLFTKNIKDITPSVWAMFVLFVLHFALK

SEQ ID NO: 21883 - protein, 228 aa, Fusobacterium nucleatum subsp. vincentii ATCC 49256
MKLVLIRHGESAWNLENRFTGWKDVDLSPKGVEEAKAAGKSLKEMGLVFDVAYTSYLKRAIKTLNIVLEEMDELYIPVYKSWRLNERHYGALQGLNKAETAKKYGDEQVHIWRRSFDVAPPSIDKNSEYYPKSDRRYANLADSDIPLGESLKDTIARVLPYWHSDISKSLQEGKNVIVAAHGNSLRALIKYLLNISNEDILNLNLTTGKPLIFEMDKDLKVLKAPESF

SEQ ID NO: 21884 - protein, 373 aa, Fusobacterium nucleatum subsp. vincentii ATCC 49256
MVVIGIGGSYLGARAVIECLSHSFFNSLNKEKRNAPEIYFAGQNISGRYLKDLIEVIGNRDFSVNVISKSGTTTEPAIAFRVFKELLENKYGEKAKDRIYVTTDKNKGALKKLADEKGYEEFVIPDDVGGRFSVLTAVGLLPIAVAGINIDDLMNGAKTAREDYSKKFIDNDCYKYAAIRNILYKKNFNIEILANYEPRFHYISEWWKQLYGESEGKDKKGIFPASVDLTTDLHSMGQYIQDGRRNLFETILNVENSDKDIVIKKETEDLDGLNYLEGKGLSFVNNKAFEGTLLAHIDGGVPNLVINIPEVTAFNIGYLIYFFEKACAISGYLLEVNPFDQPGVESYKKNMFALLGKKGYEKLSKELNERLKK

SEQ ID NO: 21885 - protein, 215 aa, Fusobacterium nucleatum subsp. vincentii ATCC 49256
MTNGIKIAPSILSSDFSKLGEEVVAIDKAGADYVHIDVMDGQFVPNLTFGPPVIKCIRKCTELVFDVHLMIDKPERYIEDFVKAGADIVVVHAESTIHLHRVIQQIKSFGVKAGVSLNPSTPEEVLKYVINDIDMVLVMSVNPGFGGQKFIPAVVEKIKAIKKMRADIDIEVDGGITDETIKVCVDAGANIFVAGSYVFSGNYKERIDLLKIKAK

SEQ ID NO: 21886 - protein, 501 aa, Fusobacterium nucleatum subsp. vincentii ATCC 49256
MNNDIILTEFARVINSDRYQYTESDIFLMENMQNKIAVFDMFFRKTEDGGFAVVSGIQEVIHLIEVLNTTSEEEKRKYFSKILEEEHLINFLAKMKFTGDLYAIQDGEIVYPNEPIITIKAPLIEAKILETPILNIMNMNMAIATKASMVTRAADPVKVLAFGSRRAHGFDSAVEGNKAAIIGGCYGHSNLVTEYKYGIPSNGTMSHSYIQAFGVGAEAEKEAFVTFIKHRRQRKNNSLILLVDTYDTIHIGIENAIKAFKECGIDDSYEGVYGVRLDSGDLAYQSKKCRKRFDEEGFTKAKITLTNSLDEQLIRSLREQGACVDMYGVGDAIAVSKSYPCFGGVYKIVELDEVPLIKISGDVIKISNPGFKEVYRIFDKDGFAYADLISLVKNDNDKEKLLNHEELMIRDEKYEFKNSLLKKDEYTYKKLTKIYIKDGVIDKELHDELFDIMKSQKHYFDSLAKVSPERKRLENPHSYKVDLSSDLINLKYGLINKIKNV

SEQ ID NO: 21887 - protein, 217 aa, Fusobacterium nucleatum subsp. vincentii ATCC 49256
MKQKIVSMEEAISHIKDGMTVHIGGFIACGTPESIITALIEKGVKDLTIVANDTGLIDKGIGRLVVNNQVKKVIASHIGTNPETGRRMQSGEMEVELVPQGTLAERVRAGGYGLGGILTPTGLGTIVQEGKQIINVDGKDYLLEKPIRADVALIFGTKVDELGNVICEKTTKNFNPLMATAADVVIVEALEIVPAGSLSPEHLDISRIFIDYIVKSK

SEQ ID NO: 21888 - protein, 221 aa, Fusobacterium nucleatum subsp. vincentii ATCC 49256
MEMDKNLVREVIAKRVAQEFHDGYVVNLGIGLPTLVANYVGDMDVIFQSENGCIGVGPAPEKGKEDPYLVNAGAGFITAAKGAMFFDSAYSFGIIRGGHVDATVLGALEVDEKGNLANWMIPGKKVPGMGGAMDLVVGAKKVIVAMEHTSNGAIKILKECKLPLTAVGVVDLIITEKAVFEVTDKGLVLKEITPYSSLEDIKATTATDFALTDELKKQLNI

SEQ ID NO: 21889 - protein, 446 aa, Fusobacterium nucleatum subsp. vincentii ATCC 49256
MISNLSELQKKDLKYVFHPCAQMKDFEENPPLVITKGDGIYLIDENGNRYMDCISSWWVNLFGHCNKRINKVITEQVNTLEHVIFANFAHEPAAELCEELTKVLPKGINKFLFSDNGSSCIEMALKLSFQYHLQTGNPQKTKFISLENAYHGETIGALGVGDVDIFTETYRPLIKEGRKVRVPYINSKLSDEEFTKLEDECIKELEDLIKKKHNEIACMIVEPMVQGAAGIKIYSARFLKAARDLTKKYNIHLIDDEIAMGFGRTGKMFACEHAGIEPDMMCIAKGLSSGYYPIAMLCITTDIFNAFYADYKEGKSFLHSHTYSGNPLGCRIALEVLKIFKDDDVLRTINKKGTHLKNKMEEIFKDKSYIKDIRNIGLIGAIELKDNLLPNVRIGREIYNLALKKGIFVRPIANSVYFMPPYIITYEEINKMLQVCKESIEEILKI

SEQ ID NO: 21890 - protein, 438 aa, Fusobacterium nucleatum subsp. vincentii ATCC 49256
MICCRNHSPLIVGLGEHQNFIASDVSAILKYTRDIIYLEDGDVVLVTKDNVIVYDKDEKEVKREVKKVEWNFEQASKGGYAHFMIKEIEEQPEIIEKTLNVYTDKEKNVKFDEQLEGINFHDIDRIYIVACGTAYYAGLQGQYFMKELLGIDVFTDIASEFRYNDPVITNKTLAIFVSQSGETIDTLMSMKYAKEKGAKTLAISNVLGSTITREADNVIYTLAGPEISVASTKAYSSQVLVMYLLSLYMGAKLGKIEEKDYQKYISDISLLKENIVKLISEKEKIHNIAKKIKDVKNGFYLGRGIDEKVAREGSLKMKEINYIHTEALPAGELKHGSIALIEKGVLVVAISTNLEMDEKVVSNIKEVKARGAYVIGVCKEGSLVPEVVDDVIQVKDSGELLTPVLAVVGLQFLAYYTSLEKGFDVDKPRNLAKSVTVE

SEQ ID NO: 21891 - protein, 336 aa, Fusobacterium nucleatum subsp. vincentii ATCC 49256
MKVLFYGVREVEVPLFHELNKKFGYDLELIPDYLNSKETAEKAKRFECVVLRGNCFATKEVLDMYKSYGVKYLFTRTVGTNHIDVKYAKELGFKLAYVPFYSPNAIAELAVSLAMSLLRHLPYTAQKFNKRDFTVDKNMFSREVRNCTVGVVGLGRIGFTAAKLFKGLGANVIGYDMFPKTGIDEIVKQVSMEELIAKSDIITLHAPFIKENGKIVTKEFLSKMKENSILINTARGELMDLEAVVNALESGHLAAAGIDTIEGEVNYFFKNFSNDEAKFRLEYPLFNRLLDLYPRVLVTPHVGSYTDEAASNMIETSLENLKEYLDTGACKNDIKA

SEQ ID NO: 21892 - protein, 459 aa, Fusobacterium nucleatum subsp. vincentii ATCC 49256
MEKIYDLLVIGWGKAGKTLSAKLGAKEKKVAIIEENPKMYGGTCINVGCLPTKSLVHSAKILSEAKKYGIDGDYSFKNNFFKEAMKKKEEMTTKLRNKNFGILDTNENVDIYNGRASFISDNEVKVVSSDNKEIILKADKIVINTGSVSRTLNIEGIDNKNIMVSEGILELKELPKKLLIIGAGYIGLEFASYFANFGSEVSIFQFDDSFLVREDEDEAKIIKEILEKKDIKFFFKTSVKKFEDLGNSVKAICVQNGKEFIEEFDKVLIAVGRKPNTDNLGLKNTSIQLGKFGEILVDDYLKTDAPNVWAVGDVKGGPQFTYVSLDDFRIVFPQILGENNGRKLSDRILIPTSTFVDPPYSRVGINEKEAQRLGIKYTKKFALTNTIPKAHVINEIEGFTKILINENDEIIGASICHYESHEMINLLTLAINQKIKSKVLKDFIYTHPIFTESLNDILG

SEQ ID NO: 21893 - protein, 265 aa, Fusobacterium nucleatum subsp. vincentii ATCC 49256
MTTLDGQEFFAGDYNTKFTIQSISKIISLMLAILDNGEEYVFSKVGMEPSGDPFNSIRKLETSSRKKPYNPMINAGAIAVASMIKGKDDREKFLRLLDFAKLITEDDTLDLNYKIYIGESDTGFRNYSMAYFLKGEGIIEGNVNEALTVYFKQCSIEGTAKTISTLGKFLANDGVLSNGERILTTRMAKIIKTLMVTCGMYDSSGEFAVRVGIPSKSGVGGGICSVVPGKMGIGVYGPSLDKKGNSLAGGYLLADLSEKLSLNIF

SEQ ID NO: 21894 - protein, 204 aa, Fusobacterium nucleatum subsp. vincentii ATCC 49256
MQKPLKLGADIVVHSVTKYINGHGDVIAGLVVTNKELADQIRFVGLKDMTGAVLGPQDAYYIIRGMKTFEIRMERHCANAKKVVEFLNKHPKIEKVYYPGLETHPGYEIAKKQMKDFGAMISFELKGGFEAGKTLLNNLKLCSLAVSLGDTETLIQHPASMTHSPYTKEEREAAGITDGLVRLSVGLENVEDIIADLEQGLEKI

SEQ ID NO: 21895 - protein, 126 aa, Fusobacterium nucleatum subsp. vincentii ATCC 49256
  misc_feature (3)..(3): Xaa can be any naturally occurring amino acid
  misc_feature (7)..(8): Xaa can be any naturally occurring amino acid
MKXCRRXXYVWNIGYSGSNANAVEVLLDGLEKVEYRGYDSAGIAFVTDTGIQIEKKEGKLENLKNHMKNFEILSCTGIGHTRWATHGVPTDRNAHPHYSENKDVALIHNGIIENYAEIKKELLEQG

SEQ ID NO: 21896 - protein, 1743 aa, Streptomyces sp. FR-008
MVPVHAHDYVTDPPSTTGRTLDGLTLPRVFADAVHRGGDAVALVDGEYALTWSAWRTAVDALARGLQESGVVSGDVVALHLPNSWEYLTLHLAAASVGAVTMPVHQGNAPSDVRALLERVRPAAVVLPARTQEGGGPLTGTALREVLPELRAVLVTGDAAGEGTETVTEMLERWSGEDPLPVEVRPDSPFLLLPSSGTTSARPKICLHSHEGLLTNSRAATEDTADAYAGTLITACPLTHCFGLQSAYSALFRAGRQVLLSGWDVGRFLELARRERPSVVVAVPAQLHDLVTRVREDADGPGFRPGRILTAGAALPPALVRDVREALDTTLVVVWGMSEAGNGTSSLSADAPEVVSRSVGRPTRDAEMRVVDEDGAPCPPGQPGELYYRSPSMFRGYFGEPELTRSVVSEDGWLRTGDLASIGEDGLVTFHGRSAELINVGGRKFNAVEIQALLADLPDIGPLAVVAAPDPRLGEYPVLVVTERPAAAPADGTAPRPRGTVGLDEVTAHLRGLGTAEYKIPLELVALPELPRTPAGKINRRALEQYLADAAERTAVTPAEAPRPGLRTALELVVTAVAEVLAAVPGEDGARPAAAGPIGPDTTFRAHGLDSVASVRLRNALAEATGLTLPAGLAFDFPTPAALARELAGLSSPAAEESPGASAHEDEPVAIVSMACRLPGGATSPEALWELLRDGVDAVSGFPEDRGWDLDALFGDDPDAPGTSVAREGGFLRDAAHFDAGFFGMSAREALATDPQQRLLLETAWEAVERAGIAPRTLRGSRTGVFTGAMYHDYAAGASDPAGELESLLPVGTAGGALSGRIAYTLGLSGPALTVDTACSSSLVALHLACRSLRSGESDLALAGGVAVMATPAAFVGFSRLRGLSPDGRCKSFGEGADGAAWSEGAGLLMLERLSDARRNGHPVLAVIRGSAVNQDGASNGLTAPHGPAQRRVVRQALADAGVRAAEVDVVEAHGTGTALGDPIEAEALLDTYGRDRPEGRPLWLGSVKSNLGHTQAAAGAAAVIKMVLALRHDLLPATLHADTPTSRVDWSPGTVQLLTRARDWPREEGRPRRAGVSSFGISGTNAHLVLEEAPVPAAGTERSADAGAAGLRAAVPWLVSAKDADALRGQARRLAAHAAAHPEVSARDLAYSLLTTRALHPRTALLTGGDRDALVASADAFARGEAPGSIVRGPLGPAPGTAFVLTGQGSQRLGMGRGLAAAFPVFDDALREVCALLDPLLERPLTEVMWAAPDSDEAGLLGGTGYAQPALFAFEVALYRLLESWGIVPDRLVGHSVGEIAAAHVAGVLSLPDACALVAARGRLMQALPPGGAMAAVRCSEAEILPLLAGRTAGATVAAVNGPRSVVLSGTEEAVAEVVTEVSAAGHKTRRLMVSHAFHSPLMEPMLAEFRATVAGLSFAAPQVPLVSGVTGRPLTAEEARDPDHWVRHARDTVRFADAISHLAGEHTEIYVELGPEAALTPMVEECLGEPESGDGPAVEPVVRGDVDEERAALAAAVRLHALGLDVQWRAVLPEARAVPLPTYAFQHEAYWLATSGSVVAGLSLPGGRAADTVPDLAGRLAGLSGGEAEALVTELVRTELAAVTGGEISAAGAGTAFTELGVTSVTAVELRNRLTAVTGVRLPPTLIFDHPTPTAVARLIGETVRGSSVPGRRDAVSLVDELEALLVSGAEVDSDTAARLRSLAGRWAPSATGTAADANGPLDLDDASDEELFRLMDGGAP

SEQ ID NO: 21897 - protein, 472 aa, Oryza sativa (japonica cultivar-group)
GRLDMAKNAAAVESWTTSFYARSSAPARDGKAAVVVPGADSDDAPPGGGEVVEEDDGDIRLCEERLEREDGVPHDRDFDKDPVLVGGAAKDWNKCSVGCEFGFSATKTPDATFGIAPDPTVESILRSMESSQYYSENNIAVARGRGYKIVMTTSLSSDVPVGYFSWAEYDIMAPVPPKTEEALAAAFISNCGARNFRLQALEMLESLDVKIDSYGSCHRNHDGKVDKVETLKRYKFSLAFENSNEEDYVTEKFFQSLVTGAIPVVIGAPNIQEFSPGEGAILHIKELDDVPSIAKTMKHIASNQEAFNQSLRWKYDGPSDSFKALIDMAAVHSSCRLCIHVATKIHEKEERTPKFMNRPCSCSSKRGKVYHLFVRERGRFKTESIFLRSDQLTMGALESAVLAKFRSLNHVPVWKDERPPSIRGGDELKVYKIYPIGLTQRQALYQFRFRDDADLDKYIKDHPCAKLEVIFV

SEQ ID NO: 21898 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGIAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 21899 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINAAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 21900 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRITTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 21901 - protein, 379 aa, Oryza rufipogon
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLSEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 21902 - protein, 379 aa, Oryza meridionalis
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 21903 - protein, 379 aa, Oryza australiensis
MATAGKVIKCKAAVAWEAGKPLVIEEVEVAPPQAMEVRVKILFTSLCHTDVYFWEAKGQTPMFPRIFGHEAGGIVESVGEGVTDLAPGDHVLPVFTGECKECPHCKSPESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 21904 - protein, 321 aa, Capsicum annuum
MGSKYSKVTNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVMWKLEYALRLQESVI

SEQ ID NO: 21905 - protein, 314 aa, Capsicum annuum
MGSKYSKATNSINDALNSSYLVPFESYRFPLVDLEEATNNFDGKGGFGKVYRGVLRDGTKVALKRHNRDSGQSIEPFRTEIEILSRRSHPHLVSLIGFCDERNEMILIYDYMENGNLKSHLYGSDLPTMSWEQRLEICIGAARGLHYLHTSAVIHRDVKSTNILLDENFVAKITDFGISKKGTELDQTHVSTDVKGTFGYLDPEYFIKGRLTEKSDVYSFGVVLFEVLCARSAIVQSLPREMVNLAAWAVESHNNGQLEQIIDPNLAAKIRPESLGKFGETAVKCLAPSSEDRPSMGDVLWKLEYALRLQESVI

SEQ ID NO: 21906 - protein, 311 aa, Capsicum annuum
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGLSKTRPQLYQTTDVKGTFGYIDPEYFIKGRLTEKSDVYSFGVGLFEVLCARSAMVQSLPREMGNLAEWAVESHNNGQLEQIVDPNLADKIRPESLRKFGETAVKCLALSSEDRPSMGDVLWKLEYALRLQESVN

SEQ ID NO: 21907 - protein, 321 aa, Capsicum chinense
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDVKSINILLDENFVPKITDFGISKKGTELDQTHLSTVVKGTLGYIDPEYFIKGRLTEKSDVYSFGVVLFEVLCARSAIVQSLPREMVNLAEWAVESHNNGQLEQIIDPNLVAKIRPESLRKFGDTAVKCLALSSEDRPSMGDVLWKLEYALRLQESVI

SEQ ID NO: 21908 - protein, 321 aa, Capsicum chinense
MGSKYSKATNSINDALSSSYLVPFESYRVPLVDLEEATNNFDHKFLIGHGVFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTNGVMHRDVKSSNILLDENFVPKITDFGISKKGTELDQTHLTTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDALWKLEYALRLQESVI

SEQ ID NO: 21909 - protein, 311 aa, Capsicum chinense
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGLSKTRPQLYQTTDVKGTFGYIDPEYFIKGRLTEKSDVYSFGVVLFEVLCARSAMVQSLPREMVNLAEWAVESHNNGQLEQIVDPNLADKIRPESLRKFGETAVKCLALSSEDRPSMGDALWKLECALRLQESVI

SEQ ID NO: 21910 - protein, 316 aa, Capsicum chinense
MGSKYSKATNSISDASNSFESYRFPLEDLEEATNNFDDKFFIGEGAFGKVYKGVLRDGAKVALKRRTPESSQGIEEFETEIETLSFCRHPHLVSLIGFCDERNEMILIYKYMENGNLKRHLYGSDLPTMSMSWEQRLEICIGAARGLHYLHTRAIIHRDIKSINILLDENFVPKITDFGISKKGTELDQTHLSTVVKGTLGYIDPEYFIKGRLTEKFDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 21911 - protein, 314 aa, Capsicum chinense
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGISKKGTELDQTHLGTVVKGTLGYIDPEYFIKGRLTEKSDVYSFGVVLFEVLCARSAIVQSLPREMVNLAEWAVESHNNGQLEQIVDPNLADKIRPESLRKFGDTAVKCLALSSEDRPSMGDVLWKLEYALRLQESVI

SEQ ID NO: 21912 - protein, 316 aa, Capsicum chinense
MGSKYSKATNSINDALNSSYLVPFESYRFPLVDLEEATNNFDSKGGFGKVYRGVLRDGTKVALKRHNRDSGQSIELFRTEFEILSRRSHPHLVSLIGFCDERNEMILIYKYMENGNLKRHLYGSDLPTMSMSWEQRLEICIGAARGLHYLHTNGVMHRDVKSSNILLDENFVPKITDFGISKKGTELDQTHLSTVVKGTLGYIDPEYFIKGRLTEKSDVYSFGVVLFEVLCARSAIVQSLPREMVDLAEWAVESHNNGQLEQIVDPNLADKIRPESLRKFGDTAVKCLALSSEDRPSMGDALWKLEYALRLQESVI

SEQ ID NO: 21913 - protein, 359 aa, Capsicum chinense
  misc_feature (288)..(288): Xaa can be any naturally occurring amino acid
NMSYRVPFAALLEATSNFDESLVIGIGGFGKVYKGVLYDGTKLAVKRGNPKSQQGLAEFRTEIEMLSQFRHRHLVSLMGYCDEKNEMILVYEYMENGTLKSHLYGSDLPSMSWKQRLEICIGSARGLHYLHTGYAKAVIHRDVKSANILLDESFMAKVADFGLSKTGPELDQTHVSTAVKGSFGYLDPEYFRRQQLTEKSDVYSFGVVLFEVLCARPVIDPSLPREMVNLAEWAMKWQKKGQLEQIIDPTLVGKIRPDSLRKFGETAEKCLADFGVDRPSMGDVLWNXEYALQLQEAVIQDDPEENSTLLIGELSPQVNDFSQVDAGASAALIGTPNLDDLSGVSMSRVFSQLVKSEGR

SEQ ID NO: 21914 - protein, 314 aa, Capsicum chinense
MGSKYSKATNSINDALNSSYLVPFESYRFPLVDLEEATNNFDGKGGFGKVYRGVLRDGTKVALKRHNRDSGQSIEPFRTEFEILSRRSHPHLVSLIGFCDERNEMILIYDYMENGNLKSHLYGSDLPTMSWEQRLEICIGAARGLHYLHTSAAIHRDVKSTNILLDENFVAKITDFGISKKGTDLDHTHVSTHVKGAFGYLDPEYFIKGRLTEKSDVYSFGVVLFEVLCARSAIVQSLPREMVNLAAWAVESHNNGQLEQIIDPNLVAKIRPESLGKFGETAVKCLAPSSEDRPSMGDVLWKLEYALRLQESVI

SEQ ID NO: 21915 - protein, 347 aa, Sulfolobus solfataricus
MRAVRLVEIGKPLSLQEIGVPKPKGPQVLIKVEAAGVCHSDVHMRQGRFGNLRIVEDLGVKLPVTLGHEIAGKIEEVGDEVVGYSKGDLVAVNPWQGEGNCYYCRIGEEHLCDSPRWLGINFDGAYAEYVIVPHYKYMYKLRRLNAVEAAPLTCSGITTYRAVRKASLDPTKTLLVVGAGGGLGTMAVQIAKAVSGATIIGVDVREEAVEAAKRAGADYVINASMQDPLAEIRRITESKGVDAVIDLNYSEKTLSVYPKALAKQGKYVMVGLFGADLHYHAPLITLSEIQFVGSLVGNQSDFLGIMRLAEAGKVKPMITKTMKLEEANEAIDNLENFKAIGRQVLIP

SEQ ID NO: 21916 - protein, 451 aa, Escherichia coli
GSIFKPAPHKARLPAAEIDPTYRRLRWQIFLGIFFGYAAYYLVRKNFALAMPYLVEQGFSRGDLGFALSGISIAYGFSKFIMGSVSDRSNPRVFLPAGLILAAAVMLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQIFMQYVLPNKLLWYIAIANVFVYLLRYGILDWSPTYLKEVKHFALDKSSWAYFLYEYAGIPGTLLCGWMSDKVFRGNRGATGVFFMTLVTIATIVYWMNPAGNPTVDMICMIVIGFLIYGPVMLIGLHALELAPKKAAGTAAGFTGLFGYLGGSVAASAIVGYTVDFFGWDGGFMVMIGGSILAVILLIVVMIGEKRRHEQLLQELVPR

SEQ ID NO: 21917 - protein, 183 aa, Mycobacterium tuberculosis
MSYYHHHHHHDYDIPTTGNLYFQGAMVAISFRPTADLVDDIGPDVRSCDLQFRQFGGRSQFAGPISTVRCFQDNALLKSVLSQPSAGGVLVIDGAGSLHTALVGDVIAELARSTGWTGLIVHGAVRDAAALRGIDIGIKALGTNPRKSTKTGAGERDVEITLGGVTFVPGDIAYSDDDGIIVV

SEQ ID NO: 21918 - protein, 302 aa, Thermus thermophilus
  misc_feature (1)..(1): Xaa can be any naturally occurring amino acid
  misc_feature (44)..(44): Xaa can be any naturally occurring amino acid
  misc_feature (61)..(61): Xaa can be any naturally occurring amino acid
  misc_feature (149)..(149): Xaa can be any naturally occurring amino acid
  misc_feature (233)..(233): Xaa can be any naturally occurring amino acid
XKAWVLKRLGGPLELVDLPEPEAEEGEVVLRVEAVGLNFADHLXRLGAYLTRLHPPFIPGXEVVGVVEGRRYAALVPQGGLAERVAVPKGALLPLPEGLSPEEAAAFPVSFLTAYLALKRAQARPGEKVLVQAAAGALGTAAVQVARAXGLRVLAAASRPEKLALPLALGAEEAATYAEVPERAKAWGGLDLVLEVRGKEVEESLGLLAHGGRLVYIGAAEGEVAPIPPLRLXRRNLAVLGFWLTPLLREGALVEEALGFLLPRLGRELRPVVGPVFPFAEAEAAFRALLDRGHTGKVVVRL

SEQ ID NO: 21919 - protein, 322 aa, Arabidopsis thaliana
MNGGGKLVCVTGASGYIASWIVKLLLLRGYTVKATVRDLTDRKKTEHLLALDGAKERLKLFKADLLEESSFEQAIEGCDAVFHTASPVFFTVKDPQTELIDPALKGTMNVLNTCKETPSVRRVILTSSTAAVLFRQPPVEASDVVDETFFSDPSLCRETKNWYPLSKILAENAAWEFAKDNGIDMVVLNPGFIFGPLLQPTLNFSVELIVDFINGKNPFNSRFYRFVDVRDVALAHIKALETPSANGRYIIDGPIMSVSDIIDILRELLPDLCIADTNEESVMNEMLCKVCVEKVKNLGVEFTPMKSSLRDTIVSLKEKCLL

SEQ ID NO: 21920 - protein, 322 aa, Arabidopsis thaliana
MNCGGKVVCVTGASGYIASWIVKLLLLRGYTVNATVRDPKDKKKTEHLLALDGAKERLKLFKADLLEESSFDQAIDGCDAVFHTASPVLFTVTDPQTELIDPALKGTINVLNTCKQVSSVKRVILTSSTAAVLSRQPPIGPNDLVDETFFSDPSLCRETKNWYSLSKILAENAAWQFAKDNGIDMVVLNPGFICGPLLQPTLNMSVELIVDFINGKNPFNKRYYRFSDVRDVALVHIKALETPSANGRYIIDGPNMSVNDIIDILRKLFPDLSIADTNEESEMNEMICQVCVEKVKNLGVEFTPMKSSLRDTIVSLKEKCLL

SEQ ID NO: 21921 - protein, 325 aa, Arabidopsis thaliana
MADGGKVVCVTGASGYIASWIVKLLLFRGYTINATVRDPKDRKKTDHLLALDGAKERLKLFKADLLDEGSFELAIDGCETVFHTASPVAITVKTDPQVELINPAVNGTINVLRTCTKVSSVKRVILTSSMAAVLAPETKLGPNDVVDETFFTNPSFAEERKQWYVLSKTLAEDAAWRFAKDNEIDLIVLNPGLVTGPILQPTLNFSVAVIVELMKGKNPFNTTHHRFVDVRDVALAHVKALETPSANGRYIIDGPVVTIKDIENVLREFFPDLCIADRNEDITELNSVTFNVCLDKVKSLGIIEFTPTETSLRDTVLSLKEKCLV

SEQ ID NO: 21922 - protein, 325 aa, Arabidopsis thaliana
MADGGKMVCVTGASGYVASWIVKLLLLRGYTVRATVRDPSDEKKTEHLLALDGAKEKLKLFKADLLEEGSFEQAIEGCDAVFHTASPVSLTVTDPQGLQIELIDPAVKGTLNVLKTCAKVSSVKRVIVTSSMAAVLFREPTLGPNDLVDESCFSDPNFCTEKKLWYALSKTLAEDEAWRFAKEKGLDLVVINPGLVLGPLLKPSLTFSVNVIVELITGKDNFINKDFRLVDVRDVALAHIKAFETPSANGRYIIEGPVVTINDIEKILREFFPDLNLGNKGEASEIIPVIYKLCVEKVKSLGIEFTPTEATLRDTILSLKEKCLV

SEQ ID NO: 21923 - protein, 424 aa, Spiroplasma kunkelii
MIKVDFTNALAESVFNKYLGRVKDIHQMIHNKTGLGNDFLGWVEWPNNYDQAEFAKMKQTANKLASEINVLLVIGIGGSYLGARAAIEMINGLYSQQKVEIIYIGNTMSSTYTVQVLKYLQDKKFGICVVSKSGTTTESAIAFRLCKELLEKKEGSLKAANLIVAITDKEKGALKILSDKAGYQTFVIPDDIGGRYSVLTPVGIFAMLVSGINVDNVFKGAQQAYQDTLNDDFTNHAYKYAVGRYILNQEEKYKAEMLVTYELQMQMITEWWKQLFGESEGKKSKGLLPLSCVFSTDLHSFGQFIQEGTKNILFETVIAIKEPQIDLNLPKAAVDTDGLNYLAGRTLHEVNTIAVESVVAAHAKVGHVPNIVLEFATMDDKMFGYLAYWFMKACAMSAYLLEINPFDQSGVEIYKQNMFNLLGK

SEQ ID NO: 21924 - protein, 212 aa, Spiroplasma kunkelii
MRNFILLGAPGSGKGTQSDHLVKKFGFTHISTGNIIRDNTKQNTSLGILCQQYADQGKLVPDDIMIQMVENHLQTVTGDLIWDGFPRTIAQAKKLDQLLQKLNSKVDHTLYFEIDEAKLIERITERLTCSTCGRTYHKTALPPKVSWVCDDDQTPLVQRKDDNEEKIKIRLAAYHADTAPLIEYYLNQQVLTVIDADMEGNAVWDQIMAVLK

SEQ ID NO: 21925 - protein, 174 aa, Spiroplasma kunkelii
MQIDKLELYLPEDKIQNKIKDYAEKLNKLYEGKTLYCIGLLNGALFFMSDLLKQLKIQIVIDTMSISSYIGTHSTNKLTIHKNISKDITGQDVLLIEDLIDTGKTLSAVIEQIQAKKPNSLQVVCLADKIAMHPNFNYPYDALFIVPNEFIVGYGFDYNDQFRQLPNVYIWRGE

SEQ ID NO: 21926 - protein, 452 aa, Spiroplasma kunkelii
MKIIVVGTNHAGTTAVRTLRRLDPKVEIVTYDKNNNISFLGCGIALWVSGEVKDPNGLFYASPEVLKNEGIKVNMEHEVLSIDNKNQKIRVKNLKSGNEFDDNYDKLILAIGSWPIIPQIEGIKQEGVHIVKWFQHGELVKKANDDKNIQNVVVCGAGYIGVELVYAFHQKGKNVTLVDISERIMQRYYDKPFTDKVEGAMRKAVVNLRGGEKVIKFEGNNNKVTKVVTDKGSYDADLVIWSVGFKPATEILNGVIDLDKNAAIKVDQYMQTSDPNIFAIGDCVEVYDNAKKQAAYIALATNAVRTGVIAAINALKPAGLASPGFQGSNAINVFGWALASTGMTETVAKDLGFDYDQITFMDNDRPEFMDTYQEVLIKILWDKKTRKIIGAQIASEANHTEVMYMFSLAIMKEVTIDELPLIDIFFLPHFNKPYNFITLTGLEVLGLNYFKK

SEQ ID NO: 21927 - protein, 428 aa, Sulfolobus acidocaldarius
MEKIRWVIEESEKYLANTTRDPESQPLVIDRGEGVWVYDIEGNKYLDFTSGIGVNNLGWPSHPDVIKVAQIQMTRLAHAPANDFYNIPQMELAKRLVQLSPGNFSKKVFFSNSGTESVEASIKLVKGTGRKYLIAFLGSFHGRTLGSLALTASKPVQRYSAGPFSIGVFHVPYPNPFRNPWKINGYEKPDELINAVIEYIDFWLFQHVVDPEEVAGIIFEPIQGEGGYVVPPHNFFAELRKLAQKYNIPLIDDEVQMGLGRTGKMFAIEHFNIEPDIITLAKALGGGLVPVGATIFRSDLDFKKKGIHSNTFGGNALSMSIGLKVVELIKELMPHVNEIGKIFGEELCQMKVDDCRGLGLAWGIEFVKSDKTPDPKVRDRVVTEAFKEGLIVISAGKSSIRIIPPLVISEEAKIGLSKLKTAINRVRG

SEQ ID NO: 21928 - protein, 388 aa, Daucus carota
MSSLYLILIFFLLNSSTSSAMITYNILRFGAKSGGQSDSSKALLKAWGAACATTKPATIYVPPGRFLLKNVYFYGEHCRNGAITIRVDGTLVAPSDYNVLGSSGNWIKFERVTGVSIYGGTLDGQGTSLWACKTSGKKCPEGITSLAFYNSNKIIISGLASLNSQMFHVVIDGCHNVKLDGIRVSASGKSPNTDGIHLQSSSGVTVLSSHISTGDDCISMGPGNSNVWIENIACGPGHGISIGSLGWELQEPGVQNVTVKSVTFTGTENGVRIKTWARPTKGFVKDVLFQHIQMVDVQNPVIIDQNYCPGEKNCPHQVSDIKISGVTYQDIHGTSATEVGVKLECSKASPCGVKLEDVELTYKSKPVEAVCTNVGGKLLASSDNQRCL

SEQ ID NO: 21929 - protein, 248 aa, Kluyveromyces marxianus
MARTFFIGGNFKMNGTKASIKEIVERLNSASIPSNVEVVIAPPAAYLDHAVSLNKKAQVSVAAQNAYLKASGAFTGENSVEQIKDVGAEWVILGHSERRTYFHETDEFIADKTKFALDSGVKVILCIGETLEEKQKGITLEVVQRQLQAVLDKVQDWTNVVVAYEPVWAIGTGLAATSDDAQAIHHSIREFLAKKLSKDTAEKIRILYGGSANGKNAVTFKDKADVDGFLVGGASLKPEFVDIINSRV

SEQ ID NO: 21930 - protein, 453 aa, Pseudomonas stutzeri
MSILNDYKRKTEGSVFWAQRARSVMPDGVTADTRVFDPHGLFISDAQGVHKTDVDGNVYLDFFGGHGALVLGHGHPRVNAAIAEALSHGVQYAASHPLEVRWAERIVAAFPSIRKLRFTGSGTETTLLALRVARAFTGRRMILRIATHYHGWHDFSASGYNSHFDGQPAPGVLPEIAKNTLLIRPDDIEGMREVFAQHGSDIAAFIAEPVGSHFGVTPVSDSFLREGAELARQYGALFILDEVISGFRVGNHGMQALLDVQPDLTCLAKASAGGLPGGILGGREDVMGVLSRGSDRKVLHQGTFTGNPITAAAAIAAIDTILEDDVCAKINDLGQFAREAMNHLFARKGLNWLAYGRFSGFHLMPGLPPNTTDTGSITRAEVARPDVKMIAAMRMALILEGVDIGGRGSVFLSAQHEREHVEHLVTTFDRVLDRLADENLLSWQPTNLSGNQS

SEQ ID NO: 21931 - protein, 178 aa, Prunus avium
MASAEIEFRCFVGGLAWATDNDALERAFSPFGEIIESKIINDRETGRSRGFGFVTFSNEKAMRDAIEGMNGQNLDGRNITVNEAQSRGSGGGGGGNGGGYSRGGGGGGYGGGGGYGGGGRREGGGGGYSRGGGGGGYGSGGGGYGGGGRREGGYGGGEGGGARYSRGSGGSEGGSWRS

SEQ ID NO: 21932 - protein, 314 aa, Medicago truncatula
MPLPPINDLTCIVTGSTSGIGLEIARQLAESGAHVVMAVRNTKRANDLIQKWQIESDGLGLGMALNVEVMEVDLLSLDSVARFAEAWNARATPLHALINNAGIFSIGEPQKFSKDGYEDHLQVNHLAPALLSILLLPSLIRGSPSRIVNVNSIMHHVGFVDTEDMNLTSGKRKFSSLVGYSSSKLAQVMFSSVLFKRLPAEAGISVLCVSPGIVQTNVARDLPKSVQTGYHLIPYFIFNAQEGSRSTLFAATDPQVSEYCELLKSDEWPVCPYISHDCRPANASEEAHNLQTSHEVWEKTLEMIGLLRMPWRSF

SEQ ID NO: 21933 - protein, 399 aa, Oryza sativa (japonica cultivar-group)
MQICLFCTADQLYFMSEDRCYHDHCHKEYFIVLVVVSGFILLTTLAVVVWLLVYRRSKRRRRSREGSSTSATALVPPLWKVFTSEELRSITKNFSEGNRLPGNAKTGGTYSGILPDGSRVAIKRLKRSSLQRKKDFYSEIGRVAKLYHPNLVAVKGCCYDHGDRFIVYEFVANGPLDVWLHHVPRGGRCLDWPMRMRVATTLAQGIAFLHDKVKPQVVHRDIRASNVLLDEEFGSHLMGVGLSKFVPWEVMHERTVKAATYGYLAPEFIYRNELTTKSDVYSFGVLLLEIISGRRPTQSVESVGWQTIFEWATPLVQSHRYLELLDPLIQELPDVGVIQKVVDLVYACTQHVPSVRPRMSHVVHQLQQLELKSAASEQLSGTSTSATSPMLPLEVRTPR

SEQ ID NO: 21934 - protein, 495 aa, Oryza sativa (japonica cultivar-group)
MGRNHLCLVTCLWILSCAVLLHASPDGLLRISLNKKRLDKKTLDGAKLAREESHRLRADGLGDDIVPLDNYLDTQYFGEIGIGTPPQNFTVIFDTGSSNLWVPSVKCYFSIACYLHHRYKSKGSSSYKKNGESCSISYGSGSIAGFFSEDSVLVGDLAVKNQMFIETTREPSLTFIIGKFDGILGLGFPEISVGGAPPIWQGMKEQQLIEKDVFSFWLNRDPDAPTGGELIFGGVDPNHYKGSHTYVPVTRKGYWQFEMGDLLIDDYSTGFCSGGCAAIADSGTSLLGGPTTIVAQINHAIGAEGIVSMECKQVVRDYGDMILEMLIAQASPMKLCSQIGLCAFDGTRSVRNNIESVVDKEKVGSDLSCTACEMAVVWIQNQLRHNQTRELILQYADQLCERLPSPNGESAVDCDEISNMPNLSFTIANKTFTLTPEQYVVKLEQQGQTVCISGFMAFDVPPPRGPLWILGDVFMAAYHTVFDFGKNRIGFAESA

SEQ ID NO: 21935 - protein, 253 aa, Oryza sativa (japonica cultivar-group)
MAGAKDVILDEPLLTSGSAESSQQRSTDADTKSRVEDIWKKMNSGMPAKMPKPVMNKLSTPAKEKKSTTGNNWMSVLGLSPSKASTNDQGSKNGQKQAQQETSEDAKKLAASALAAVRDAASAAAGRGKVEITEVRDFAGKDIEIKKLVDADSTEAIEKAKAAGAAPSALDHILEQIKKKQKLSVLDKTKKDWGEFKEENKGMEEELDQYKKSSNKYLDKVSFLQRADYREFERERDARLSMMSKRKSDTRED

SEQ ID NO: 21936 - protein, 503 aa, Oryza sativa (japonica cultivar-group)
MALAILARRRAAEALLRRPLGAAGVSALRASYAAVAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLASPSEVSVDLSDGGSTVVKGKNIIIATGSDVKSLPGVTIDEKKIVSSTGALCLSEIPKKLVVIGAGYIGLEMGSVWNRLGSEVTVVEFAPDIVPSMDGEVRKQFQRMLEKQKMKFMLKTKVVGVDTSGDGVKLTLEPAAGGEQSVIEADIVLVSAGRVPYTAGIGLESVGVETDKAGRILVDKRFMTNVNGVYAIGDAIPGPMLAHKAEEDGVACVEFIAGKEGHVDYDTVPGVVYTHPEVASVGKTEEQVKALGIPYRVGKFPLLANSRAKAIDDAEGLVKVVAEKETDKILGVHIMAPGAGEIIHEAVLALQYGASSEDIARTCHAHPTVSEALKEACLQTFTKAIHI

SEQ ID NO: 21937 - protein, 420 aa, Oryza sativa (japonica cultivar-group)
MTKDEDFKLVKIQTHVLRVNIHCDGCKHKVKKLLQKIEGVYSVALDVDNHKVTVTGNVDSDTLIRKLTRGGKHAELWSQQKGGSNQGHKGSNNQQKQQQQQGQQQHGQQHQKQGANPSKDGNKNNNILKDQGKQGGVGGLIQGLKAFKNQHSKNQLPELDSEDDDLYDDEDDEFDDDYEDDLRFLGDKMSQLGFLRQQAAAAAAANVKNKNANTATVNNHHNNVNGKKGGGGGGSAGGGNHHQNNHHQNQKNPNVINMAAANAKMANGAQKNTGAINGMMGLNHGLGTAGATPGFQGYTGFNHPSYASAGYGGLQQQHLQQQQQSNNLMASMQGYHHHPAATAAMMNNLRGLNNNMMMMHQPQQQPQMMYHRSPQISPYTAYYNPYSYYYHPGAAGYHPASNGDVETMFSDENTKGCVVM

SEQ ID NO: 21938 - protein, 337 aa, Oryza sativa (japonica cultivar-group)
MPEYCVTGGTGFIASHLIRALLAASHTVRATVRDPEDEAKVGFLWELDGASERLQLVKADLMVEGSFDDAVRGVDGVFHAASPVVVVGNSSSNNGKPNDDDDEEEVQQRLVEPIVRGASNVLRSCARASPRPRRVVFTSSCSCVRYGAGAAAALNESHWSDAAYCAAHGLWYAYAKTLAEREAWRLAKERGLDMVAVNPSFVVGPILSQAPTSTALIVLALLRGELPRYPNTTVGFVHVDDAVLAHVVAMEDARASGRLICSCHVAHWSEIVGSLRERYPGYPIPAECGSHKGDDRAHKMDTAKIRALGFPPFLSVQQMFDDCIKSFQDKGLLPPHA

SEQ ID NO: 21939 - protein, 238 aa, Oryza sativa (japonica cultivar-group)
MAGGGGEYLRQFVEETAWYNEIFLSHVVPGDWWRALPHPLQSWLRNGLGGYLIYFACGFLWCFVIYYWKRHAYIPKDSIPTIEAMKKQIIVASKAMPLYCALPTLSEYMVENGWTQCYVNISEVGWPMYLVYLALYLIFVEFGIYWMHRELHDIKPLYKYLHTYHHIYNKENTLSPFAEAVWTTNIHDCIHGKVWPVMGAGYHTIHHTTYRHNYGHYTVWMDWMFGTLREPEDILKKD

SEQ ID NO: 21940 - protein, 306 aa, Oryza sativa (japonica cultivar-group)
MPRYDDRDRYDDRYGGNTRLYVGRLSSRTRTRDLEDLFGRYGSHPHGFLMLCLSMQEEFSDARDADEARYNLDGRDFDGSRMIVEFAKGVPRGPGGSREYMGRGPPPGSGRCFNCGIDGHWARDCKAGDWKNRCYRRGRSYSRSPSPRRGRSRGRSYSRSRSRSYSRSQSPRRDSRNERRSRSPRDSRSPRGSPRDSRSPRGSPRDSRSPKGSPRDTQSPRGSPRDSRSPRRSASPPNGRNRSPTPNASRSPAPRDSRSPMRADSRSPADHERRDMSTAANGRSPSPRDYEDNGNHRASPRGSASP

SEQ ID NO: 21941 - protein, 119 aa, Oryza sativa (japonica cultivar-group)
MHDFCFTIPYGFAVLAGGVLGYARRGSTASLAGGAGAGALLLLAGFVSLKTFEKRRNSYLALALETLCALALTYVMGQRYLETSKIMPAGVVAGLSALMSAFYLFKIATGGNHIPPKKE

SEQ ID NO: 21942 - protein, 512 aa, Oryza sativa (japonica cultivar-group)
MEVSLPLLIGVVLAFLLLFVLVNIKNSCRSWWPPPEKEKKKLRLPPGPWQLPLVGSLHHVLLSRHADLPHRALRELAGKYGPLMMLRFGAVPTLVVSSAEAAREVLKTYDAAFASRYLTPTLAVLSRGGRDILFSPYCDLWRQLRRICVHELLSARRVQSLRHGREDEAARLVRSVAAECAARGGAAVVNVGELISRAVNDSVVRSAVGARSARRDEFVRELDESVRLSGGFNLADLYPSSWLARRLSGAMRETERCNRSLMAIMDDIIREHGDGEEDLLGVLLRLQRNGDVQCPLTTDLITNVVLDMFAAGSETSSTTLEWALTELVRNPHIMEKAQSEVREIFRGENKLTEEMMDKLSYLRLVIRETLRLHLPVPFLLPRQCREPCSVMGYDIPVGTKVLVNAWAIARDNQYWDDPEVFKPERFENNRVDFKGIDFEFIPFGAGRRICPGIALGLANIELMLASLLYHFDWEFLDRDRNDEIDLSETFGITAKRKSKLMVYATQRIPCLG

SEQ ID NO: 21943 - protein, 170 aa, Oryza sativa (japonica cultivar-group)
MSVLLPLSLLSLFLSPSSPLAGGRAWAAPATRVLIGASVTVAFLLLLVFFFIILPRGGTPPEVVSSSKEGGIRGRRDGGGVFQVESYGERCEHVAEEDGHDRRRFPRDYVDYLYLFDCVFGVERRVLGYGVMAAWLAVLFYLLGDTAAVYFCSSLKGLSWLLRLSRRSPA

SEQ ID NO: 21944 - protein, 218 aa, Oryza sativa (japonica cultivar-group)
MAPRVSLLAAGAVAVAVVLLLAAPARASNDEGDALYALRTRLSDPNGVLQSWDPTLVNPCTWFHVTCDHASRVVRLDLGNSNISGSIGPELGRLVNLQYLELYRNNLNGEIPKELGNLKNLISLDLYANKLTGTIPKSLSKLGSLRFMRLNNNKLAGSIPRELAKLSNLKVIDLSNNDLCGTIPVDGPFSTFPLRSFENNNRLNGPELQGLVPYDFGC

SEQ ID NO: 21945 - protein, 182 aa, Oryza sativa (japonica cultivar-group)
MNIATTFGKVVVLAFGAWVGLKDGGVVTGLAAYGVIMATVSTASDLTQAFRTGYFMLDRSPPRWAQRHNGDLDLRPDRGRPAQWLVGLVTLRHINRGWRPGRHTARVTGSITARHASSSPPTTAAAATTIAIKSTVATVHVKHATTTRDGSGSRKSDGTDVPERPAASAPGSGSHFPLSLQG

SEQ ID NO: 21946 - protein, 236 aa, Oryza sativa (japonica cultivar-group)
MAALAAASTAFAAKPRLARAPSSPAARFSVSCSASGNNGGAGEMAQSLAASAKTFSAALALSSVLLSSAATSPPPAAADIAGLTPCKESKAFAKREKQSIKKLQSSLKKYAPDSAPALAINATIEKTKRRFENYGKFGLLCGADGLPHLIVSGDQRHWGEFITPGLLFLYIAGWIGWVGRSYLIAISGEKKPAMREIIIDVELAVKLLPRGFIWPVAAYRELITGNLVVDDADIGY

SEQ ID NO: 21947 - protein, 501 aa, Oryza sativa (japonica cultivar-group)
MAASSADLADDGFPAPRLFSQGVSYTYDDVIFLPGYIGFPADAVDLSTRLSRRIPLSIPCVASPMDTVSEAAMAAAMASLGAAAVVHCNTEPHLQASIVRAAKSRRLPFVSSVPLFSPASTPSLSDFAGHDYGLVTERGDSLSKLVGVAVAAETSSRQAPLPVSEYMRPAPRSVSASFDFEQAAAFLADEGLDYAPLVSDDSEVIDLITVNDVERIRSYPKLGKPSLGADGKFVVAASIGTREDDKRRLEQLVKAGANAIVVDSSQGNSIYQIDMIKYAKKMYPEVDLIGGNVVTIAQAQNLVASGVDGLRVGMGSGSICTTQEVCAVGRGQATAVYKVASYAKDHNVPVIADGGISNSGHIVKALSLGASTVMMGSFLAGSHEAPGTYEYKDGHRVKKYRGMGSLEAMTKGSDARYLGDTLKLKVAQGVVGAVADKGSVLRFIPYTMQAVKQGFQDLGASSLQSAHELLRSETIKLEVRTGAAQVEGGIHGLVSYEKKAF

SEQ ID NO: 21948 - protein, 488 aa, Oryza sativa (japonica cultivar-group)
MGARCSKLSVCWWPPHFKSPLLENGAAADDGSGVPVFAEYSLDELRVATDGFSPERIVSEHGEKAPNVVYRGTLFSTGRTVAIKRFGRSAWPDSRQFLEEARAVGQLRSVRLANLIGCCCENGERLLVAEFMPHETLAKHLFHWETKPLSWAMRVRAAFYVAQALEYCSSKGRALYHDLHAYRVLFDVDGNPRLSCFGLMKNSRDGKSYSTNLAFTPPEYLKTGRVIPESVVYSFGTILLDLLSGKHIPPSHALDLIRGKNYLVLMDSCLEGHVSSSDGTELIRLASRCLQYEGRDRPNLKSVVSALGNLQKDASAPSHALLGIQHDKENTERISLSAIAKVYARADLDEVHEMLENDGYCEDERATFEVSFHSWTGQQVSDSILVKKHGDSAFQSKDFATAVECYSRFIDTGVMVSPTMLARRSFVYMVLGKLQEGLADAKKAADISPEWPTAHYLQGMAYLAMGMEPEGHEELKQGAALEAERNAR

SEQ ID NO: 21949 - protein, 416 aa, Oryza sativa (japonica cultivar-group)
MGNCCGWGARIKDGSPQPGASGMFSRSGAKDGSRLSGCSSRASSASMPPTAKTECEILQSANVKIFSFSDLRIATRNFRPDSVLGEGGFGSVYKGWIDENTLSACKPGTGIAVAVKRLNQESLQGHREWLAEVNYLGQFCHPNLVKLFGYCLEDEHRLLVYEFMPRGSLENHLFRRGSHFQPLSWNLRMKVALGAAKGLAYLHSSEAKVIYRDFKTSNILLDTDYSAKLSDFGLAKDGPVGEKSHVSTRVMGTYGYAAPEYLSTGHLTAKSDVYSFGVVLLEMMSGRRAIDKNRPQGEHNLVEWARPYLTHKRKIFRVLDTRLEGQYSHVGAQTVATLALECLSYEAKMRPSMEAVVTILEELQESSHVDRKPAAERRQESTTGTGKKAPTANASKNSVFWQQVLFVHYHELLNFS

SEQ ID NO: 21950 - protein, 480 aa, Oryza sativa (japonica cultivar-group)
MAVTRIGLAGLAVMGQNLALNIAEKGFPISVYNRTTSKVDETVQRAKVEGNLPVYGFHDPASFVNSIQKPRVVIMLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 21951 - protein, 227 aa, Oryza sativa (japonica cultivar-group)
MAAAAAAAARRLLSRRATSFSASALLRRGGPGAPESLLRPTVAAVSRVGFLRGFARRPGGDGYSPMRSGGGGGGGGDRAPTEMAPLFPGCDYEHWLIVMDKPGGEGATKQQMIDCYIQTLAKVLGSEEEAKKKIYNVSCERYFGFGCEIDEETSNKLEGLPGVLFVLPDSYVDPEYKDYGAELFVNGEIVQRSPERQRRVEPVPQRASDRPRYNDRTRYARRRENQR

SEQ ID NO: 21952 - protein, 508 aa, Oryza sativa (japonica cultivar-group)
MQMQQRRKPPPAAAPVAAKQPSPRRTPGPLSFAGALLSLLVVATFLYINDHGNMMPPHASPDPDLRLLQEAAHQKVNSILLSRHAPAPPPRTNTNTSSSDQHLRLINIPMSSDLDLELGGNSTSSSGVEIQFEQQQQQEEKNLRGCELYKGRWVYDAAGREAPLYRESECGFLTEQVTCMRNGRRDDSYQRWRWQPEGCDLPSFDARALLERLRNKRMMFVGDSLNRNQWESMVCLVQSAIPYGQKTLTKFVNNGSLNVFRAHEYNATVEFYWAPFLVQSNSDDPQVHSVRDRVIAWRSIAKHAANWKGVHYLVFNTYIWWLNNFQIKVLKSRGAPFAGSGGWSSRYALVDRAIAYREVLKTWAKWVDRRIDPNKTHVFFMAMSPNHFMPEAWGGSAGAVKCAMETQPIVNRTSGGLDIGTDWRLHGVARGVLRSMRRVGVRFVDITALSELRKDAHTSVHTLRQGKLLTPEQQADPRTYADCIHWCLPGLPDTWNHFLYAHIVAHAA

SEQ ID NO: 21953 - protein, 178 aa, Oryza sativa (japonica cultivar-group)
MAGSGRDDPLVVGRIVGDVLDPFVRITNLSVSYGARIVSNGCELKPSMVTQQPRVVVGGNDMRTFYTLVMVDPDAPSPSNPNLREYLHWLVTDIPGTTGATFGQEVMCYESPRPTMGIHRLVFVLFQQLGRQTVYAPGWRQNFSTRNFAELYNLGSPVATVYFNCQREAGSGGRRVYP

SEQ ID NO: 21954 - protein, 179 aa, Oryza sativa (japonica cultivar-group)
MAGSGRDRDPLVVGRVVGDVLDAFVRSTNLKVTYGSKTVSNGCELKPSMVTHQPRVEVGGNDMRTFYTLVMVDPDAPSPSDPNLREYLHWLVTDIPGTTAASFGQEVMCYESPRPTMGIHRLVFVLFQQLGRQTVYAPGWRQNFNTKDFAELYNLGSPVAAVYFNCQREAGSGGRRVYP

SEQ ID NO: 21955 - protein, 327 aa, Oryza sativa (japonica cultivar-group)
MAPAAEPYVVEDCRGAVQLMSDGTVRRSAEPAFHVDLPDDADAAVEWKDVTYDAEHDLNARLYRPRHLGAANDARVPVVAYFHGGGFCIGSGRWPNFHAWCLRLAAELPAVVLSFDYRLAPEHRLPAAQEDGATAMAWVRDSAARDPWLADAADFSRVFVAGDSAGGNITHHMAVRFGKAGLGPQVRLRGHVLLMPAMAGETRTRAELECRPGAFLTAEMSDRYARLILPGGATRDYPVLNPAGPEAPGLEAVAMAPSLVVAAEHDILRDRNEHYARRMREEWGKEVAFVEFAGEQHGFFEVDPWSERADELVRLIRSFVVEHMDSE

SEQ ID NO: 21956 - protein, 328 aa, Oryza sativa (japonica cultivar-group)
MASLSDPNSPPPHVVEDCRGALQLLSDGTVVRAAAPPPPFYVRLDIDDGRVEWKDVVYDAAHGLGVRMYRPAATGGAEEKLPVVVYFHGGGFCIGSCTWPNFHAGCLRLAAELPAVVLSFDYRLAPEHRLPAAHEDAAAALIWLRDQLLSDPWLADAADARKVFVSGESAGGNFAHHLAVRFGAAGLDPVRVAGYVLLMPAFISERPTPSELAAPATAFLTRDMCDRYCRLALPAGADKDHPLVNPFGPASRSLEAVDVGRVLVVAADGDLLRDKNVEYAERMKAMGKDVELVVFAGEEHAFFGVKPMSAATGELVEVIRRFIAGAAA

SEQ ID NO: 21957 - protein, 348 aa, Oryza sativa (japonica cultivar-group)
MPAVVSAAGAAAPCSNVVEDLVGFLRVLSDGTILRSPGPVFCPSTFPDEHPSVEWKEAVYDKPKNLHVRMYKPSPASGGVGAGGGGKLPVLVYFHGGGFCLGSCTWANVHSFCLRLAADAGAVVLSAGYRLAPEHRLPAAVDDAAGFLHWLRERAVDGDGDGDGWWLAEAADFGRVFVTGDSAGGTIAHHLAVRAGSAAAAAPDDPVAIRGYVLLMPFFGGVSRTPSEAGCPAEVFLNLDLFDRFWRLSLPPGATRDHPMANPFGPDSPAMDGVELPPVLVVAGGLDMLRDRAVDYAERLSAMGKPVELAEFAGEHHGFFTLGPGSDAAGELIAAVARFVDVAAPPPK

SEQ ID NO: 21958 - protein, 330 aa, Oryza sativa (japonica cultivar-group)
MAAERVVVDECRGVLFVYSDGAVERRAAPGFATPVRDDGSVEWKDAVFDAARGLGVRLYRPRERGGGRLPVFFYYHGGGFCIGSRTWPNCQNYCLRLAAELGAVVVAPDYRLAPEHRLPAAFEDAENALLWLASQARPGGDTWVAEAADFGRVFVSGDSAGGTIAHHLAVRFGSASGRAELAPARVAGYVQLMPFFGGVERTPSEAACPDDAFLNRDLNDRYWRLSLPAGGATADHPFSNPFGPASPDLAAAEFAPTLVVVGGRDLLRDRALDYAARLAAMGKPVEALEFEGQQHGFFTIDPWSAASGDLMHAVKLFVDTDGGGGARLDG

SEQ ID NO: 21959 - protein, 1073 aa, Oryza sativa (japonica cultivar-group)
MEASISPPGSSKQAGLRRPSPGNSLKDLCLVSKQGSIAEVESALALLKKSGGSIDGRNVFGLCALHLATWRNHLPIVRRLLDAGADPDARDGESGWSSLHRALHFGHLCVASVLLQFGASLALEDTKGRTPVDLLSGPVSQANGDSPDSVAMEVFSWGSGTNYQLGTGNAHIQKLPCKVDALHGSYIKTVAASKFHSVAVSSDGELYTWGFGRGGRLGHPDIHSGQTTAVITPRQVTVGLGRKRVNVVAAAKHHTVIATEAGELFTWGSNREGQLGYPSVDTQPTPRRVSSLKARIISVAAANKHSAAVADTGEVFTWGSNKEGQLGYGTSNSASNCIPRMVEYLKGKAFKCVSAAKYHTVALGTDGEVFTWGHRLVTPRRAVISRCLKKGGNTNLKFHRMERLQVISVAAGVMHTTVLTADGAIFYWVSSDPDLRCRQIFSMCGRNVVNISAGKYWTALATAGGDVFMWDAKKHKDDLPMFTRVHGVKRATSVCVGETHMLVLSSIYHPEYPPKPKIQCKKAMLEWNGGMEELDEDIMFNDVQPDSGISGSDGVIKKGAPSLKSLCEKVAIEHILEPKNSIQLLEVAESLEAKELKKHCEDIAIRNLDYIFTVAAPSVMNASPETLANLERLLDEKSSEPWSHRRLPTVTATYPAVIDSDEEGDEAGGFLRLRDSQKSASKSYGISSYGNFLEKDSNAGQAASKQIRALRKKLQQIEMLEAKQLDGHQLDNQQLAKLESRAALEGELAELGIPTDLRTPVCVTEEKTNKKSSVSKKQKRKNKQAAHSDTPLVKREDRDQIYVKDLQEVLPVHISAEKEASVADSIKPSEHVTFINTKAISCPLENKASQPTSSKKKNRKGGLSLFLSGALDDTPKPSPPTPVVTVTPKHEGPAWGGAKVTKGSASLRDIQSEQRKTNEPITAKAKDRFEDSPDSAGRMRLSSFIPDARSTPITVTPARVVPASEGDKSTLSWSSSATSPNVLRPSLRDIQMQQEKRQTGISHSPKTRTSGFAIPSQGTSPEVGGIKDNVPNRWFKPEADAPSSIRSIQIEEQAMKDFKRFYSNVRIVKPQVQ

SEQ ID NO: 21960 - protein, 202 aa, Oryza sativa (japonica cultivar-group)
MEGTVFTPSLQGIKNVKSESGVILTKPFLEVCKHILPVLDKFGSAMSIVKNDIGGNITRLETKYASDPSKYEQLHSMVKVEISSKTAKSSSSCTNGLLWLTRAMDFLVALFHNLVQHPDWQMSQACSDAYSKTLKKWHGWLASSSFSVAIKLAPDRKKFMEIISGSGDINADIEKFCATFSPLLAENHRFLASVGMDDLKAS

SEQ ID NO: 21961 - protein, 286 aa, Oryza sativa (japonica cultivar-group)
MGKEVDVSTLEAGGARDYIDPPPAPLVDVDELGKWSLYRALIAEFVATLLFLYVTVATVIGYKHQTDAAVNGADAACGGVGVLGIAWAFGGMIFILVYCTAGVSGGHINPAVTLGLFLARKVSLVRALLYMAAQCLGAICGVALVKGFQSSLYDRYGGGANELAAGYSTGTGLAAEIIGTFVLVYTVFSATDPKRNARDSHVPVLAPLPIGFAVFMVHLATIPITGTGINPARSLGVAVVYNNNKAWSDQWIFWVGPFIGAAIAALYHQVILRASARGYGSFRSNA

SEQ ID NO: 21962 - protein, 283 aa, Oryza sativa (japonica cultivar-group)
MGKEADVEAGGVRDYEDPPPAPLVDIDELGRWSLYRAVIAEFVATLLFLYVTVATVIGYKHQTDASASGDDAACGGVGVLGIAWAFGGMIFILVYCTAGISGGHINPAVTFGLFLARKVSLVRAILYIVAQCLGAVCGVALVKGFQSSFYDRYGGGANELAAGYSKGTGLAAEIIGTFVLVYTVFSATDPKRNARDSHVPVLAPLPIGFAVFMVHLATIPVTGTGINPARSLGAAVVYNNSKAWSDQWIFWVGPFIGAAIAALYHQIVLRASARGYGSFRSNA

SEQ ID NO: 21963 - protein, 290 aa, Oryza sativa (japonica cultivar-group)
MGKDEVMESGGAAGEFAAKDYTDPPPAPLIDAAELGSWSLYRAVIAEFIATLLFLYITVATVIGYKHQTDASASGADAACGGVGVLGIAWAFGGMIFILVYCTAGISGGHINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 21964 - protein, 397 aa, Oryza sativa (japonica cultivar-group)
MASSSDVDLADRFDMSGPTHMMKEKIIHWDKEEHRRCVAACLVKGAYVVENDLNRRRMWGKELAPAWWENFGFRTVDVINDDVIDDNDQIVTGTIYEHETPPGGGEPRHPLSPRYVVAFRGTMTWHPKAFVDLYLDLQVLFNTLQDSQRFRLAKAAVQKLVDTIHKGTGVCDHAVGGRCVVWLVGHSLGASVALEVGRVMMTEQGYNLPTFLFNPPQVSPAPVINLLHPNEKAKRHLHAASSLLKVGLGKIMNSHEEHMEKLFERLSPWTPELYVHESHPICQGYIDYFEQRQLVQERFRGIGNSAMKLSYRDMFFSVLGKNKERPHLLPSALLWKNSRVDDDVEDHKKLSKCKMLQEQLHQYKKLAFNAHSLEHWWKPDNELSLTKTQYMYSYPSA

SEQ ID NO: 21965 - protein, 288 aa, Oryza sativa (japonica cultivar-group)
MYKQGGGGGGGGGGGGGAGLDRKRISDALDKHLEKAVAAAAAAASPSTSRGSAGGRGGGDHQRLVVPSSASSMPKGRCSEGESESDSEASDVSGSDGEDHSWISWYCSLRGNEFFCEVDDDYIQDDFNLCGLSSQVPYYDYALDLILDIESSHGDMFTEEQNELVESAAEMLYGLIHARYILTSKGLAAMLEKYKNYDFGRCPRVYCCGQPCLPVGQSDIHRSSTVKIYCPKCEDIYYPRSKYQGNIDGAYFGTTFPHLFLMTYEHLKPQKPSQRYVPRVFGFKLHKP

SEQ ID NO: 21966 - protein, 173 aa, Oryza sativa (japonica cultivar-group)
MARGVSYVSAAQLVPMLRDPRIAVVDVRDEERIYDAHIAGSHHYASDSFGERLPELAQATKGKETLVFHCALSKVRGPSCAQMYLDYLSEADEDSDVKNIMVLERGFNGWELSGRPVCRCKDAPCKDFRVAIYALWSLQHIKNRVSHFGGSAIVLLCGSINSVAVNVTSRHVN

SEQ ID NO: 21967 - protein, 284 aa, Oryza sativa (japonica cultivar-group)
MLPYATAAEAEAAVGRGLTWAEAAWFRYSAAIPDYCLYCHNVPILLLVYTLAPLPLALLELRRHLPLPHKLQPGVRHPPAAFLRCYAATARVLLLAVGPVQLASFPAVRAVGIRTGLPLPSAGETAAQVAVYLLVEDYLGYWIHRLLHTPWAYHHIHRVHHEFTAPMGYAAPYAHWAEILILGFPAFAGPAIVPCHMTTFWLWFVLRHLEAIHIHSGFKLPFDPTKYIPLYGGVEYHDYHHFVGGHSQSNFSSVFTFCDYIYGTDRGYRYHKASLSKMRIFVRA

SEQ ID NO: 21968 - protein, 306 aa, Oryza sativa (japonica cultivar-group)
MYENCKVIDLGVTNCRVVESVGEHVEGFAAGDPVVPTFLGQCTECVDCASERSNVCSTYRFAVRPGMPRDGTARFRDRHGAPIHHFLGVSSFSEYTVVDANQVVRVDPAVPPATASLLSCGATTGVGAAWKLAKVEPGSSVAIFGLGAVGLAVAEGARICGKKFGVTHFINPQELGDKPVSQAIIEMTDGGADYCFECIGLASVMSDAFRSSREGWGKTIILGVEMHGAPLSIPSLEILNGKCVMGSLFGGVKPKQDIPILADKYLNKELELDKFITHEVPLKDINTAFDLLLQGKSLRCTIWMDK

SEQ ID NO: 21969 - protein, 360 aa, Oryza sativa (japonica cultivar-group)
MEDQSLKPIRCKAAVCRAASEPLIVEEIVVDPPKAYEIRIKIICTSLCHTDVTLWHKVDPAFPRILGHEAYGVVESVGENVEGLAAGDTVVPTFMGQCDSCASCAAEWTNQCTAVPFTMGPGMRRDGTTRFWDGEGKPLSDTVAVTSFSQYTVVDVNQVVKVDPAVPPKIACLLGCCGGTGEPEIRRYIEPAWGRSSMEVGQSATRFVGGCLRAGIRRIGGKEFGVTDFVNPSQLGDKSVSEVINAMTDGGADYSFECIGISSVMTEAGRGKTIILGVEKDSQPLCLPSFEFLFGKCVMGSLFGGAKPKTDIPILAEKCMNKELELEKLVTHEVGLTEINTAFDLLLQGKSLRCIIWMDK

SEQ ID NO: 21970 - protein, 391 aa, Oryza sativa (japonica cultivar-group)
MEQQPKMVTGWAARDANGLLSPFSYPLRAKGDEDVVVKILFCGICHSDLSTIKNEWGNAKYPVVPGHEIVGVVAEVGSSVARFAAGDTVGVGYIASTCRACANCRDGFENYCAGLVPSFNAALPDGATVHGGFSELAVVNQRYVVRIPGGGGGASPAPLDRLAPLLCAGVTVYCPMRRLGLDRPGVHLGVAGLGGLGHLAVKFGKAFGVKVTVISTSPWKEAEAVERLGADAFLLSTNAEQMKAAAGTMDGIIDTVSAVHDLTPLITLLRTHGQLVPVGSPGKPVQLALYPLQSGPSPVGPRIDWAGGPIRARWAVLMVCDVADGKSVAGSMIGGMRDTQEMVDFAVEHGVAAEVEVIGMEDVNGAMERLQKGDVRYRFVIDVANTMARAR

SEQ ID NO: 21971 - protein, 326 aa, Oryza sativa (japonica cultivar-group)
MVTGVEQMVCVTGAGGFIGSWLVKELLHRGYAVRAAVRDPEGRKNAHLHALERAKRRLSLHRADVLDCNSLRAAFNLCDGVFHVASPVSDDPELLPTAIEGTKNVINAAADMGIKRVVFTSSYGAAHMNPNRRSDQTLDETCWSDLEFCKQTQNWYCYAKTVAEKTATEEASKRGVQLLVVVPAVTVGEMLQPTLNASVYRVATYMRGTKSAYPNAVAAYVDVRDVARAHALVYEHPDARGRYLCIGSVLHRSEFVRLLRELFPQYPITTRCEDNSKPMVKPYQFSVQRLEALGMQFTPLKESLYKTVISLQDKGHLPAISPRSAL

SEQ ID NO: 21972 - protein, 328 aa, Oryza sativa (japonica cultivar-group)
MVTGRSEQMVCVTGAGGFIGSWLVKELLHRGYFVRGAMREPADIKNAHLHVLDGAREGLSLYRADVLDRNSLRAAFALCDGVFHVASPVSNDPELLPAAIEGTKNVINAAADMGVKRVVFTSSYGAVHMNPNRRSDQIVDESCWSDLEFCKQTQNWYCYAKMLAERTAMEEASKRGVNLLVVVPAVTVGEMLQPTLNASVHRVATYMRGTKSAYPNAVAAYVDVRDVARAHALVYEHPDARGRYLCIGSVLHRSEFVRLLRELFPQYPITSRCKDNSKPMVKPYKFSVQRLETLGMQFTPLKESLYRTVISLQDKGHLPAAISRRSAL

SEQ ID NO: 21973 - protein, 320 aa, Oryza sativa (japonica cultivar-group)
MEAEAAAKRARESGDAAAAGAGEQAGISAVIPGWFSEISPMWPEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDVAFLKNAPEGTYDAVIVDSSDPPGPAQELFEKPFFQSVARALRPGGVVCTQAESIWLHMHIIEDIVANCRQVFKGSVNYAWTTVPTYPGVIGFMLCSTEGPTVDFQHPIFNIEDNEFSTKSKGPLKFYNSEIHSASFCLPSFAKRVIGSKAN

SEQ ID NO: 21974 - protein, 308 aa, Oryza sativa (japonica cultivar-group)
MDGGGGGGGGGGVMAGPGVAGGGGGGGGGGVGGDVELVSKTLQFEHKLFYFDLKENPRGRYLKISEKTSSTRSTIIVPVAGVAWFLDLFDYYIRTDERDAFSKELRLDTKVFYFDIGENKRGRFLKVSEASVNRNRSTIIVPAGSSGEEGWEAFRNVLLEINNEASRLYVLPNHPNQQHLEPPERLPGLSDDVGAGFIAGHGSQSASGPEVDVERLVDLPPQEEISGMGMSKVIRADQKRFFFDLGSNNRGHYLRISEVAGADRSSIILPLSGLKQFHEMVGHFVDIMKDRLEGMTGANVRTVESSQR

SEQ ID NO: 21975 - protein, 381 aa, Oryza sativa (japonica cultivar-group)
MSHRRVDAAACDSWRPPPTPPPPHARRALALRVGGGGGGPAFASLTVREGGGGGEEGEVGEGKGKQQQLPAAGVLVRHPLAMLALVPNAVALFAAGAAAGAVAKTITAPLDRVKLLMQTHSVRVVGESTKKGIGFLEAIAEIGKEEGLKGYWKGNLPQVIRIVPYSAVQLFSYEVYKKFFRRKDGELTVFGRLAAGACAGMTSTLVTYPLDVLRLRLAVQSGHSTMSQVAMNMLRDEGLASFYGGLGPSLIGIAPYIAVNFCVFDLMKKSVPEKYKSRPETSLATALLSATFATLMCYPLDTVRRQMQMKGSPYNTVLDAIPGIVERDGLIGLYRGFVPNALKNLPNSSIKLTAFDTVKTLISTGQKELEKLMQENQEKMS

SEQ ID NO: 21976 - protein, 1230 aa, Oryza sativa (japonica cultivar-group)
MNWIGIGQIWHYRPTYGKAWRAKQVAMKVIWGDWDEAYVRLPTLMRAIKAKNPTMHFRVEAHPEKSRMVDGVQRRVFGRAYWIFGQSIEAFKHLRPVLAIDGTFLTGKYQGTLLTAIGVDAGLHLVPLAFALVEKENTSNWEWFINMLRNKLIGPNREVCIISDRHPGILNSIIHIMPHHLTIHHRWCMRHFCANFYTAGATTDQMKDLERICQINEKALFLDEIKRLMGVVGERPKKWLEDHMPLKVKWARAFDTNGRRHSIMTSNMAESFNNVLRGIRKLPVTAIVAYTFSKCNSWFVDRHKEATVDILCGKKWPTKVKDMLEEQQRRTLGQRAACFDFPSMKYEVSEQGGVTAAGVQWGGRHYVVVARDNTCSCQFPQLHHLPCSHMITVCKLRGLDVEVAPRMCYEASNKAVQDSYSPRFEPYLDPSQWPSYDGEFFVPDLSLKNNTRGRRRTRRFKNDMDKAYKGSANRRSQKPNNTNSEPVMQNRCSLCHELGHKKTRMEHFPGLEDFYEEKHRAPQIASGERLKTLRVRGHTAHILFDDRYVPYLRRAKLLAFVTMAQRPVPLYNAAALTALVDRWRPETHTFHLPCGELTVTLEDVAMILGLPIRGQAVTGDTASGNWRERVEEYLGLEPPVAPDGQRQTKTSGVPLSWLRANFGQCPAEADEATVQRYCRAYVLYIFGSILFPDSGGDMASWMWLPLLADWDEAGTFSWGSAALAWLYRQLCDACRRQGGDANLAGCVWLLQVWMWMRLPVGRPMWRTHQAWPHQDADRRPTVAHLWESVPSPVVGRRNLAYYHYTNEMDYLQPEHVVWMPYQAQEVLELELNPMCHIEDALKTLRCPLICFYAVEFQMCHRVMRQFGRLQTIPHRFSTSIDLHNHFNIYYIFELDILHTCRVDRRKNKKVTDWAYYHQDHITQWEKFEENGVPDQGQHNGTEFDLYLAWLHRTYRLVLRPAWTLADIADDPEDVEEQNEYDTRTRLGTTVETGPVRDRVARELLRTVNDAGVALGTAPGSEGEGGTLRNALQRLRQRCRKLAARLGCRSTDVVEHAHAHQEGDEEGEVGDEEGEQDKEAEEGDEEEEGDEDREEEADELGPSQLEDAPESSQPDISQPGPSRPRRRRAPSQDWRYTPDVPRPRTRVLLKFSRAHLALRSQPSHPEGLLGWATAETAKSHLSARWAGAEFPIVSAIMAGAEVPARKPSSRLAGLGLGGCGQVPPQRQVGWR

SEQ ID NO: 21977 - protein, 490 aa, Oryza sativa (japonica cultivar-group)
MGKKRKLDSKSPAAARSAAARAAAAAAAAAAAAAVAEPSSQPEALAEDPAPSSQPLGLSSEGAGERMMSREAGGGEEEEVEEVEVEEEVEVDEDEDGEGEGEEEEEAAERDADSIQALLNSFPKDQLVELLSAAALSHEDVLTAVHRAADADPALRKIFVHGLGWDATAETLTEAFSAYGEIEDLRVVTDRATGKCKGYGFILFSRRSGARAALREPQKKIGNRTTACQLASVGPVPPGGMATNPAPAVAPAPAQLALPPVSEYTQRKIFVSNVGADIDPQKLLQFFSKYGEIEEGPLGLDKVTGKPKGFALFVYKTLDSAKKALQEPHKQFEGVVLHCQKAIDGPKPNKGGGLGGLYGAGTSGGRKGAGGYGAHSHSLPGAAVGGHVMPSPVSSLTSLPGVAGGPGVNPALGQALTAILASQGGGLGLNNILGVGANGSGLPNPGASAGLGSSGLPGMPGAGGYLGGYGGGGGYGSTPPGGPGRNYMGH

SEQ ID NO: 21978 - protein, 202 aa, Oryza sativa (japonica cultivar-group)
MQGFANKEALATTISTRKATFYSRSRSSLWTKGETSMNFINVHDIFLDCDRDSIIYLGKPDGPTCHTGAETCYYTSVYDALQGSKPNQDRQVVSTLYSLEDTISRRKEEIVTEGSGKPSWTKKLILDNRLLCSKISEEAGELNQTLLENEDESRTISEMGDLLYHAMVLLRVKGVRMEQVLEVLRKRFSQSGIEEKASRNKS

SEQ ID NO: 21979 - protein, 507 aa, Oryza sativa (japonica cultivar-group)
MEEQQEGAAGVMRRRPKTKIVCTLGPASRSVEMIGRLLRAGMCVARFNFSHGSHEYHQETLDNLRAAMESTGILCAVMLDTKGPEIRTGFLKDGKPVQLKKGQEITVSTDYSIKGDDNMISMSYKKLAVDLKPGSVILCADGTITLTVLHCDKEQGLVRCRCENTAMLGERKNVNLPGVIVDLPTLTEKDKEDILKWGVPNKIDMIALSFVRKGSDLVEVRKVLGKHAKSIMLMSKVENQEGVANFDDILAQSDAFMVARGDLGMEIPIEKIFYAQKVMIFKCNIQGKPVVTATQMLESMIKSPRPTRAEATDVANAVLDGTDCVMLSGETAAGAYPELAVRTMAKICLQAESCVDHAAVFKSITASAPIPMSPLESLASSAVRTANSAKAALILVLTRGGTTARLVAKYRPSMPILSVVVPELKQTDSFDWTCSDEAPARHSLIVRGVIPMLSAATAKAFDNEATEEALGFAISNAKAMGLCNSGESVVALHRIGTASVIKLLTAN

SEQ ID NO: 21980 - protein, 212 aa, Oryza sativa (japonica cultivar-group)
MAAAWSPALAAVLLAAAVASASNSEGDALYALRRALADPRGVLQSWDPTLVNPCTWFHVTCDRAGRVTRLDLGNSNLSGHLAPELGHLEHLQYLELYKNNIQGTIPAELGSLKNLISLDLYNNNITGTIPKELGKLSSLVFLRLNDNSLNGPIPRDLAKISSLKVIDVSNNDLCGTIPTSGPFEHIPLNNFDKNPRLEGPELQGLATYDTNC

SEQ ID NO: 21981 - protein, 204 aa, Oryza sativa (japonica cultivar-group)
MAPNGEGAVAAAAAAPAPAPAVARGKRAEKPRRISMEGLQRAMSDLALELTKKQQVADAAAGGGGGGEKLPEITEQQQVVVEEARCECCGMQEECTPEYARRVRERYCGRWVCGLCAAAASAEADRRCRHGGTGWTTATAEEALAAHMAVCGRFNRVGRANPVLMQTEAMREILRKRSRSNSPRDHGHGGLTRSSSCIPAITKD

SEQ ID NO: 21982 - protein, 477 aa, Oryza sativa (japonica cultivar-group)
MGISKGGSGKEAKKPPLLLGRFEVGKLLGQGNFAKVYHARNVATGEEVAIKVMEKEKIFKSGLTAHIKREIAVLRRVRHPHIVQLYEVMATKLRIYFVMEYVRGGELFARVARGRLPEADARRYFQQLVSAVAFCHARGVFHRDIKPENLLVDDAGDLKVSDFGLSAVADGMRRDGLFHTFCGTPAYVAPEVLSRRGYDAAGADLWSCGVVLFVLMAGYLPFQDRNLAGMYRKIHKGDFRCPKWFSPELIRLLRGVLVTNPQRRATAEGIMENEWFKIGFRRFSFRVEDDRTFTCFELDDDAAVDAPTSPPDTPRTVDSGDVGAAPTRPRKAGSLTSCDSAPLNAFDIISFSPGFDLSGLIPEQQKHTARFVSAAPVEVIVATLEAAAAAAGMAVREREDGSISMEGTREGEHGALAVAAEIYELTPELVVVEVRRKAGGAAEYEEFFRARLKPSLRELVCDDRPCPEDSGELSRSL

SEQ ID NO: 21983 - protein, 507 aa, Oryza sativa (japonica cultivar-group)
MASGPPSSPSSKAFSRKSHAHASGPNSSKAAAAGGGGGGVAAAFDAHNGTHVRTVTFSLSSSPAARRELRRRLTAELAQVRATCKRLSSLPAPAPSSALSATDPSTPLPPHPPVSKHKSKKGNPSSNPGLSAEARRKLYAPVFKSCGALLARLMKHKHSWVFNTPVDASALGLHDYHTIITKPMDLGTVKSRLAAGHYKSPREFAGDVRLTFQNAMRYNPKGQDVHFMAEQLLNMFEEKWPEIEAEVAQLSPQPPTPSSAAPRKPKEIDNSKVLERSDSTVHAAGMEATPKQNTGRPPVLKKPKAREPNKREMTFWEKQRLSNNLQELPPEKLDNVVQIIKKRNLSLSQHDDEIEVDIDSFDVETLWELDRFVTNYKKSISKNKRKAENPVAGQDEMNHDIELEKTEHARLDEVEQDQMPPVQETLHNPEPESIDIEPPKENTAAFLFAINSIKDIFIYICITYEIYREKHMQIQTQIVHQQMALMLHSHPERNIYRPGSKTMLKTE

SEQ ID NO: 21984 - protein, 176 aa, Oryza sativa (japonica cultivar-group)
MSGRGRGDPLVLGRVVGDVVDPFVRRVALRVAYGAREVANGCELRPSAVADQPRVAVGGPDMRTFYTLVMVDPDAPSPSDPNLREYLHWLVTDIPATTGVSFGTEVVCYESPRPVLGIHRLVFLLFEQLGRQTVYAPGWRQNFSTRDFAELYNLGLPVAAVYFNCQRESGTGGRRM

SEQ ID NO: 21985 - protein, 151 aa, Oryza sativa (japonica cultivar-group)
MAQLVDKAKGFVADKVARVEKPEAELAELSFQSVGRGGATLAGRVDVRNPYSHSIPICEVSYSLKSAGREVASGTMPDPGSLTAGDTTRLDIPVKVPYDFLVSLARDAGRDWDIDYEMRVGLTVDLPILGNFTLPLTKSGELKLPTLSDVF

SEQ ID NO: 21986 - protein, 214 aa, Oryza sativa (japonica cultivar-group)
MSSAAAATRFIKCVTVGDGAVGKTCMLICYTCNKFPTDYIPTVFDNFSANVSVDGSVVNLGLWDTAGQEDYSRLRPLSYRGADVFILSFSLISRASYENVQKKWMPELRRFAPGVPVVLVGTKLDLREDRAYLADHPASSIITTEQGEELRKLIGAVAYIECSSKTQRNIKAVFDTAIKVVLQPPRHKDVTRKKLQSSSNRPVRRYFCGSACFA

SEQ ID NO: 21987 - protein, 309 aa, Oryza sativa (japonica cultivar-group)
MDRIVGGKFKLGRKIGCGSFGEIYLATHVDTYEIAAVKIESSKTKHPQLFYEAKLYNALQGGSGIANVKWCGVDGEENVLVIDLLGPSLEDLFVYCGRKFTLKTVLMLADQMITRIEFMHSKGYLHRDIKPDNFLMGLGRKANQVYIIDFGLAKRYRDSTTNRHIPYRENKNLTGTARYASCNTHLGVEQSRRDDLESLGYVLLYFLRGSLPWQGLKAATKKQKYDKICEKKISTPIEVLCKSCPVEFASYFHYCHSLTFDQRPDYAFVKRLLRDLFTRQVYEFDYVFDWTVLRYKQGQKVQVYCLGSK

SEQ ID NO: 21988 - protein, 440 aa, Oryza sativa (japonica cultivar-group)
MAASLAALAGAGVAGVAVELWWGVVERQGPGVYDWAGYLELAAMARRYGLRVRAILAFHQCGAGPHDPPWIPLPQWVLEEMDKLPDLSYMDRYQRRNKEYISLGCDILPILKGRSPMQAYSDFMRSFRDAFKEYLGAIVTEVQIGMGPGGELRYPSCPTETLSQAGISSELGEFQCYDKFMQASLSARAQLIGMQDWGNGGPAGTDGSRQNPEETSFFRADGGCWNTPYGRFFLEWYSGMLLLHGERLCMVADAVFSGSGVTIAGKVSGIHWHYYTCSHPSELTAGYYNTLLRNGYLPITQMFARYKAALCCSCFDLRDEERNNSKSSPEGTLRQLMVAAKMCNLPLNGENSVTRLDDTSLNQVIRSSRLYSGGTSGTSFSFNYVRMNKSLFEFHNWNRFTKFVRQMSDARTFLARLEFRRGQHYLSSMSVVWVVSRACA

SEQ ID NO: 21989 - protein, 145 aa, Oryza sativa (japonica cultivar-group)
MWTHIRPAAGEKAAGARGKRRAAPRRRPAAASTPAITTTAKVVFQDSSMAQFVAPTSMGRASSASASTCFVCCSDELRFDAPARAMAVHDALQLGQLYFVLPVSALHRPLSDQDMAALAVKAIAALGASATAASMDSSIYKCGSI

SEQ ID NO: 21990 - protein, 349 aa, Oryza sativa (japonica cultivar-group)
MGVDYYKVLGVDRGAGDDDLKKAYHKLAMRWHPDKNPTNNKKEAEAKFKQISEAYEVLSDPQKRTIYDQVGEEGLKGQPPPGAGGPGASPFYPGGAHSNSFHFNPRSADDIFAEFFGFRGPFSSMGGMPSVSGGMRGDPRFPGFGNEYFSSRFGGEGSTSMHQPSHQLAKPPPIENRLPVSLADLYKGVTKKMKISREIIDFNGRVSQQEEILQIEVKPGWKRGTKITFEEKGNQAPNMKPADIVFIIEEKPHDIFTREGNDLVITEKISLVEALTGYTARIITLDARSLSVPINSVIHPDYVEVVPGEGMPNPKGPNKKGDLKIKFNIRFPSRLTSDQKAGFKRLLGS

SEQ ID NO: 21991 - protein, 345 aa, Oryza sativa (japonica cultivar-group)
MEKRRMLRAKQRFFEQNGGLLLQQQLGSLAASGVAFKIFSEEEVSKATDGFAEARVLGRGGHGVVYRGSLADGSTVAVKRSRVVEEKQLREFSREMLILSQINHRNVVKLLGCCLEVQVPMLVYEYVPNGSLHRYIHGGGAGAGEGLSPADRLRVAAESADALAYMHSSASPPILHGDVKSANILLDAGLTAKVSDFGASRLAPAADEAEVATLVQGTCGYLDPEYLLTCQLTSKSDVYSFAVVLLELLTGRKAFCPPPDSAAGSQDDDDDDDDRSLAFFFLTAAHKGRHREIMDGWVREEVGGEVLDNAAELVMQCLSMAGEERPTMKEVADRLAGMRSRASDS

SEQ ID NO: 21992 - protein, 474 aa, Oryza sativa (japonica cultivar-group)
MAVAAPGQLNLDESPSWGSRSVDCFEKLEQIGEGTYGQVYMAKETETNEIVALKKIRMDNEREGFPITAIREIKILKKLHHQNVIQLKEIVTSPGPERDEQGKPIEGNKYKGSIYMVFEYMDHDLTGLADRPGMRFTVPQIKCYMRQLLTGLHYCHVNQVLHRDIKGSNLLIDNEGNLKLADFGLARSFSSDHNGNLTNRVITLWYRPPELLLGSTRYGPAVDMWSVGCIFAELLNGKPILTGKNEPEQLSKIFELCGTPDELIWPGVTKMPWYNNFKPQRPMKRRVKESFKHFDQHALDLLEKMLTLDPSQRISAKDALDAEYFWTDPLPCDPKRTQANHTKSGLASLCIMHHLWQLAQVITMQSREDLEALIGTHKAGTKEATIRTAVDREEAMGVAHIHSKDEVLPLILVVAWAEPVVRGVVVAVAMVLADQIINRVDLMVHLVQVEARTIIKVVLAINNSMETGNSTAVS

SEQ ID NO: 21993 - protein, 296 aa, Oryza sativa (japonica cultivar-group)
MDVSRRKKWVAWVAAVTIFVVLMLVTPAIPQNEEYHDFADQRRLFLGIPNTLNVISNIPFFFVGVVGLVLCHYKNYFRLKLDHYCSQGELWSWTLFFAGVTAVAFGSSYYHLKPNDATLVWDRLPMTIAFTSVMAIFIIERVDDRAGTKSLAPLVIAGALSIMFFDDLRPYAVIQFVPCIAIPVMAIVIPPMYTHSSYWLWAAGFYLLAKVEEAADKPIYKWTHQIVSGHTLKHLAAAMVPVFLALMLAKRTVEPERVSLFQRWKVKLVAVRETRFNKDRNTVDYNYIAVSTTPEP

SEQ ID NO: 21994 - protein, 385 aa, Oryza sativa (japonica cultivar-group)
MGRRALPPSSSSSSSSSTTTTSPELRRKRTAAPPPPPSPRRYRSISDVMRRSLPVDAAPPVARAYESTRCDVCGSGERDEELLLCDGCDRGRHTFCLRPIAARVPTGPWFCPPCAPRSKPVKRFPMTQTKIVDFFRIQKGAEDAEAEKYGLFQDVKKRRKRSLVMHKKRRRILPYVPTEDKVQRLKQMASLATAMTSSKMKFSNELTYMPGMAGRSCNQATLEEGGMQILPKEDKETIELCRTMQKRGECPPLLVVFDSREGFTVQADADIKDMTFIAEYTGDVDFLENRANDDGDSIMTLLLTEDPSKRLVICPDKRGNISRFINGINNHTLDGKKKKNIKCVRYDIDGESHVLLVACRDIACGEKLYYDYNGYEHEYPTHHFV

SEQ ID NO: 21995 - protein, 197 aa, Oryza sativa (japonica cultivar-group)
MTMEASMSRTVSMLFSARRCIVASAAKDIEIAQGGRRRRSNDVKQQRGSHGQLAVAAATTAAAMTGQCHAAAAAAAPERQWQEVAEWVCRAVAVVGELDPATAKAAIGVAGPALSAFGFLFIARIVMSWYPRLPVREFPYVVAYAPTEPLLAVTRKVIPPLGGVDVTPVVWFGLVSFASEILVGPQGLLVLLSQQKP

SEQ ID NO: 21996 - protein, 467 aa, Oryza sativa (japonica cultivar-group)
MDLEPTVDAANSDRARSEDATVASVRASMRWRPLRRGCDGKDTRVGMASSELALHPLRAMGNCCGTKISSDAISRNASGSRRRRSGSRRKGTGLSSRVSSSVAAVTPRSEGEILRCANVRSFAFNELKTATRNFRPDSVLGEGGFGSVFKGWVDENTFLPSRPGTGMVIAVKKLNQDGFQGHREWLAEVNYLGQLSHPNLVKLVGYCLQDEQRLLVYEFMPRGSLENHLFRRGSHFQPLSWNLRMKVALGAAKGLAFLHSDKAKVIYRDFKTSNVLLDSNYNAKLSDFGLAKDGPTGDKSHVSTRVMGTYGYAAPEYLATGHLSAKSDVYSFGVVMVEMLSGRRALDKNRPAGEHNLVEWARPYLSSRRRIFRILDARLAGQYSLAGAHKAAALALQCLSADAKNRPTMHQVVAALEQLQETTTTSHHHRSPQSRMLLGGRGFNASGRSSAGAGARPRRLSASPLPA

SEQ ID NO: 21997 - protein, 327 aa, Oryza sativa (japonica cultivar-group)
MEEERRVLVTGGNGFIGSWIVRILLARGYAVTATYQPGTDAAHLLALDDERLLLLPADLLDAGAISAAAAAGGGCRAGVLHVASPCTLADPRDPQAELVEPAVRGTLHVLEAARGAGARRVVVTSSISAMVPNPGLAAGELVDERSWTDMEFCKARGKWYPVSKTLAERAAWEYAARWPGFELATILPSTCLGPLLQPTLNASSVVLQRLLQGSTDDQADYWLGAVHVRDVAAAHLLLLEAPTVSGRYLCTNGIYQFSDFARLAARICPAYAHAIHRFEEGTTQPWLVPRDARDAARRLLDLGLVLTPLEEAIKDAEKSLTDKCFLP

SEQ ID NO: 21998 - protein, 510 aa, Oryza sativa (japonica cultivar-group)
MGPLWTFILLYPEIFLAIICFFWFSLFRPIRQRQKSNLPVNWPVFGMLPFLVQNLHYIHDKVADVLREAGCTFMVSGPWFLNMNFLITCDPATVNHCFNANFKNYPKGSEFAEMFDILGDGLLVADSESWEYQRRMAMYIFAARTFRSFAMSTITRKTGSVLLPYLDHMAKFGSEVELEGVFMRFSLDVTYSTVFAADLDCLSVSSPIPVFGQATKEAEEAVLFRHVIPPSVWKLLRLLNVGTEKKLTNAKVVIDQFIYEEIAKRKAQASDGLQGDILSMYMKWSIHESAHKQKDERFLRDTAVGFIFAGKDLIAVTLTWFFYMMCKHPHVEARILQELKGLQSSTWPGDLHVFEWDTLRSAIYLQAALLETLRLFPATPFEEKEALVDDVLPNGTKVSRNTRIIFSLYAMGRIEGIWGKDCMEFKPERWVSKSGRLRHEPSYKFLSFNTGPRSCLGKELSLSNMKIIVASIIHNFKVELVEGHEVMPQSSVILHTQNGMMVRLKRRDAA

SEQ ID NO: 21999 - protein, 505 aa, Oryza sativa (japonica cultivar-group)
MELLPWLLGFVVKYPEIMASAACFLLLFCRFRRRSKRIPTNWPVVGALPAIVANAGRVHDWVTEFLRAAAMSHVVEGPWGSPGDVLITADPANVAHMFTANFGNYPKGEEFAAMFDVLGGGIFNADGESWSFQRRKAHALLSDARFRAAVAASTSRKLGGGLVPLLDGVAASGAAVDLQDVFMRLTFDLTAMFVFGVDPGCLAADFPTVPFAAAMDDAEEVLFYRHVAPVPWLRLQSYLKIGHYKKMAKAREVLDASIAELIALRRERKAADANATGDADLLTAYLACQDEIGMDGAAFDAFLRDTTLNLMVAGRDTTSSALTWFFWLLSNHPGVEARILAELRAHPPSPTGAELKRLVYLHAALSESLRLYPPVPFEHKAAARPDTLPSGAAVGPTRRVIVSLYSMGRMEAVWGKGCEEFRPERWLTPAGRFRHERSCKFAAFNVGPRTCLGRDLAFAQMKAVVAAVVPRFRVAAAAAPPRPKLSIILHMRDGLKVKVHRRQED

SEQ ID NO: 22000 - protein, 384 aa, Oryza sativa (japonica cultivar-group)
MLVKAQMNRSSRMLVKFRRYAKVAQEQKNIRKETASDAACPNPPRRGCEETNPNPNPKRNPKPAERGEEPPVRAVGCGGFAFLCALAGHTEAISGISLPVGSDKLYSGSADGSVRVWDCNSGKCVDAIKMGGKIGCMITHGPWIFVGITKSVEAWNTQTGMKSSLREPSGLVCSMTIKDEMLFAGTGDGRIMAWKIPDKKGDSGPVAILSGHERQVISLGVSVTRLYSGSLDKTIKVWDLKTLQCVQTLSEHKAAVTSVLCWDEKLLSCSLDKTVKIWAASKSGDLQVIYTHSEEHGVRTLFGMHRVGKTPVLFCSLHNSNCIRLFDLPSFDEMGKLFSKKEVRTIELAAGGLLFTGDGAGELKVWRWAPEEEPATPALVKSSM

SEQ ID NO: 22001 - protein, 181 aa, Oryza sativa (japonica cultivar-group)
MEKVAVDSGKWLPLSGGGGGGGGWRSGASVPSDFPAESFDDRRQKQVFVRGRMPSAAAVAGYVVLSVMSTIVVPRLYTELKCHHVAVACIVALVLAFCNTYVTSVIDVNIATTFGKVVVLAFGSWVGLKDSGVVTGLAAYGVIVATVSTGSDLTQAFRTGYLTLTSLRATFLSQAAGMALG

SEQ ID NO: 22002 - protein, 128 aa, Oryza sativa (japonica cultivar-group)
MFNYPPKSATIYGNKETSNIAEICHPFSSATNAGDAYVADVGRFYSVLAQSEGNYAEALQNYYEATRLEIDPYDRSYILYNIGLIHTNNGEHTKALEYYFRALERNPFLPQAFNNMAVICHYVRLSPL

SEQ ID NO: 22003 - protein, 218 aa, Oryza sativa (japonica cultivar-group)
MGNGLSPCMHLPATAAAGVKLVYWGGQTRMLDDDGGVCAVAGDVTAELPGDHVVCAADSFYVGLPIPVVSAGEELMAGRTYFVLPAERFSCFKVLTAAALASLSPAPSKKVSVAGPGQCPFEYVKGEGGATLIRVLPEFIEKVISCDENGGGARRRKPSTTATATATELCSTPELKRHYALLMGRRNQPWSPRLETISECNKTRKLLLRTLARLLSSR

SEQ ID NO: 22004 - protein, 390 aa, Oryza sativa (japonica cultivar-group)
MEQMNTAAAKSIRCRAAVSRVAGQPLEMEEVEVAPPRAHEVRIKILCTSICHTDITFWRMEGNHPSIFGHEAVGVVESVGEHVQEVAVGDMVVPVFAAQCSECPDCLSDRSNLCSKLPNVAGLMPRDRTTRFSSVSTGEPIRHFLSVSSFAEYTVVDITHIVKLDVGFPPAMACLLSCGISTGVGAAWKVAAVEPGSSVAVFGLGAVGLAVAQGARMRGAKRIIGVDLNPDKFDVGKRLGMTDFINPNDTGGKTVSEVIKEMTGGGGADYCFECIGSTSVMAEAFQSTRNGWGKTILLGVSGNKAPISIPSHEILRGRSVIGSLFGGIKPKNDIPMLAQKYLDKELELEEFITHEMGFEEINRAFELLTQGKSIRCIIWMDGAKVIDNGE

SEQ ID NO: 22005 - protein, 143 aa, Oryza sativa (japonica cultivar-group)
MFGLYIVCSIWLSASAKKSGDVTELQIGVKYKPESCTLQAHKGDKIKVHYRGSLTDGSVFDSSYDRGDPFEFTLGNGQVIKGWDQGLLGMCVGEKRKLKIPAKMGYGERGSPPKIPGGATLIFDTELIAVNGKTTGGASNSEL

SEQ ID NO: 22006 - protein, 420 aa, Oryza sativa (japonica cultivar-group)
MDDAGRASAPAVVTLPATAAATDEPSHDPAALYGEGMWQQMTMSGSGAMQPGPYPERSGEPDCTYYLRTGLCRMKGEYPERMGQPECQYYLKTGTCKFGPTCKFHHPREKAGIAGRVQLNTLGYPLRPSEKECAYYLKTGQCKYGNTCKFHHPELFNAMASSRGSPIYPSVHSSATAGPPYTGTMASWAFPRGSFIPSPRWQNPSNYAPMIVPQGLVQVPSWNSYTGQMMPVSSSESRLQSPGAQQTYGTSQQVDASAGNQGMLSPYRSSSYPVPQYALQRENVFPERPDQPECQYYMKTGDCKFGAVCKFHHPRVRSMPTPDCVLSPVGLPLRPGEELCKFYSRYGICKFGANCKFDHPTMAPPMGVYAYGSASTNVPMIVGIGFSGSWQQGAKDPTDSSGAPPNTHVLGEDPIPYRKI

SEQ ID NO: 22007 - protein, 253 aa, Oryza sativa (japonica cultivar-group)
MAATAASSSSLPPNKVVVVSPPLPLSLGADIVSAVIVIVGAASIPDTPNSFTLRGRLNEARDLLWRIRRAGAATADVDAELKDIVRVAEEDRRYESGALWRLLRCKYRPHLPATRVLIGASVTVAFLLLLAFFFIILPRGGTPPEVVSSSKEGGIRGRRDGGGVFQVESYGERCEHVAEEDGHDRRRFPRGYVDYLYLFDCVFGVERRVLGYGVMAAWLAVLFYLLGDTAAVYFCSSLKGLSWLLRLSRRSPA

SEQ ID NO: 22008 - protein, 502 aa, Oryza sativa (japonica cultivar-group)
MARAEAAAALEFTPTWIVAAICSLIVLISLAAERCLHYLGKTLKRKNQKALFEALLKVKEELMLLGFISLLLTVSQGILQKTCVPPKWTNYLLPCRKMEDQSKQRGPSEAHFVAAGVLGHLGRRLLADGGTGADHCQNKGKVPLLSLEALHQLHIFIFVLAITHVIFSALTMLLGGAKIHQWKHWENDIQKDVAQNAPKKVTHVHQFEFIRERFKGIGKDSIILSWLHSFVKQFSGSVTKSDYITMRLGFIQTHCRANPKFDFHRYMVRALEADFKKVVGISWYLWIFVMIFLLLNVNGWHTYFWISFVPLLLLLAVGTKLEHVITQLAHEVAEKHSAIEGDLVVNPSDEHFWFGRPKVILYLIHFILFQNAFEIAFFFWILTTYGFNSCIMDHVPFILTRLIIGAIVQILCSYSTLPIYAIVTQMGSFFKKEIFDEHVQQGLVGWAQKAKKRKGLKESNGAMAGAGSTNGSSQPSSILQMVRRAAASEEGSSNGGDMRTNQ

SEQ ID NO: 22009 - protein, 323 aa, Oryza sativa (japonica cultivar-group)
MAGRSELVVSFGEMLIDFVPTVAGVSLAEAPAFVKAPGGAPANVAIAVARLGGGAAFVGKLGDDEFGRMLAAILRDNGVDDGGVVFDAGARTALAFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 22010 - protein, 352 aa, Oryza sativa (japonica cultivar-group)
MGNRSFDLSCSLRKEEENGTNLSPFVRKLFKEVLPGEHNFVATLIEGRDQKKRPTQFGMNQVLQPFDSVKFNFTKVSPEEVIFTFKESQNDSVKYFDNVPHAVAASPTAILINVSPIGYCHVLLIPRIQDCLPQRVDKESFLLAMYVASEAKDPFFRVGYNSLGGFATINHLHFQAYYLKVQYPVEKALTEKLTTLGNGVSIIQLVQYPVSGFVFEGGACLEDLSDVVSKVCIFLQENNKPFNALISESGKRVFLLPQQWITNILSPSDSIDQCYAEKQALGRVSQEFLDMRINPAVWELSGHLVLKRRKDYDEASEATICRFLVEASLSESEFQELKSCILEFLSSAAPEE

SEQ ID NO: 22011 - protein, 326 aa, Oryza sativa (japonica cultivar-group)
MAATGDSSGALVCVTGGSGFIGSWLVRLLLDRGYTVHATVKNLQDDGETRHLQALDGADTRLRLFQMDLLDPASITPAVDGAHGVFHLASPLTLHPTQDPEGELLKPAVSGTLNVLRAAKDCGVARVMLMASQVAIVPNPEWPADKVIDDDSWADVELLKKHQHWYNVSKTLAEKAAWDFAAKEGLQLVALNPGLVLGPMLMPSPTSSLHMLLQILGGQRFDIDDFYIGCVDVRDVAQSAVVIYENTSAQGRHLCIESIERLIDFHDKLAELYPEFPIHRIQEDKQGWVVRSKAASKKLIDLGVHFIPFEKTIRDSVDCLRSKGYI

SEQ ID NO: 22012 - protein, 389 aa, Oryza sativa (japonica cultivar-group)
MEPPQLDGQCGGEPPASVEGVVFMPYATADSSLRVMAGQAEGFGRHAIGGLHGDVYHVTTLEGTLFIFHLPASNNVANGSRSPDDGDGSLREGCRRREPLWIVFDVSGTIHLSTGLRVSSYKTIDGRGQRVTLSGKGLQLRECEHVIVCNLEVEGCRGHDADAVAVKPGSRHVWIDRCGLRGCGDGLLDVTRGSTDVTVSRCRFSAHDKAVLIGGSAGHVEDRAIRVTIHHCLFDGTRQRHPRVRFGRVHLYNNYTRGWGIYAVCASVESQIVSQCNIYEAGEKKKVFKYMIEQAADRDQSSTGFIRSEGDLFLNGAEECTAQDSEAAADELWDFKIQELDFYQSCSVQPASMALKELLECFTGWQPVPLPEDTCLEEETDSAPADTTA

SEQ ID NO: 22013 - protein, 255 aa, Oryza sativa (japonica cultivar-group)
MAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDFVADKIAYALSQGIKVIACIGETLEQREAGTTMEVVAAQTKAIAEKISDWTNVVLAYEPVWAIGTGKVATPAQAQEVHDGLRKWLVTNVSPAVAESTRIIYRGSVNGANCKELAAKPDVDGFLVGGASLKPEFVDIIKSATVKSSA

SEQ ID NO: 22014 - protein, 417 aa, Oryza sativa (japonica cultivar-group)
MEHLPVEVIGNILAHLSAARDVMVASGVCRKWRTACRKHLHSLSFNSDDFPRDMTTRQLEIVITQTIFQTMGLQCLSIHIDRTHEFSAAPVIAWLMYTRETLRSLSYNVRTNPNVNILEKCGRQKLEVLDLDHNTITGVEPSYQRFTCLKSLSLRHVSISALDLSLLVAACPKIESLALDFLEVVTSDPQSTMELTSHTLKSLFAKSVGVDKIILDTDNLEVLNLNALNLDLFELIGKGTLKHLKIDDVSVTHMDIGESTDHLEVVDVSNFTIVRPKLYSMISRASNLRMLRFWGVVFDDEDEIVDSETIAVSFPLLRHLSLSYELRDGLLHYSLQGSSPLDNVSVLELGWTVISEHFGPWVFGMIERCPNLKKLVIHGVLSEAKTREERQMLASFTSFIVCLMRKYVHVDVQFEYE

SEQ ID NO: 22015 - protein, 188 aa, Oryza sativa (japonica cultivar-group)
MAAAAAAAAAEEEIAVKEPLDLIRLSLDERIYVKLRSDRELRGKLHAYDQHLNMILGDVEEIVTTVEIDDETYEEIVRKNTDSKRQRRRRDARAMGVTKEDVEAAITSSLSPSSLVVTDTSGGCGASYEIEVVSEKFEGKRLLERHRMVNTALAPHMAEIHAVSIKKALTPAQAQPQPEPAADKAPQA

SEQ ID NO: 22016 - protein, 329 aa, Oryza sativa (japonica cultivar-group)
MELATHDLAALGAADLVRVSASIPRAAPRTFALLTAGLVFPLSAAVLVHSLFTHPIILRLQGANGDYSSSDSAQWLKLFAYQFLYLILLFTLSLLSTAAAVFTVASLYAAKPASIASSLAALPPILPRLLRTFLWVSLLMLAYHLVFALTVLLLLLLFAPSSSPPSLPFVLILVVVVFVFLAIHVYISALWHLASVISVLEPLCGLAAMTKSKQLLQGRTRTAGVLVVSYFAACGVTAVLFRAAVVKGRGEEGSLGLSLPGRVLAGAVLVSVLVCVNLLGLLVQSVFYYACKAFHNQQIDRSALYEHLGGYLGEYVPLKSNIQMENLDA

SEQ ID NO: 22017 - protein, 454 aa, Oryza sativa (japonica cultivar-group)
MDPSRPLLGRGALITSSAHAAAALLLVAFLFLTLRNLPISLSPPTAALTPTTSHLEQQDQASCDTTSTLDCADPQLFHLMMRRAIDAFPDVHFNRFGRPVPGDPPSSSCDMAWRARSTASANYKDYRRFSVARDPVTCAYSVTSIGEYHSGPLARKPRRGGTNATAPPPPPALSRSQFAAGKYLSYLGGGDRCKPMPHYLRSLLCSIAEARYLNRTLVLDLSVCLAAAYAGGMPEEGKRLAFYIDIEHLQSVVGIVEHKRFWEDWDKWGAQGQLGVRIIEDSRVAPTKFSKSRDPLIVRKFGDVEPGNYWYNVCEGEAEHVLRPPQGAIRTAPSLMDIVDGIISRMQVDFDSVHVGGNDGNLRRRIEERLNGGGRQVYVAGEGINVVLLDALKAKYSSVHYLDAFEELWARDSKWFLEMKRLNGGVPVEFDGYMRELVDREVFLKGKKKVEVLV

SEQ ID NO: 22018 - protein, 501 aa, Oryza sativa (japonica cultivar-group)
MGNCCPGSGDAEPASSDASTGNGSSSFKAGASPSSAPAQNKPPAPIGPVLGRPMEDVRSIYTIGKELGRGQFGVTSLCTHKATGQKFACKTIAKRKLSTKEDVEDVRREVQIMYHLAGQPNVVELKGAYEDKQSVHLVMELCAGGELFDRIIAKGHYTERAAASLLRTIVEIIHTCHSLGVIHRDLKPENFLLLSKDEDAPLKATDFGLSVFKDIVGSAYYIAPEVLKRSYGPEADIWSVGVILYILLCESEHGIFNSILRGQVDFTSDPWPRISASAKDLVRKMLNSDPKKRISAYEVLNHPWIKEDGEAPDTPLDNAVMNRLKQFRAMNQFKKAALRVIAGCLSEEEIRGLKEMFKSMDSDNSGTITVDELRKGLSKQGTKLTEAEVQQLMEAADADGNGTIDYDEFITATMHMNRMDREEHLYTAFQYFDKDNSGCISKEELEQALREKGLLDGRDIKDIISEVDADNDGRIDYSEFAAMMRKGNPEANPKKRRDVVI

SEQ ID NO: 22019 - protein, 189 aa, Oryza sativa (japonica cultivar-group)
MGAGALGVVAMVAAAVVVAMAGANSEGDALSALRRSLRDPGGVLQSWDPTLVNPCTWFHVTCDRDNRVTRLDLGNLNLSGHLVPELGKLDHLQYLELYKNNIQGTIPSELGNLKNLISLDLYKNNISGTIPPTLGKLTSLVFFDVSSNDLCGTIPTSGPFEHIPLSNFEKNPRLEGPELQGLAVYDTNC

SEQ ID NO: 22020 - protein, 451 aa, Oryza sativa (japonica cultivar-group)
MGGILVPYVCGACGPGRTGGKRGFAIRGSEATKSRHDAPQSPASTVARGVGGVPGASWGWFFQAAAGSPELDPAEERISGKGAAKLLDGRLVVALRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNEQLQSCLE

SEQ ID NO: 22021 - protein, 316 aa, Oryza sativa (japonica cultivar-group)
MSSSATGVNVSDRPISPDTTRVAWVGTGVMGQSMAGHLLAAGYALTVYNRTASKAEGLVSRGATLAESPRAAAAAADVIFLMVGFPSDVRSTSLDPSTGALAGLAPGGLLVDMTTSDPTLAAEIAEAAAAKSCAAVDAPVSGGDRGARSATLSIFAGGDAAVVARLAPLFKLMGNALYMGGPGAGQRAKLGNQIAIASTMVGLVEGMVYAHKAGLDVAKWLEAISTGAAGSKSLDLYGKRMLERDMAAGFYVRHFVKDLGICLSECQAMGLALPGLALAHQLYVSLLAHGEGGLGTQALILAIERLNNTCLDKKPE

SEQ ID NO: 22022 - protein, 360 aa, Oryza sativa (japonica cultivar-group)
MWWRAARARRRIAGARAASTSAAAAGEKSCRAVVVPRFGGPEVLEVRQGVPVPDLKPGDVLVRARAVSINPLDLRMRSGYGRSIFEPVLPLIIGRDISGEVAATGTSVSSFTIGQEVFGALHPTAIRGTYTDYAILSQDELTSKPSTLSHVEASAIPFAALTAWRALHGTARISEGQRVLVIGGGGAVGLAAVQLAVAAGCSVSATCGTKSIEQVLAAGAEKAIDYTAEDTESAVKGKFDAVLDTIGVPETERIGINVLRRGGHYMTLQGEAAALADRYGLAVGLPAATAVLLKKQMQYRYSHGIDYWWTYMRADSEGLHEIQRLSGAGKLQIPVEKTFPISKEYMKGEKHDSIPVALVH

SEQ ID NO: 22023 - protein, 415 aa, Oryza sativa (japonica cultivar-group)
MRQAAGHEGDRRRRQGFYYRWGRAVADGRARWRRSSAAGDARWSSAEDGGWRLVRATSVGVKRRWVEWAAEAEKKERGVVSRWEASLDKDAERSASAYSEPMDLTIEWFIFRVSAWNGLTTTTTDFLSSRDTTLAGGWPAGGEKAGGVMRERRRTSVAGDGRRRGSRPPHRVGRRPADVRDVGDDDSDVHYTSPGGARNQEYLTIGVDDRPLFHGRTPIQLYADFMKRFRENMAGFLDSGLIVDIRGWAWPCKAKVGNSLTSDKYLEENFRVAATEAGHPKWELPDAAAGEYNDTPEDTFFFTADGGTYLTEAGRFFLTWYSNKLVEHGDKILDEMNMGPAGLLTPRGLLSTRQPAQRSERERERGARSGRLLSRQPALYARGAVISVACGATDAATPCGSTSRARMRGGSTPAR

SEQ ID NO: 22024 - protein, 389 aa, Oryza sativa (japonica cultivar-group)
MDLQDPAADAVAAEPLTVAETDDQPPPPAPPLEAEGVVVAEEDPLPHPPLEVVEEDVAPVVAEAGAAAVPMEPSEAGAGGVVLTDELCDRIVKQVEYYFSDENLPTDEFLIKFVKKNKQGFVPIGVIASFRRMKKLSQDLSIIEAALRTSSKLVVSPDGKRVRRLHPLPNNELNDVKKRIVVVENLPSDFSMESIHAKFETVGKIAKITIHDQHSVGESATIKNHDIMLSNKAITLNDGSNWRTGMKVRLAKRTVGSGKHNQSSKENQAIQGQPSKVEQQMVSEKNGGTDSVESAFDNENVNSNISHEDMHQHQKVNAKGGRKGRYKSQGRGQIQQNTSGQGHVSSPATSGSDHVNKPIPGPRMPDGTRGFTMGRGKSPTFQKGDNAEE

SEQ ID NO: 22025 - protein, 225 aa, Oryza sativa (japonica cultivar-group)
MSADELRLDLEELRRLEGLAKRPRVLSALANEIRAVDAKLAKATEPQAPQAVAAGSPPVVAAAAAPAPAAAAGVSYVTLGSFSWDQDAEKIKIYVFLEGVEQDKVETTFKPMSVDTKFHDVKGKNYRCAIPKLHKEIVPEKCKVLVKPTKIIVTLYKASKGNWLDLHFKEDKFKPSMAKEKDPMSGIMDLMKNMYEEGDEDMKRTIAKAWSDARSGKTADSPLME

SEQ ID NO: 22026 - protein, 396 aa, Oryza sativa (japonica cultivar-group)
MEGHEGGEEEGLGDQFERLPDEVLLDVFGRIGDVKALGRCALVSRRFHALVPLVDSVFVRVDCVISDDPPPSSAGSAQAAAAAEGGPPAARGRGALAHLARLVLGGIVRPIQALGQILSPAAATVSRRSAAPPAAPAPAAADVSHHSPSEVLRSFKELRRLHIELPTGELGIEDGVLLKWKADFGSTLGSCVILGASSVTSKPPPPPAAPPPTAADSSAASPDSSREPDELGNIPESLYTNGGLKLRVVWTISSLIAASARHYLLQPIIADHSTLESLDLTDADGQGVLTMDKRQLQELRVRPVSASGNSHRTLMPALSMRLWYAPHIELPGGQLLKGATLVAIRPSEDVLREGGGIEVAGPTGASWILDAFEEPYRTAAQVLLKRRTYSLEMNSF

SEQ ID NO: 22027 - protein, 215 aa, Oryza sativa (japonica cultivar-group)
MVNTTAGVKCGGGGAALPLSTLNHVSLVCRSLSTSLTFYRDFLGFVSVRRPGSFDFDGAWLFNYGIGIHLLQAEDPESMPPNKEINPKDNHISFTCESMEAVQRRLKEMGVRYVQRRVEEGGVYVDQIFFHDPDGFMIEICTCDKLPVVPLDAAAAHSIFAGRSPPPPVACKIRPVKQPSATKLGSVAAGGCVGEVIVVDAINGAAAAGGGGAMS

SEQ ID NO: 22028 - protein, 487 aa, Oryza sativa (japonica cultivar-group)
MKASSSSQGQSPRTPSPRATSATAEHTRSSSEPWLVAAAVASTCDDSCVNDVENFARTVAAAKSRQLVGSSAASRPDMLASVLSHYAAKWLPDVVAASSSSSSPATSASGRFLPPESPTATWLKKRLLLESLVAALPPDPPAPAGGGGAADDGITCDFLLKLLRAGSMVGADAALLQELESRAARRLDQATLGAVMIPAFGHGYACGTLLDVPLVLRLVRGFLKDAGAGGGGAAKAGGGGGAAAARVARLVDAYLAEAALEAGLRPAEFEELARAVPAHARPADDALYRAVDTYLKAHASTSKEERKSLCRLIDARKLTAEAAAHAVQNDRLPVRSVLQVLFSEHGKLNRLAELSGGASSFGAPSPAFDLPGARCPSKREVLAQHHELRRLREDFARLQVQCSALQAQVDRLSTERRRRGGGGSGGGGGFFKWSTFWFGGMSADVARVEDSESGIERRTPASGKKGRGGAAGAAAATPTPKWRKSMS

SEQ ID NO: 22029 - protein, 184 aa, Oryza sativa (japonica cultivar-group)
MDEETQKKVESTVLEILRGSDMESLTEFKVRTAAADRLGIDLSIPDRKRFVRRVVEGYLESLSQEDEQEQQQEQAGGAGEEGKDEQAEEEEEEEEEEEEERGGGTKREYDDEGDLILCRLSARRRVTLQEFKGKTLLSIREYYFKDGKELPAKGISLTVEQWEAFRDSVPAIEDAIKKLGESSD

SEQ ID NO: 22030 - protein, 318 aa, Oryza sativa (japonica cultivar-group)
MASLVQGVYVMERDRQWNRHGHDARAPAWWRFFHFEVREVLVDAADSSIFGAVYAFQPPWHLLDPAAAAAASAPHYVVAFRGTITKKASASRDLALDLQLVRNGLDRTSRFHAAMRTVHAVVAAAGHQHHHRVWLAGHSLGSAISTLAAKSMARAGVALPTFLFNAPFPSAPVERIGDRRVRQGVRIANSFVTAAAATLLHHGSGGGGYDAFAALARWVPNVFVNPGDPISAEYVGYFDHRKKMEDIGAGAVGRVATRNSVKDLLLGIGTAGGCEPLHLFPSAVLTVNRGASPDFKAAHGIHQWWRPDLALECAAHYY

SEQ ID NO: 22031 - protein, 380 aa, Oryza sativa (japonica cultivar-group)
MATLNMFDILGADDNDDPSQLLAAAAAAAQKAEAKKAAAAAAAPAGKAAQAASAAAKFPTKPAPPTQAAREARGGGAPSRGGFGRGERGRGRGGRGYGQNRDFGGDNANGYQGGYGGGYGDGAVAAGGEGDRERGPRAPFHGGRRGGYRNGEYGDDSERPPRRNYERHSGTGRGYEMKRDGAGRGNWGTATDEALAQETEEALKVEESAPIAEKQGEQDDAPTGEKDNKEGAANEEEEKEEDKEMTLEEFEKLREEKRKALLAFKAEERKVEVDKDLQSMQPLSTKKGNDEIFIKLGSDKDKKKENAERDERAKKSVSINEFLKPAEGERYYGGRGRGRGRGDRGGRGYGGGYQRGPYSTSAPSIEDQAQFPTLGGKPRA

SEQ ID NO: 22032 - protein, 168 aa, Oryza sativa (japonica cultivar-group)
MAALPLATAEVCDANADLIMNGELRALQPIFQIYGRRQVFAGPIVTLKVYEDNVLIREFLEEKGHGRVLVVDGGGSLRCAILGGNPVQQAQNNGWAGIVVNGCIRDVDEINGCDIGVRALNSHPMKANKKGIGEKHVPVTIAGTRICDGEWLYADTDGILISRTELTV

SEQ ID NO: 22033 - protein, 348 aa, Oryza sativa (japonica cultivar-group)
MAPLLSPPLLADSVAKFHCSSTPTPCSGSVRRWAITRFAGAGRRRDWHRRRRTSGRGVLTVSAVAAESPSSGGGVAEDYYAVLGVMPDATPQQIKKAYYNCMKACHPDLSGNDPDVTNFCMFINEVYTVLTDPIQRAVYDEIHGYAATATNPFFDDSAPRDHVFVDEFSCIGIINYYITKQEFILVYVLFGCKNCANVCSKVFEIEEDFGRARVYNQSGNAELIQEAIDTCPVDCIHWTSAAQLSLLEDEMRRVERVNVGLMLAGMGSSVDVFRMEKVRRRVSQEDSGKGSSWSDVWGAPTRYRKNEDEARERAKRAAAAARRWREYSRKGADKPPTFKLPEAVSNKE

SEQ ID NO: 22034 - protein, 224 aa, Oryza sativa (japonica cultivar-group)
MAAAAAAAGYRAEEEYDYLFKVVLIGDSGVGKSNLLSRFARDEFSLETRSTIGVEFATKTVRVDDRLVKAQIWDTAGQERYRAITSAYYRGAVGALVVYDVTRRITFENAERWLKELRDHTDANIVVMLVGNKADLRHLRAVPAEDARAFAEAHGTFSMETSALEATNVEGAFTEVLAQIYRVVSRNALDIGDDPAAPPRGRTIDVSAKDDAVTPVNSSGCCSS

SEQ ID NO: 22035 - protein, 158 aa, Oryza sativa (japonica cultivar-group)
MAEKLGPEKRHAFVHNGQKVFEWDQTLEEVNMYIELPKGVPTKLFHCAIQATHVEVGIRGNPPYLNHDLTLPVKTDSSFWTIEDGEMHITLQKREKGKTWSSPIQGQGSLDPYAADQEQKRLMLQRFQEENPGFDFSQAQFTGTCPDPRTFMGGIRSD

SEQ ID NO: 22036 - protein, 2157 aa, Oryza sativa (japonica cultivar-group)
MSAAQGMAYKLRTDAAPTGAGRRARRSHSSVAAPYRAARLVQGGVSIEGGLVGGCQLTEERVAARPPRAAARDAEPVRPLSTLPESSIGLYDPSRERDSCGVGFVAELSGDYKRATVNDALEMLERMAHRGACGCEKNTGDGAGILVTKDAGFELPQPGEYAVGMVFLPIDEKRRERSKAEFQKVAESLGHVILGWRRVPTDNSDLGESALQTEPVIEQVFLTKSSSSEADFEQQLYILRRLSILSIRAALNLRRGGKRDFYMCSLSSRTIVYKGQLKPCQLKGYYYADLGHENFTSYMALVHSRFSTNTFPSWDRAQPMRVLGHNGEINTLKGNKNWMKAREGLLECEKLGLTKDQFSKILPIVDATSSDSGAFDGVLELLIRGGRSLPEAVMMMIPEAWQNDVNMEPEKKALYEFLSALMEPWDGPALISFTDGRYLGATLDRNGLRPGRFYVTHSGRVVMGSEVGVVDVPSKDVLRKGRLNPGMMLLVDFENHTVVDDEALKAQYSKAHPYGEWLKRQKIYLKDIVESVPETERVAPGISGSLTQKNEKKEHAGVNGIVTPLKAFGYTVEALEMLLLPMAKDGVEALGSMGNDTPLAVMSNREKLTFEYFKQMFAQVTNPPIDPIREKIVTSMECMIGPEGDLLETTEKQCNRLALEGPLVSIDEMEAIKKMNYRGWRSKVLDITYPKKSGRKGLEETLDRICTEARGAIKKGYTVLVLSDRGFSSDRVAVSSLLAVGAVHQHLVANLERTRVGLLVESAEPREVHHFCTLVGFGADAVCPYLAIEAIWCLQNDGKIPPNGDGKPYSKEELVKKYFYASNYGMMKVLAKMGISTLASYKGAQIFEALGLSSEVIRKCFDGTPSRIEGATFEMLARDALRLHELAFPSRAPPPGSADAKALPNPGDYHWRKNGEVHLNDPLAMAKLQEAARVNSRAAYKEYSRRIQELNKTCNLRGMLKFKDTADMISVDEVEPASEIVKRFVTGAMSYGSISLEAHTALAMAMNKLGGKSNTGEGGEQPSRMEPLANGSMNPKRSAIKQVASGRFGVSSYYLTNADELQIKMAQGAKPGEGGELPGHKVIGDIAVTRHSTAGVGLISPPPHHDIYSIEDLAQLIHDLKNSNPRARISVKLVSEAGVGVVASGVVKGHADHVLISGHDGGTGASRWTGIKNAGLPWELGLAETHQTLVANGLRGRAILQTDGQLKTGKDVAVACLLGAEEFGFSTAPLITLGCIMMRKCHTNTCPVGIATQDPVLREKFAGEPEHVINFFFMLAEELREIMSQLGFRTITEMVGRSDMLEVDPEVVKSNEKLENIDLSLILKPAAEIRPGAAQYCVEKQDHGLDMALDNKLIALSKAALEKEVRVFIETPIQNTNRAVGTMLSHEVTKRYHMKGLPAGTIHVKLTGSAGQSLGAFLCPGITLELEGDSNDYVGKGLSGGKIVVYPPRDSTFIPEDNIVIGNVALYGATIGEAYFNGMAAERFCVRNSGAQAVVEGIGDHGCEYMTGGTVVILGKTGRNFAAGMSGGIAYVYDIDGKFSVRCNHELVDLYHVEEEEDITTLKMMIEQHRLNTGSVVARDILSNFDTLLPKFVKVFPRDYKRVLDNMKAEKAAAKLAKEPKISNGVSVTTKKVQPEQSTNRPTRVSNAKKYRGFISYERESISYRDPNERVKDWKEVAIESVPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMVPRPPLQRTGKKVAIIGSGPAGLAAADQLNKMGHFVTVFERADRIGGLMMYGVPNMKTDKIEIVQRRVNLMAEEGITFVVNANVGSDPLYSIERLRSENDAVILACGATKPRDLGIPGRELSGVHFAMEFLHANTKSLLDSNLEDGRYISAKGKKVVVIGGGDTGTDCIGTSIRHGCTSIVNLELLTKPPSKRAADNPWPQWPRIFRVDYGHQEASSKFGNDPRTYEVLTKRFIGDENGNVKALEVVRVKWEKVDGRFQFKEIEGSNETIEADLVLLAMGFLGPEATIAEKLGLEKDNRSNFKAQFGNFATSVDGIFAAGDCRRGQSLVVWAITEGRQAAAAVDKYLSRNEQDAAEDITPSGAGFVQPVAA

SEQ ID NO: 22037 - protein, 113 aa, Oryza sativa (japonica cultivar-group)
MAAPATGGGISADVPILHSENLTSNVKSIYYSRTFLSIISGVVAGIWGFTGLMGFVFYLLVMMVASLGLLLKAKFSIHTYFDSWNRILIEGVFGGLMSFVLFWTFAYDIVHIF

SEQ ID NO: 22038 - protein, 286 aa, Oryza sativa (japonica cultivar-group)
MSVIDILTRVDAICQKYGRYDAEKLHGSGVAGEDPFARLYASVDADLNECLEKAEAAKQEKNRATVVALNAEIRGTKAKLLEEDLPKLQRLALKKVIDASLVLSPLLLCIASRYVDMQGGWCEELVPACTVLQRYLEWKLIYVGSAEDENYDQLLESVLVGPVNVGTYRFVLQADPPDPSKIRKEDIIGVIVLLLTCSYMGQEFIRVGYYVNNDNDDEQLREEPPAKLLIDRVQRNILADKPSVTKFPINFHPETSAGAGQEQQQQQQSGSPENHPNQGSKPNPDQ

SEQ ID NO: 22039 - protein, 474 aa, Oryza sativa (japonica cultivar-group)
MAIAVSGRWTRLRTLGRGASGAVVSLAEDGASGELFAVKTAAAAEAAMLRRERGMMSGLSSPHVVPCIGGGDGPDGSYNLFLEFAPGGSLANEVARDGGRLEERAIRVYAADVLRGLTYLHGMSLVHGDVKADNIVIGVDGLAKLADFGCAKTMDSERPVSGTPAFMAPEVARGEEQGPAADVWALGCTVIEMATGRAPWSDMDDVLAAVHRIGYTDAVPEVPVWLSAEAKDFLAMCFARNAGDRSTAAQLLEHPFVAFACHEVKAAQPKPRWVSPKSTLDAAFWESETDDEEEVDEITESLCDRIKSLACPVSALPDWDSDEGWIDLLGEQCEACDSEAARESIDVARSAPSKVSSAATVPAAEVVLVGGGCCPSNEADAFDQSIGGDIQAADRSIERRNKVCAGSDNDVLPFRLRLALLGPSRPSTAHIRKPPPNPRGRSALTASASISSPRRACVDVKRGVCVAPRPHRLT

SEQ ID NO: 22040 - protein, 387 aa, Oryza sativa (japonica cultivar-group)
MEAAVDGRWTRVRTLGRGASGAVVSLAADDRSGALFAVKSAAAAAAAEQLVREGRILSGLRSPHVLPCLGFRAEAGGECQLFLEFAPGGSLADVVARSGGRLDECAIRAYAADVARGLAYLHGMSLVHGDVKGRNVVVGADGRAKIADFGCARTVGSDRPIGGTPAFMAPEVARGEEQEPAADVWALGCTVIEMATGRAPWSDMEDILSAVRRIGYTDAVPEVPEWLSAEAKDFLARCFARNPRERWTSSQLLEHPFLASAGCSVKTGEAAPQWVSPKSTLDVAFWESDTDDEEDDMPASPAERIKALACPCSALPDWDSDEGWIQVLNESSEACDTAVAKVEAEGKGRVLIEALETINESSGGDAECVDPEGTYMQFAPSDQVRNC

SEQ ID NO: 22041 - protein, 389 aa, Oryza sativa (japonica cultivar-group)
MQKQLRRLRTLGRGASGAVVWLASDDASGELLAVKSAAGEGGAEQLRREGRVMSGLCSPHIVPCLGSRAAAGGEYQLFLEFAPGGSLADEAARSGGRLAERAISAYAADVARALAYLHGNSLVHGDVKARNIMVGADGRAKLADFGCARRTDSERPIGGTPAFMAPEVARGEEQGPAADVWALGCTIIEMATGRVPWSDMDDVFSAVHRIGYTDAVPEIPEWLSPEAKNFLSRCFTRNPSDRPTAAQLLEHPFLASASSDIDETAPKHGWVSPKSTLNAECWESDEDDEVEEGMSQSATKRISALAITCSALPDWDSEDGWIDLQSDPSEVSETPAPMVVTTADFGLWWEEALDAEIDLHFVDVDGDGYVTRTGEVHLPEEVFGRRRLL

SEQ ID NO: 22042 - protein, 388 aa, Oryza sativa (japonica cultivar-group)
MRHPGAGGGSGDAGFVRADQIDLKSLDEQLERHLGRPAERAASQHGGSGSRRGESARLGLGEEPPQAPHHQRRREDWEIDPAKLVIRGVIARGTFGTVHRGVYDGQDVAVKMLDWGEDGHRSEREISSLRAAFAQEVAVWHKLDHPNVTKFIGAIMGARDLNIQTEHGHFGMPSNICCVVVEYLAGGALKNFLIKNRRRKLAYKVVVQLALDLARGLSYLHSKKIVHRDVKTENMLLDKSRTVKIADFGVARIEASNPSDMTGETGTLGYMAPEVLNGHPYNRKCDVYSFGICLWEIYCCDMPYPDLSFSEVTSAVVRQNLRPEIPRCCPSSLANVMKRCWDANPDKRPAMAEVVSMLEAIDTSKGGGMIPTDQPQGCFSCFGRHRGP

SEQ ID NO: 22043 - protein, 466 aa, Saururus cernuus
FVGFKAGVKDYKLTYYTPDYETKDTDILAAFRVTPQPGVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEIIREAAKWSPELAAACEVWKEIKFEFEAMDTL

SEQ ID NO: 22044 - protein, 450 aa, Oryza sativa (japonica cultivar-group)
MDRPDETVKFPSCDAYFDTIQSKKKLPLSLQESLTAAFAQIPVSSFPDVPNGRVIEIPGDTSVLDAVRILSKHNIRAAPVLNPECGAPADWKGRYLGIIDYSAIILWVLENAEIAAVALSAGSATAAGVGMGAVGAVGVAALGATGPAAVAGLTAAAVGAAVAGGLTAEKGVAKDGLTAADHLGEDFYKVLLQQEPFKSTTVRSIVESYRWSPFVPITLDTSMLTVLLLLSKYRLRNVPVIEPDKPIIKNFITQTGVVKGLQQCKGRDWFDYISALPLSDLGLPFMSLDEVITVNSGDLILEAFKCMKDNKIGGVPVVEGPNKKLVGSVSIRDIRFLLLRPDLFSNFRQLTVMEFMKTIGSTVSDSGNGLVKPPLTCSPDASLGSVIDSIASRITHRIYVVDGDFEVVGVVTLRDVISCFIYEPPGYCDNYLASAMDKLEEKGAGSVDTS

SEQ ID NO: 22045 - protein, 502 aa, Oryza sativa (japonica cultivar-group)
MAAANGGDSKGFEVPKLEIKFTKLFINGRFVDAVSGKTFETRDPRTGEVIAKIAEGDKADIDLAVKAAREAFDHGPWPRMSGFARGRILHKFADLVEQHVEELAALDTVDAGKLFAMGKLVDIPGGANLLRYYAGAADKVHGETLKMARPCHGYTLKEPVGVVGHIVPWNYPTTMFFFKASPALAAGCTMVVKPAEQTPLSALFYAHLAKLAGVPDGVLNVVPGFGPTAGAAISSHMDIDKVSFTGSTEVGRLVMEAAAKSNLKPVSLELGGKSPVIVFDDADLDTAVNLVHMASYTNKGEICVAGSRIYVQEGIYDAFVKKATEMAKKSVVGDPFNPRVHQGPQIDKEQYEKILKYIDIGKREGATLVTGGKPCGENGYYIEPTIFTDVKEEMSIAQEEIFGPVMALMKFKTVEEAIQKANSTRYGLAAGIVTKNIDVANTVSRSIRAGAIWINCYLGFDPDVPFGGYKMSGFGKDMGMDALEKYLHTKAVVTPLYNTPWL

SEQ ID NO: 22046 - protein, 507 aa, Oryza sativa (japonica cultivar-group)
MGSTGDCGNGKAAAGGGGLVVPEIKFTKLFINGEFVDAASGKTFKTRDPRTGDVLAHIAEADKADVDLAVKAAREAFEHGKWPRMSGYERSRVMNKLADLVEQHADELAALDGADAGKLLTLGKIIDMPAAAQMMRYYAGAADKIHGESLRVAGKYQGYTLREPIGVVGVIIPWNFPTMMFFLKVSPALAAGCTIVVKPAEQTPLSALYYAHLAKLAGVPDGVINVVPGFGPTAGAALSSHMDVDSVAFTGSAEIGRAIMESAARSNLKNVSLELGGKSPMIVFDDADVDMAVSLSSLAVFFNKGEICVAGSRVYVQEGIYDEFVKKAVEAAKNWKVGDPFDAATNMGPQVDKVQFERVLKYIEIGKNEGATLLTGGKPTGDKGYYIEPTIFVDVKEEMTIAQEEIFGPVMSLMKFKTVEEAIEKANCTKYGLAAGIVTKNLNIANMVSRSVRAGTVWVNCYFAFDPDAPFGGYKMSGFGRDQGMVAMDKYLQVKTVITAVPDSPWY

SEQ ID NO: 22047 - protein, 254 aa, Oryza sativa (japonica cultivar-group)
MISPDAARNVVGIIGNVISFGLFLSPVPTFWRICKRKDVEQFKADPYLATLLNCMLWVFYGIPIVHPNSILVVTINGIGLIVEGTYLFIFFLYSPNKKRLRMLAVLGVELVFMLAVILGVLLSAHTHKKRSMIVGILCVFFGSIMYFSPLTIMGKVIKTKSVEYMPFFLSLVCFLNGVCWTAYALIRFDIYVTIPNGLGAIFGAIQLILYACYYRTTPKKTKAAKDVEMPSVISGPGAAATASGGSVVSVTVER

SEQ ID NO: 22048 - protein, 259 aa, Oryza sativa (japonica cultivar-group)
MISPDAARNVVGIIGNVISFGLFLAPVPTFWRICKRKDVEEFKADPYLATLLNCMLWVFYGIPVVHPNSILVVTINGIGLLVEGTYLLIFFLYSPNKKRLRMCAVLGVELVFMLAVILGVLLGAHTHEKRSMIVGILCVFFGSIMYFSPLTIMGKVIKTKSVEYMPFFLSLVCFLNGVCWTAYALIRFDIYVTIPNGLGALFGAIQLILYACYYRTTPKKTKAAKDVEMPSVVVSGTGAAAAAGGGNTGGGSVSVTVER

SEQ ID NO: 22049 - protein, 305 aa, Oryza sativa (japonica cultivar-group)
MEDFYDIKSSKVDDNQINLFGIFDGHGGSHAAEHLKKHLFENLLKHPSFITDTKSAISETYRKTDSDFLDAETNINREDGSTASTAIFVGNHIYVANVGDSRTVMSKAGKAIALSSDHKPNRKDERKRIENAGGVVTWSGTWRVGGVLAMSRAFGNRFLKRFVVAEPEVQEQEIDDDLEFLILASDGLWDVVSNEHAVAFVKAEEGPEAAARKLAEIAFARGSTDNITCIVVKFLHAKMAVDAASSIARVNCGTFGSLLRFAKPHLSHATIVRENCHWFHVGEEDKPPSLHNYRHLGEGSIATTA

SEQ ID NO: 22050 - protein, 180 aa, Oryza sativa (japonica cultivar-group)
MSAAEERGDRQERDDGEGGEEERRERGGVGGLVDRAKGFVAEKIAKIPKPDATLDRVSFKGVSRECITLHSHLDVNNPYSHRIPICELTYTFKSGDKVIASGTMPDPGWIAASGTTNLELPVKVPYDFIVSLIKDVSGDWDIDYVLEVGITIDLPVVGSFTIPLATEGEMKLPTFRDLLF

SEQ ID NO: 22051 - protein, 510 aa, Oryza sativa (japonica cultivar-group)
MGHTASRICTLLSILFVSCMLASAANDGLIRIALKKRPIMESIYGELVPKSGTVDHEVALGGFRERGSLKNGTQNHPLALKNFLNAQYFGEIGVGCPPQNFTVVFDTGSSNLWVPSAKCVFSLACYFHRKYESRSSSTYMENGTPASIHYGTGSIHGYYSQDQVTIGDLVVNNQEFIEATHEPGLTFLAAKFDGILGLGFKEISVEGADPVWYNMIQQSLVTDKVFSFWLNRNANDINGGEIVFGGADESHYKGDHTYTRVTRKAYWQFEMGDFLIGGRSTGICVDGCAVIADSGTSLIAGPIAAIAQIHAHIGATGVANEECKQVVARHGHEMLELLQDKTPPAQVCSKIGLCKSDGAHGISDGIESVLGETHKSADEVSDATCNACEMAVTWMQSEFVQNHTKEGKLEYANQLCGNMPSPVGSYVDCRHIGHLPNVAFSIGGRAFELTPEQYILKFGEGFLAHCMSGFTALDIPPPIGPLWILGDVFMGAYHTIFDYGKMRVGFADSA

SEQ ID NO: 22052 - protein, 452 aa, Oryza sativa (japonica cultivar-group)
MKEKDVMKIIPCKPGHINRMTRPKAPVVVCLVDYIHESPASALEKKHNFGRQVIKPLATCVGISFTVIMNNGLKRNKTIIQGEEAAAAAAAAVRDEIVESGTPPPSFASHEKEGRKMSSESEAAPGTGKLVCVTGASGYIASWLVRLLLARGYTVRATIRDTSDPKKTLHLRALDGANERLHLFEANLLEEGSFDAAVNGCDCVFHTASPFYHNVKDPKAELLDPAVKGTLNVLGSCKKASIRRVIVTSSMAAVAYNGKPRTPDVVVDETWFSVPEICEKHQQWYVLSKTLAEEAAWKFSKDNGFEIVTVNPAMVIGPLLQPSLNTSAEAILKLINGSSSTYPNFSFGWINVKDVALAHILAYEVPSANGRYCMVERVAHYSELVQIIREMYPNIPLPDKCADDKPSVPIYQVSKEKIKSLGLELTPLHTSIKETIESLKEKGFVTFDSSNL

SEQ ID NO: 22053 - protein, 478 aa, Oryza sativa (japonica cultivar-group)
MLLLKAVYRVVVNNFLALAAAAVAAVLLRRPDELAARLRAVSSPLHAATAAVLAAGVARLVRARRARGVYLVEYGCFRPRPCYRAPFATCLEHAHLMPYLVDEESVAFAIRLLERSGLGDETCVPDAYHYMPPDRSLRASRDESELVIFSAVDDVFARSALTPADIDVLIVNCSIFTPTPVFADMVVNRYKLRAEVQNVNLSGMGCSAGLVSVGLAKNLLQVSPPGTNVLIVSTEILSSQYYVGTERAMLLPNCLFRMGAAAMILSNSPDHARFRLGRVVRTVTAARDSDYRCVFQEEDEQGNTGIRLSKDLATTAGHALKSNIAAFGPLVLPASEQLLVAISFLKRKLKQLSGHAGKVRLYRPDFRTAFEHFCIHAGGRGVIDEVQHGLGLSDDDVEASRMTLHRFGNTSSSSVLYELAYLEAKGRMKRGDRVWMISFGAGFDCNSVAWECVKPAPDADGPWVDCIHRYPVQLPEIA

SEQ ID NO: 22054 - protein, 497 aa, Oryza sativa (japonica cultivar-group)
MFPWILALFPFLLLALHYLATNHRTPTTCKETRNHLSPPSPPRLPIIGHLHLIGDLPHVSLRELAHRYGPNLMLLHLGQVQNLVVSSPHAAEAVLRTHDHVFASRPHSLIGDILLYGPSDVGLSPYGEQWRRSRRIVTTHLLTNKKVRSYHVAREEEVHKVMTKVHELSTKGMGVDMFELFSTYSNDLICRLVSGKNFQGDKGRNKMFRQLFKANYVLLAGFNLEDYYPGLARLKAVSWVMCAKARNTRKLWDELLDEIINDRMSKQPCEHDRGNDDQDEMDFVDVLLLQERGITRDHLKAILVDMFQAGTETTSVVLVFAMAELMQKPHLMAKLQAELRTNIPKTNMTYLKAVIKETLRLHPPSPLLVPHLAMADCDIDGYTVRSGTRVIVNAWAIGRNSESWEAAEEFLPERFVDGGSAANRRICPGINFASASMEIILANLLYHFDWDVSAEAAIDKDGIDMAEAFGLSVQLKEKLLLVPVEYKGSVQDSAVIL

SEQ ID NO: 22055 - protein, 364 aa, Oryza sativa (japonica cultivar-group)
MGASCSSPFPPPPSPAESNAPSASAMHHPPHPAAGGGGPVMPYADADRTLRALAGAAEGFGRRAIGGLHGPLYRVTSLDDDGHGTLRQACRAHGPLWIVFDVSGDIHLRTYLRVTSHKTIDGRGQRVRLLGKGLQLKECRHVIVCNLQIEGGRGHDVDAIQIKPSSADIWIDRCSLADCDDGLVDITRGSTDVTVSRCRFSRHDKTMLVGADPSHTGDRGIRVTVHHCFFDGTRQRHPRVRFGRAHLYNNYTRGWGIYAVAAGVEAQVASQCNVYEAGAERKAVFRYVPERAADREEAEAGWVRSEGDAFLNGARPCLVDGGDAAVFRPEEYYERWTMEAASPALKEVVQLCAGWQPVPRPPGE

SEQ ID NO: 22056 - protein, 482 aa, Oryza sativa (japonica cultivar-group)
MEKKTKLVEEEDGCYYYDYGGYGDGVVDDEGRATELRPMALSRPHTQAFHLAWMSLFACFFAAFAAPPILPAMRPALVLAPSDASAAAVASLSATLVGRLAMGPACDLLGPRRASGVASLVCALALALAAVFASSPAGFVALRFVAGLSLANFVANQHWMSRIFAPSAVGLANAVAAGWANVGSAAAQVVMPVAYDAVVLRLGVPVTVAWRVTYLLPCAMLVTTGLAVLAFPYDLPGGGGGRCPGGGGGRRRSFWAVVRGGVGDYRAWLLGLTYGHCYGVELIMENVAADFFRRRFRLPMEAAGAAAACFGAMNAVARPAGGVASDEVARRFGMRGRLWALWAVQSAGAALCVLVGRMGAAEAPSLAATVAVMVACAAFVQAASGLTFGIVPFVCKRSLGVVSGMTASGGAVGAIVTNRLFFSGSRYTVEEAISCTGITSLLCTLPVALIHFRRQGGMFCGPSATIDGDGDVDDDDDYMLLK

SEQ ID NO: 22057 - protein, 512 aa, Oryza sativa (japonica cultivar-group)
MENAGAGDGAPKHYPGKMTVFVFIACLVASSGGLIFGYDIGISGGVTSMDPFLSRFFPSVYAKEKEVVDTNQYCKFDSEPLTLFTSSLYLAALIASLFASVITRKLGRKMTMLGGGFIFLIGAVLNGAAVNVAMLIIGRILLGIGVGFSIQAVPLYLSEMAPAKMRGMLNIIFQLMITVGILFANLINYFTDKIAGGWGWRVSLGLAAVPAVIMTVGSILLPDTPNSLLSRGKENEARTMLRRIRGTEDIGPEYDDLVAASEATKAIENPWRTLLERRYRPQLVMSVLIPTLQQLTGINVVMFYAPVLFKTIGFGGTASLMSAVITGLVNMFATFVSIATVDRFGRRVLFIQGGIQMIIAQFILGTLIAVKFGTAGVANISQGYAIVVVLFICLFVSAFAWSWGPLGWLVPSEIFPLEIRSAAQSVVVVFNMAFTFFIAQIFLMMLCRLKFGLFFFFGAMELIMTGFVLVFLPETKGIPIEEMDRIWGEHWYWSRFVGAGRNRVMQMASTNV

SEQ ID NO: 22058 - protein, 159 aa, Oryza sativa (japonica cultivar-group)
MDAAGAGAGGKLKKGAAGRKAGGPRKKAVSRSVKAGLQFPVGRIGRYLKKGRYAQRIGTGAPVYLAAVLEYLAAEVLELAGNAARDNKKNRIIPRHVLLAIRNDEELGKLLAGVTIAHGGVLPNINPVLLPKKTAEKAAAAGKEAKSPKKAAGKSPKKA

SEQ ID NO: 22059 - protein, 431 aa, Oryza sativa (japonica cultivar-group)
MIIYPGFVLGIFMGGRLAGVVIGLVVGTGVLALSLVLTILLRRWKRGIQKKIRRAYFRKNKGLVLERLISSDESVAHSTKIFSLEELERAPDHFNSTRILGRGGHGIVYKGILSDQRVVAIKRSKIVEQGEIDQFVNEVAILSQIIHRNVVKLFGCCFESEVPLLVYEFISNGTLYDILHGDMSTECSLKWDDRVRISLETASALAYLHCAASIPIFHKDVKSANILLNDNFTTKVSDFGASRSISIDETHVVTIVQGTFGYLDPEYYHTGQLTAKSDVYSFGVILVELLTRKKPIFLNCSGEKQNLCHYFLQSLRDKTTTDMLDSQVVEEGNLGEIDEFVSLAEACLRLRGEDRPTMKEVESRLQLLRANITKKIQDESQKNVEAMQLFPSVYDSTSFTQNVDIGMDADSLTQLASTCHTMEQELVSLTR

SEQ ID NO: 22060 - protein, 397 aa, Oryza sativa (japonica cultivar-group)
MAVACLPEDGGEVVLVREFDGGRDRPGVELVERACEVGPSGGKLCLFTDLLGDPLCRVRHSPAYLMLVAEAVGGPLGTEIVGVVRGCVKTVACGRSQLFSKVAYLLGLRVSPRHRRRGIGRRLVERMEEWFREMGAEYAYVATDRDNEPSVRLFTGACGYAKFRTPSVLVHPVFGHDLAPSRRAAVVRLDAREAELLYRRRLGSVEFFPRDIDAVLSNALSLGTFLAVPRGTRWRGVEGFLASPPASWAVASLWNCKDAFRLEVRGAPRLWRAAARATRAADRAAPWLGIPSIPNLFEPFGLHFVYGLGGGGPAAARMARALFRHAHNVARRGGARVVATEVGACEPLRAGVPHWPRLGADDLWCIKRLADGYGDGALGDWSKAPPGTSIFVDPREF

SEQ ID NO: 22061 - protein, 184 aa, Physcomitrella patens subsp. patens
MASAVASTVVAPVSVTVASSSVAASRESSSVKAFSGLKSATLFTSKSQQLSSVQNGSRVQCMQVWNPIGQPKFETFSYLPPLSDDQIARQVDYMIQQNLIPCIEFDTVGAVSRTNFSGSGSSGYYDGRYWTMWKLPMFGCTDSSQVLREIQECKTSYPSCWVRVLGFDSKKQVQICGFLVARPN

SEQ ID NO: 22062 - protein, 201 aa, Chlamydomonas reinhardtii
MLLTRKNVAVRPARAARRDVRAMSLLGNLFGGGSKPTSSTSNFHQLSALDIDKKNVDFKSLNNRVVLVVNVASKCGLTAANYKEFATLLGKYPATDLTIVAFPCNQFGGQEPGTNAEIKAFASARGFSGAGALLMDKVDVNGANASPVYNFLKVAAGDTSDIGWNFGKFLVRPDGTVFGRYAPTTGPLSLEKYIVELINSR

SEQ ID NO: 22063 - protein, 501 aa, Arabidopsis thaliana
MGVFSNLRGPKIGLTHEELPVVANGSTSSSSSPSSFKRKVSTFLPICVALVVIIEIGFLCRLDNASLVDTLTHFFTKSSSDLKVGSGIERCQEWLERVDSVTYSRDFTKDPIFISGSNKDFKSCSVDCVMGFTSDKKPDAAFGLSHQPGTLSIIRSMESAQYYQENNLAQARRKGYDIVMTTSLSSGVPVEYFSWAEYDIMAPVQPKTEKALAAAFISNCAARNFRLQALEALMKTNVKIDSYGGCHRNRDGSVEKVEALKHYKFSLAFENTNEEDYVTEKFFQSLVAGSVPVVVGAPNIEEFAPSPDSFLHIKQMDDVKAVAKKMKYLADNPDAYNQTLRWKHEGPSDSFKALIDMAAVHSSCRLCIFVATRIREQEEKSPEFKRRPCKRTRGSETVYHLYVRERGRFDMESIFLKDGNLTLEALESAVLAKFMSLRYEPIWKKERPASLRGDGKLRVHGIYPIGLTQRQALYNFKFEGNSSLSTHIQRNPCPKFEVVFV

SEQ ID NO: 22064 - protein, 457 aa, Listeria monocytogenes
MAKAKRTTKFVCQACGYESAKWMGKCPNCNEWNQMVKALEPSKKSRSAFNHTGEPSKATPITQIASETEKRVQTSMPELNRVLGGSVVPGSMVLVGGDPGIGKSTLLLQVSAQLTLTNKKVLYISGEESIKRTKLRAERLQVSGDNLYVYAETNLEAVQETIDFVKPDFVVIDSIQTVYHPDVTSAAGSVSQVRECSATLMRIAKMQNIAIFIVGHVTKEGAIAGAPLLEHMVDTVLYFEGERPHAYRILRAVKNPFGSPIEMGIFEMRDVGLVEVANPSEVFLEERLESASRSTVVASMEGTRPVLVEIQALVSPTMFGNAKRMATGIDYNKVSLIMAVLEKRVGLMLQNQDAYLKAAGGVKLDEPAVDLAVAVSVASSYRDKPTRSTDCFIGELGLTGEICRVARIEQRVQEAAKLGFKRIFIPKNNEGNWKIPKDVQVVGVETIGEALKKALPD

SEQ ID NO: 22065 - protein, 377 aa, Lilium hybrid cv. 'Star Gazer'
MENVKGPVVVTGASGYVGSWLVMKLLQYGYAIRATVRDPRDLRKTKPLLDIPGADERLTIWKADLSEDASFDEAINGCTGVYHVATPMDFDSKDPENEVIQPTINGVLGIMKSCKKAGTVKRVIFTSSAGTVNVQENQMPEYDESSWSDVDFCRRVKMTGWMYFVSKTLAEKAAWEFAKENDIQLISIIPTLVVGPFITSTMPPSMLTALSLITGNEAHYSILKQIQLVHLDDVCKAHIFLFENPEASGRYICSSYDATIYDLARKIKDRYPQYAIPQKFEGIDDQIKPVHFSSKKLMDLGFKYQYTFEEMFDEGIRSCIEKKLIPHQTQERYYVHDELDLGCSKMTNDKLDLGGSKLNSMDEMVRGHNEQVSVALQ

SEQ ID NO: 22066 - protein, 123 aa, Arabis holboellii
AVLIQILNVVAFCHLQGVVHRDLKPENFLYASKEENSQLKVIDFGLSDFVRPDERLNDIVGSAYYVAPEVLHRSYTTEADVWSIGVIAYILLCGSRPFWARTESGVFRAVLKADPSFDEPPWP

SEQ ID NO: 22067 - protein, 123 aa, Arabis holboellii
AVLIQILNVVAFCHLQGVVHRDLKPENFLYTSKEENSQLKVIDFGLSDFVRPDERLDDIVGSAYYVAPEVLHRSYTTEADVWSLGVIAYILLCGSRPFWARTESGIFRAVLKADPSFDEPPWP

SEQ ID NO: 22068 - protein, 123 aa, Arabis holboellii
AVLIQILNVVAFCHLEGVVHRDLKPENFLYTSKEENSQLKVIDFGLSDFVRPDERLNDIVGSAYYVAPEVLHRSYTTEADVWSLGVIAYILLCGSRPFWARTESGIFRAVLKADPSFDEPPWP

SEQ ID NO: 22069 - protein, 123 aa, Arabis holboellii
AVLIQILNVVASCHLQGVVHRDLKPENFLYTSKEENSQLKVIDFGLSDFVRPDERLNDIVGSAYYVAPEVLHRSYTTEADVWSLGVIAYILLCGSRPFWARTESGIFRAVLKADPSFDEPPWP

SEQ ID NO: 22070 - protein, 123 aa, Arabis holboellii
AVLIQILNVVAFCHLQGVVHRDLKPENFLYTSKEENSQLKVIDFGLSDFVRPDERLNDIVGSAYYVAPEVLHRSYTTEADVWSLGVIAYILLCGSRPFWARTESGIFRAVLKADPSFDEPPWP

SEQ ID NO: 22071 - protein, 123 aa, Arabis holboellii
AVLIQILNVVAFCHLQGVVHRDLKPENFLYTSKEENSQLKVIDFGLSDFVRPDERLNDIVGSAYYVAPEVLRRSYTAEADVWSIGVIAYILLCGSRPFWARTESGIFRAVLKADPSFDEPPWP

SEQ ID NO: 22072 - protein, 123 aa, Arabis holboellii
AVLIQILNVVAFCHLQGVVHRDLKPENFLYASKEENSQLKVIDFGLSDFVRPDERLNDIVGSAYYVAPEVLHRSYTTEADVWSIGVIAYILLCGSRPFWARTESGIFRAVLKADPSFDEPPWP

SEQ ID NO: 22073 - protein, 123 aa, Arabis holboellii
AVLIQILNVVAFCHLQGVVHRDLKPENFLYTSKEENSQLKVIDFGLSDFVRPDERLNDIVGSAYYVAPEVLHRSYTTEADVWSIGVIAYILLCGSRPFWARTESGIFRAVLKADPSFDEPPWP

SEQ ID NO: 22074 - protein, 244 aa, Nicotiana benthamiana
MLPFKTLQEAESAIGRSLTTLETIWFNYSANKSDYYLYCHNILFLFLIFSCVPPYCLFLELFFRNSIQSYKIQPKVNFSLSEVFHCYKSVMRMFILVVGPLQLVSYPSVKMVGIRTSLPLPSLWEILLQLGTYFIVEDYFNYWIHRFLHCKWGYENIHKVHHEYTAPIGFAAPYAHWLEILILGIPSAIGPAIAPGHMVTFWLWIALRQIEAIETHSGYDLPWTITKYIPFYGGPDYHDYHHYV

SEQ ID NO: 22075 - protein, 242 aa, Nicotiana benthamiana
MASMIESAWTYLISNFSDFQLTCLGGFVLHESIFFLSGLPFILFERAGWFGKYKIQKKNNSPEAQEKCITRLLMYHLCVNLPILLGSYPVFKFMGTRSSLPLPSWKVISTQIIFYFILEDFVFYWGHRILHTKWLYKHVHSVHHEYATPFGLTSEYAHPAEILFLGFATIIGPAITGPHLITLYLWVSLRVLETVEAHSGYHFPWSPSNFLPLYGGADFHDYHHRLLYTKSGNYSSTFVYMD

SEQ ID NO: 22076 - protein, 247 aa, Saccharomyces cerevisiae
ARTFFVGGNFKLNGSKQSIKEIVERLNTASIPENVEVVICPPATYLDYSVSLVKKPQVTVGAQNAYLKASGAFTGENSVDQIKDVGAKWVILGQSERRSYFHEDDKFIADKTKFALGQGVGVILCIGETLEEKKAGKTLDVVERQLNAVLEEVKDWTNVVVAYEPVWAIGTGLAATPEDAQDIHASIRKFLASKLGDKAASELRILYGGSANGSNAVTFKDKADVDGFLVGGASLKPEFVDIINSRN

SEQ ID NO: 22077 - protein, 488 aa, Pseudomonas aeruginosa
MNAVAPLIPCIVSGGSGTRLWPVSRESMPKPFMRLADDQSLLQKTFLRIAGLPDVARLLTVTNRDLLFRTLDDYRAVNRSGLAQDLLLEPVGRNTAPAIAAAALHVQEHFGDQAQLLILPADHLIRDEQAFAAAVAEARGLAAQGYLVTFGITPERAETGFGYIEQGAPLGNGFRVARFVEKPDQATAQSYLDSGKYLWNAGMFCFQAATVLQELERHAPEVLIAARAALADGSSLENGQCRQRELAAGAFPQAPDISVDYALMERSDKVAVVPCSIGWSDIGSWQALRELSAADENGNQVRGESVLHDVSNCYIDSPKRLVGAVGVHDLIIVDTPDALLVADAARSQDVKFVAQELKRRGHDAFRLHRTVSRPWGTYTVLEEGRRFKIKRIVVRPKRSLSLQMHHHRSEHWIVVSGMALVENGEREFLLNTNESTFIPAGHSHRLSNPGIIDLVMIEVQSGEYLGEDDIVRFNDIYGRAPASDEKKA

SEQ ID NO: 22078 - protein, 1003 aa, Streptomyces sp. HK803
MHLLVKGIQHRISSEILVPNSKYHAHRALILASLADGESRIHGLSDARHVEYTVRLLRGLGVQLVREGDTFVVRGLGGHYRPVQDTVSAGSSGTTLYFMTGLASLSNRAVTITGQKYFRNRPVGPLLRALEQIGVRLESANDCPPVQVRSHRPTGGEVTIPGTLSQWISGLLLLAPFATGPTTITVSDTLNERTYLELTVAMMRQFGLEVTVAPDWRRFDVAPHQSVRPTELTLPPDIGSAAFGIATAALHPSDVLLRGMPSLTGGPADHPEFHFLDIARSMGVPMELDPVAGGVRIQQDAPLLKAVDVDCRDVPDMLPVLSTLATFAHGESVFRNVAHTRLKESDRAGVMVQLNSMGAELELSDDTLRVTGVDSLVGAELSSYNDHRVLMSLAVASSRARGHSTLSYPHAYRISYPGFLDMMNSVGVPTSVEKGPARSARSRARRPVREPVRSVADPDHACEVTLPEWLARHAASRPGDTALVDVRPDGDSVVTWSDLAGRVDKAAALLLELGVRPGENVAYQLPNRLEFVVLSLAALRIGAVCCPVIPFFRERELGFVLRRSLARVLVVMDEYRSRRPAQEALALAATGGPDTAHLEHVVVLARSGGGSRPPQPPPGGVRLHDWESALRTTTVDRAALDAIRPTPGATAQLLFTSGTTGEPKGVMQSSSNLVRAVSMEIRHLGLGPEDAVWVPSPLAHQTGFLYGMTLATVLGVPQILQSDWDARRALVSLNTHRATFVQAATPFLADLVKAVEEIGEAPRHLRLFVATGATVPRSLAEHASEVLGTMVCGAFGTTETCLGALSRPTDTPERRWGTDGRVLDGVRLRVTDDRGAVLAPGAEGNFEILSRTTFEGYLDRPDLTAEAFTPDGWFRTGDLAVLDESGYVRITGRVKDVINRGGEKIPVGEMEQLLFRHPAVDDVAIVAMPDERLGERACAFVVLKDGALLGFEEMCRYLDGHQAAKQYWPERLQLVPDLPRNPIGKVQKFELRARARHLRPHMQ

SEQ ID NO: 22079 - protein, 388 aa, Streptomyces sp. HK803
MMDEQRFGQVRDMVERWVEGPGERWAERIEETGEVPEAVWSELDELGFLRLAAPVEYGGQGLGFTQWMELMEIFSRSHGSLRMIVHVVNGIWRSMDGHACDEQRKRFVVPSVLGEIKIAFALTEPGNGTGADITTSVVREGDTYYLSGRKHLITFGMRCDYYLLAARVAGSAGHEGTVALLVPRNAPGVSAEDTSRTMGVTGTDHASIVFDRTPVPVDHRLGEEGQGLEVFLGGFLTPSRISVAMSCVGLAQRAQQLAVDYARSRVTFGKSLTERQAIQFMLAENAADIEAARQLVLHAARRFEEGADDASMQSSMAKMHAVTMLTTVTDKALQVHGGLGYWKSQKIERVYRDARAQRFEEGPNEVQKAVVFRELLRQAGTVTAGGAR

SEQ ID NO: 22080 - protein, 278 aa, Gossypium barbadense
ISHELMETVERLTKEHYRKCMEQRFKEMVASKGLEAVQSEINDMDWESTFFLRHLPESNMSEIPDLEEDYRKVMKEFAVELEKLAEQLLDLLCENLGLEPGYLKKVFYGSKGPTFGTKVSNYPPCPKPDLIKGLRAHTDAGGIILLFQDDKVSGLQLLKDGQWIDVPPMKHSIVINLGDQLEVITNGKYKSVMHRVIAQTDGTRMSIASFYNPGSDAVIYPAPALLEKEADKSQVCPKFVFEDYMKLYAGLKFQAKEPRFEAMKPVESAVNLGPIATV

SEQ ID NO: 22081 - protein, 176 aa, Gossypium barbadense
LFSFILILTHFLLKSSIRIQVLGWICVAISVSVFAAPLNIMARVIRTESVEFMPFTLSFFLTLSAVMWFAYGLFIKDLCVALPNVLGFILGMLQMLLYAIYRHSEKVNIEEKKLPAEQMKSINVVLTTLGASEVHPVVLDIHTDDTKEEDNKNNEPTGEPDKQTDVKMEDANESPV

SEQ ID NO: 22082 - protein, 171 aa, Oryza sativa (indica cultivar-group)
MEHKETGCQQPKGPILCINNCGFFGSAATMNMCSKCHKEMIMKQEQAKLAASSIDSIVNGGDSGKEPIIAGHAEVAVAQVEVKTLVAQPAEIAGPSEGVTVNPKGREGPNRCSTCRKRVGLTGFNCRCGNLYCAMHRYSDKHDCQFDYRTAARDAIAKANPVVKAEKLDKI

SEQ ID NO: 22083 - protein, 344 aa, Datura stramonium
MEVLSSTHTNGSSLLKNGVITMNGHHNGNSDHRNGGTTVHENGRKLLGNSNSIKPGWFSEFSALWPGEAFSLKIEKLLFQGKSDYQDVMLFESATYGKVLTLDGAIQHTENGGFPYTEMIVHLPLGSIPNPKKVLIIGGGIGFTLFEVLRYPTVEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKDETHANSKLGPLKFYNTDIHKAAFILPSFARSMIES

SEQ ID NO: 22084 - protein, 294 aa, Spirulina sp.
AKTDIPVNIYKPKNPYIGKCLSNEELVREGGTGTVRHLIFDISGGDLRYLEGQSIGIIPPGTDNNGKPHKLRKYSIASTRHGDHVDDKTVSLCVRQLEYKHPETGETVYGVCSTYLCNLEAGADVAITGPVGKEMLLPEDEDATIIMMATGTGIAPFRAFLWRIFKEQHEDYKFKGLWALFFGIPYSPNILYQQELEELQEEFPENFRLTLAISREQQNPEGGKMYIQDRIKENADQLWELIQKPNTHTYICGLKGMEGGIDEGMSAAAGKFDVDWSDYQKELKKKHRWHVETY

SEQ ID NO: 22085 - protein, 413 aa, Trichoderma atroviride
MADLQGRKVFKVFNQDFVVDERYTVTKELGQGAYGIVCAAVNGQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAMDVWSVGCILAELLGGRPFFKGRDYVDQLNQILHILGTPNEETLRRIGSPRAQEYVRNLPFMPKKPFPALFPDANPDALDLLDKMLAFDPSQRISVEQALEHPYLHIWHDASDEPDCPTTFNFDFEVVEDVGDMRKMILDEVLRFRQLVRTAPASGNQAAAQQIQVPMPQAGGQWTAEDPRPQEYMGHANGLEQDLAAGMDIRR

SEQ ID NO: 22086 - protein, 430 aa, Pseudomonas sp. QDA
MMIPVILSGGSGSRLWPLSRKQFPKQFLALTGEHTLFQQTLERLAFEGMDTPIVVCNKDHKFIVQEQLAALKLETQGILMEPFGRNTAPAVTMAAMKLVNEGRDDLMLVLPADHVIDDQKALQRALALATVAAERGEMVLFGVPATKPETGYGYIRSSQDALLPEGVARVAQFVEKPDEKRAAEFVQAGGYFWNSGMFLFRASRFLEELKKHDADIYDTCVLALERSEEEDEVLSIDEATFACCPDNSIDYAVMEKTQRACVVPMSAGWSDVGCWSSLWDVHEKDDNGNVTKGDVVVQDSRNCMIHGNGKLVSVIGLENIVVVETKDAMMIAHKDKVQGVKQMVKTLDEQGRTETQNHLEVYRPWGSYDSVDMGGRFQVKHITVKPGASLSLQMHHHRAEHWIVVSGTAEVTCDENVFLLTENQSTYIPV

SEQ ID NO: 22087 - protein, 475 aa, Acroporium stramineum
MSPQTETKASVGFKAGVKDYRLNYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYLNATAGTSEEMAKRAQFARELGMPIVMHDYLTGGFTANTSLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVAVEACVQARNEGRDLAREGNEIIREAAKWSPELAAACEVWKEIKFEFETIDTI

SEQ ID NO: 22088 - protein, 475 aa, Arabidopsis thaliana
MDAYNNPSAVESGDAAVKSVDDDGREKRTGTFWTASAHIITAVIGSGVLSLAWAIAQLGWVAGTTVLVAFAIITYYTSTLLADCYRSPDSITGTRNYNYMGVVRSYLGGKKVQLCGVAQYVNLVGVTIGYTITASISLVAIGKSNCYHDKGHKAKCSVSNYPYMAAFGIVQIILSQLPNFHKLSFLSIIAAVMSFSYASIGIGLAIATVASGKIGKTELTGTVIGVDVTASEKVWKLFQAIGDIAFSYAFTTILIEIQDTLRSSPPENKVMKRASLVGVSTTTVFYILCGCIGYAAFGNQAPGDFLTDFGFYEPYWLIDFANACIALHLIGAYQVYAQPFFQFVEENCNKKWPQSNFINKEYSSKVPLLGKCRVNLFRLVWRTCYVVLTTFVAMIFPFFNAILGLLGAFAFWPLTVYFPVAMHIAQAKVKKYSRRWLALNLLVLVCLIVSALAAVGSIIGLINSVKSYKPFKNLD

SEQ ID NO: 22089 - protein, 303 aa, Candida parapsilosis
MATDSNFLIDFLMGGVSAAVAKTAAAPIERVKLLIQNQDEMLKQGRLSHKYTGIIDCFRRTAADEGIVSFWRGNTANVIRYFPTQALNFAFKDQIKALFGFKKDEGYWKWFAGNLASGGIAGALSLAFVYSLDYARTRLANDAKSAKGDGKGREFNGLIDVYKKTLASDGIAGLYRGFGPSVIGIVVYRGLYFGLYDSLKPVVLVGPLEGSFLASFLLGWVVTTGASTASYPLDTIRRRMMMTSGQAVKYDGALDCARKVVAAEGVKSLFKGCGANILRGVAGAGVISLYDQLQVLLFGKKFK

SEQ ID NO: 22090 - protein, 220 aa, Gossypium barbadense
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRS

SEQ ID NO: 22091 - protein, 294 aa, Hordeum vulgare subsp. vulgare
MAMASSTTASIAAASLRALAGASPAPLRKPFLVLLSPALPRRLGLGLRAARPRGPLAPLAASDSFETSAAVDVAEPEDEALEAVAEEEPAVAVAEEEFDVAAEEEVGEYVEPPEEAKVYVGNLPYDVDSERLAQLFEQAGVVEVSEVIYNRETDQSRGFGFVTMSTIEEAEKAVEMFHRYDVNGRLLTVNKAAPRGARVERPPRDSGSSFRIYVGNLPWQVDDSRLVELFSEHGKVVDAKVVYDRDTGRSRGFGFVTMASQEELDDAIAALDGQSLEGRALRVNVAEERPPRRF

SEQ ID NO: 22092 - protein, 402 aa, Streptomyces anulatus
MEFRQSSKLSEVCYEIRGPVIEHANALEEAGHSVLRLNTGNPALFGFEAPEEIVQDMIRMLPQAHGYTDSRGVLSARRAVAQRYQALGLDEVSVDDVFLGNGVSELVTMAVQALLEDGDEILIPAPDFPLWTAVTTLSGGKAVHYVCDEAADWYPDLDDMASKITDQTKAVEIINPTGAVYPKEILEGILDLARRHGLMVFADEIYDQILYDDAVHHSVAALAPDLVVLTFCGLSKTYRVAGFRSGWLVITGPRQHARDYLEGLTMLASMRLCPNAPAQFAIQAALGGRQSIRELTAPGGALHEQRDRAWEKLNEIPGVSCVKPKGALYAFPRLDPKVHPIHDDEKFVLDLLLQEKIQVVQGTGFNWPRPDHFRILTLPHADDLDAAISRIGRFLSGYRQGR

SEQ ID NO: 22093 - protein, 153 aa, Streptococcus pneumoniae
GVPIEEIMDSIRVIGRDNARTPMQWDESKNAGFSTGQPWLAVNPNYEMINVQEALANPDSIFYTYQKLVQIRKENSWLIRADFELLDTADKVFAYIRKDGDRRFLVVANLSNEEQDLTVEGKVKSVLIENTLAQEVFEKQILVPWDAFCVELL

SEQ ID NO: 22094 - protein, 1436 aa, Schizosaccharomyces pombe
MENILDPSVVNSHILENGSRRSSINPILDSELRDKTFEKAHRRSLTLLSSFTSSMLELPNNGKEENHRRPSVARSSSDRSKASAKEDLFSEAFRMAEQPPAEALTISTPVDPINIDELDRAYAVSPSDTSNLLHPPTSSSSIPIPIKNAGHSNLDHPIRPSLQSSISSNRIIKSPGIKEDDYMHRGRSISSPMIDVEHINSTAVPSKTKNLPEKPKRSHKLRNSITFAKIEDHPERKSQLRRLSSSLKCFDPEYDYNDPSLSIRRDSSTYYFSNVNETYDEEDSDLDSETSTVNWVQSVLNLPSLLSDDLMANPKNKERFEWQYMLTSVLTGDIVRSEKLRLRKIASSREGRNSDYSDNLWMEIWCWLTHRSVDSYRENLKHLRTGMVDVLLAIMNFHWDESNELTPIVAVDNMLQKLDKYERLYPSRRSILQEHSLYASESFQHKLDVLTAYSNVTHALEIQVNIIRSWVGNEEMDITKNTTNSINNVSQISNGPFVERFYRETGLIRAFEQRIMTNMNSVLSKVCNTIVTYADDLKSYGLPLIADDYMRLLSFPFRLIKEFLNLRLSCAENITSISLFTIDSLLDDLRNTMKVAVHIIQQHTVLIKPFRDDSKFVDENQSLNNILVASLKFYFNLLHRKVRNGCALLHFKETEILEGEWDFLLAVCPHIEHGFQIMSKSLSSLVGEILTNINRYLKDQLQGPDTDDSALITSFYIKVLDCVRIRFRKLMSFTRILKAHLENSCEYVIKENSLSLLIQRLEESNHVLTYTASIEHEGAYVIVPGHLVDSPNILREVLSMTFNKGDNNFESVPPYAVVLAPDSSICWNGHVTDLDIPEVSISIAPNCVRLVTLATANQLSVIEDYFISIVGDTVSLVDSAKANSSKINKQMTKIKRNSLKLALSLLDVIQTIRTRYHGMNCQNLIHYSFSYAIEFAQRLMRLSILDASSIGLIRRKMIQLAISWVGFIYEDCSPTDRNTFRWTVTALEFAMIMTYGSNILMIDKKSFEELKEKVGKCVALLLLHFDVMGTKHAGRSMDQQAGDIPARLVRNNSDRSRLSDNELASFVKEEVMHRIIELESNRRDRLYKSQLIGRVLDDTTKENRLLKELASSKSNITIRWQQGGLIGSGSFGTVYRAVNLDTGDLMAVKEVALHKPRISRPMIKRIKGEMLVLELFDHPNVVSYYGIEVHREKVNIFMELCQGSSLFEFLRYGRIEDELVIQVYVLQLLEGLAYIHSCGVSHQDVKPENILFDHNGIMKFTDFGSAKMSGSASTKIFEQLTQQEEEEFEKDSEFLQHLDQNRGYSLTGTPTYMAPELILGNPSERVGAMDIWSLGCVIVEMATGSPPWPRLDNHFSLMYHIAAHNPPIIPADDQLSPLGQNFLKRCFVSDPNQRATAAELLMDPWVYPLRAGTEFDLMNSSVVESAPSTNGAPLEL

SEQ ID NO: 22095 - protein, 448 aa, Sphingomonas sp. RW5
MSDYDYDLIVIGAGSGGVRAARVAAAHGARVAIVEEYRVGGTCVIRGCVPKKLLIYGAHFAEDLRDARQFGWQVPDCQFDWPTLRDNVLAEVDRLEGLYRNTLGSHGVTILPGRGTIIGPHGVRIAGGQDVTSRMILVATGARPLLPSFDGAEHGISSNEAFHLDDVPRRIAIVGGGYIANEFAGIFNELGSAVTVINRSGQLLRGYDHSVRDRLVEISTRKGIAFRFDASFEKVIKLADGSLSVQLAGEDAFSVDCLMFAIGRVPNSSDLGLEEQGVEIDPLGAIIVDDDGRSTVGSIFAVGDVTNRIQLTPVAIREGQAFADTQFGGKPHRVDYRHVPSAVFSHPPIAFVGLTEQQARDQVGEVKIYTSDFRPMKNVLAKRDERALYKMICDADTDRILGLHMIGPDAPEILQAAAIAVKAGLSKAAFDETIALHPTMAEELVLLR

SEQ ID NO: 22096 - protein, 287 aa, Raphanus sativus
MAKDVEAVSGEGFQTRDYQDPPPAPLFDPEELTKWSFYRAVIAEFVATLLFLYITVLTVIGYKIETDSTAGGVDCGGVGILGIAWAFGGMIFILVYCTAGISGGHINPAVTFGLLLARKVSLVRAILYMVAQCLGAICGVGFVKAFQSAYYVRYGGGANSLADGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 22097 - protein, 372 aa, Hemerocallis hybrid cultivar
STEIFSPVRIRSLAAVRQEEVKLMITGILASTSTDNSVKVNMKVVFSELMFNVIMKIIAGKRYFGVNTDSEVEEGQKFRVVFDEMFSTLEVASPQDFLPFLKWFGFKRMENRLTKLAKELDQLFQKLIEERRSERGKVQSTVIDVLLSLQETDREQYSDKLIKGMILSLIAAGTHTTAGTMEWAMSLLLNHPEALLKVRDEIDKKVGQDRLIDHSDLQNLSYLNNAIKESLRLFPTAPLLLAHESSAECTVGGFTIPSNTILFANAYALHRDPKVWTDPVSFKPERFENNGQQGSRIYVPFGLGRRSCPGEGLATQVVGLALGTLIQCFEWDRNGEEKVDMTDGSGLAMHMEKPLEAMCKPRQSIVDVINRL

SEQ ID NO: 22098 - protein, 220 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSV

SEQ ID NO: 22099 - protein, 445 aa, Saccharomyces cerevisiae
MDDKVSEKESSPKQTEEDSEGKMAHVQPASYVNKKKYVFGKTLGAGTFGVVRVRKNTETGEDVAVKIVIKKALKGNKVQLEALYDELDILQRLHHPNIVAFKDWFESKDKFYIITQLAKGGELFDRILKKGKFTEEDAVRILVEILSAVKYMHSQNIVHRDLKPENLLYIDKSDESPLVVADFGIAKTLKSDEELLYKAGTALGYVAPEVLTQDGHGKPCDIWSIGVITYTLLCGYATIDRKVQDFLDECTTGEYPVKFHRPYWDSVSNQAKQFILKALNLDPSKRPTAAELLEDPWIICTELKTHNLLPGLKEGLDARQKFRNSVERVRLNMKIQKLRDLYLEQTESDSDFDEGSQANGSVPPLKATDTSQLSKKLSEEEQSKLKSELTSKAFAQLVNTVLAEKEKFLNINRVCSSDSDLPGSDIKSLDEAKEKPEGKDTKTEE

SEQ ID NO: 22100 - protein, 474 aa, Streptomyces coelicolor A3(2)
MHVTGTVPPPAPEPRETPAAPDHTTLADPAPGNGRHARRFGLPVATALVMGNIIGGGIFLLPASVAPFGTISLLAFGVLTVGAIALALVFGRLAARDPHTGGPYVYARGAFGDFAGFLAAWAYWITTWVSNAALAVAAVGYLDVLIPVNDHRWTACLAALVVQWLPALANFAGTRWVGAVQLVSTVLKFAPLLLVAVGGLFFFDADNLGPFNASGSGGIGAVSAAAAILLFSYLGVESAAVSAGEVEDPRRTVGRATVIGTAGAALVYLLGTLSVFGTVAHDRLVTSDAPFSDAVNAMFGGAWGGWAVALAALVSMTGCLNGWTLLSAQTPYAAARDGLFPAAFARKRRGVPTTGVGVTVVLASLLTVYNYTSGSAKVFEVLVLVTTFTATVPYLLATAAQIFHLVSGQGERVDRARLVRDGIAASVAAAFSLWLVAGAGYAAVYQGVLFLFAGVLVYAVMAARRRRAETSNAP

SEQ ID NO: 22101 - protein, 457 aa, Schizosaccharomyces pombe
MSLATLQGQSLDFAVKHSLDDLLKNPVRFRPAVVSSPSVPEGTYTVLNNPKQSTVSRKSFSAPTSPTRNKRSGSSSQEYKKSSGTRGDGANDFVDEDPAFIPPARILFPEEKLSMEWDNIMPNAPGLVNLGNTCFMNSVLQLMTQTPPLVQYLLSGQHSLSCRMNACVLCRMEQHVARAYPNKGTKRASAFKPSGIQSMLKVISSHFRPYRQEDAHEFMRYLVDAWQKSCLQNHKNLDHPSRETSVVHRIFGGYLRQQILCSVCKKPSNTYQALLDLSVDAKGSSLADSLKHFVHAEKLTKQNKYRCENCKQLVDASKQMTIYRAPNILTIHFKRFTFNGFQSSKISKQISYPESFNLGPYMSDPNCSCWYELIGVLVHAGGSTRSGHYYSFCKSSNGVWLKFDDDFVSNSSIDRVLNQQAYILQYKRKSTSSSKHKLNTENTVTKTSNKKRRKISF

SEQ ID NO: 22102 - protein, 441 aa, Schizosaccharomyces pombe
MFQRRSLLSVRSSGSQIAFRRFVSLTHKDPTPDTTSCNIIKKEGANIISVYARYPVVAAKGEGSYLFDKEGRKYIDFTSGVAVTSLGHAHPEVARLAADQCSKLVHSSNLFYNEPAIELSNVINNSLAKNSGIAGPTKIFFANCGTEANETALKFARKAAFEKYGEGKSQIVYFNNSFHGRSLGSLSITANPKYKRGFQPLLPDVVQAVYNDPASIEQFVNDKTAAVIVEPVQGEGGICPAKPEFLIALRKACDKVGASLIYDEIQCGLGRSGDLWAHSIVKDVASPDIITVAKPLANGLPIGATIVSSKIAAEIHPGEHGSTFGGNPVACRVGTFCVNELGSSKILQNVRKQHKALTSRFDDFVAKYPNLIRGYAGRGLLLGLQFTEPPAKFIELARQQGLLLLPGGNNNTRVLPSLNVKDEVIAKGLDIMESTLKALSK

SEQ ID NO: 22103 - protein, 483 aa, Streptomyces coelicolor A3(2)
MRHRLSELSELSDLSEPSERLPDELRVLNPATEEVVATVPAASAADVDAAVARAARAQTAWAALAPGDRARLLRRFAVTVDEHLEELARLEVRQAGHLLGNARWEAGNVRDLLDYAAGGVERLTGRQIPVAGGLDVTLLEPLGVVGVIAPWNFPMPIAAWATAPALAAGNAVLLKPAETTPLTALRLAELALVAGLPEDLFQVLPGHGPVAGDALVEHPDVAKIVFTGSTAVGRQVAAKGAALLKPVTLELGGKSPNIVFADADVEAAAAATPMSFLDNSGQDCCARTRILVQRSVHDRFLELLAPAIEAVRVGDPADESTEMGPLISRAQLERVRSHVPADAAGIRGRAPRGGPGFWFPPTVLTGVDAHARVAVEEVFGPVAVVLPFDDEADAVRLANATDYGLAGSLWTRDVGRALRVSGAVRAGNLSVNSHASVRYWTPFGGFKQSGIGRELGPDALTAFTETKNVFFSTTPSSTEGPAQ

SEQ ID NO: 22104 - protein, 462 aa, Streptomyces coelicolor A3(2)
MSPGQKEALPVADRTPPLGVEELHALVAAGDIDTVVLAFPDMQGRLQGKRFAARFFLDEVLEHGTEGCNYLLAVDADMNTVDGYAMSSWDRGYGDFAMRADPATLRRLPWNEGTAMAVADLAWEDGSPVLAAPRQILRRQLERLAGHGYTAQVGTELEFIVFRDTYEHAWDANYRGLTPANQYNVDYSVLGTGRVEPLLRRIRNEMAGAGLTVESAKGECNPGQHEIAFRYDEALVTCDQHAVYKTGAKEIAAQEGMSLTFMAKYNELEGNSCHIHLSLADADGRNAMAEGGGMSDVMRHFLAGQLVALREFSLLYAPHINSYKRFQPGSFAPTAVAWGHDNRTCALRVVGHGRSLRFENRLPGGDVNPYLAVAGLVAAGLHGIEQRLELPEPCPGNAYTADFAHVPTTLREAAELWENSTLAKAAFGDEVVAHYRNMARVELDAFDAAVTDWELRRSFERM

SEQ ID NO: 22105 - protein, 509 aa, Nepeta racemosa
MVSLSYFLIALLCTLPFLLFLNKWRRSYSGKTPPPSPPKLPVIGNLHQLGLYPHRYLQSLSRRYGPLMQLHFGSVPVLVASSPEAAREIMKNQDIVFSNRPKMSIANRLFFNNRDVAFTQYGEYWRQIRSICVLQLLSNKRVQSFRRVREEETSIMVEKIMQLGSSSSTPVNLSELLLSLTNDVVCRVTLGKKYGGGNGSEEVDKLKEMLTEIQNLMGISPVWEFIPWLNWTRRFDGVDQRVDRIVKAFDGFLESVIQEHKERDGDKDGDGDGALDFVDILLQFQRENKNRSPVEDDTVKALILDMFVAGTDTTATALEWAVAELIKNPRAMKRLQNEVREVAGSKAEIEEEDLEKMPYLKASIKESLRLHVPVVLLVPRESTRDTNVLGYDIASGTRVLINAWAIARDPSVWENPEEFLPERFLDSSIDYKGLHFELLPFGAGRRGCPGATFAVAIDELALAKLVHKFDFGLPNGARMEELDMSETSGMTVHKKSPLLLLPIPHHAAP

SEQ ID NO: 22106 - protein, 332 aa, Nicotiana tabacum
VNDWADEFGNQVAEGAFGETSADSWAEAYDEYMNEQAALKQQSDASRGVYVFSDLNPYVGHPNPLKEGQELFRKGLLSEAVLALEAEVLKNPENAEGWRLLGIAHAENDDDQQAIAAMMRAQEADPTNLEVLLSLGVSHTNELEQQAALKYLYSWLRHHPKYGSIAPQDQPVSFYHADVSRLFTDAAQMSPDDADVHIVLGVLYNLSREYDKAIESFKTALKLKPRDYSLWNKLGATQANSVQSADAILAYQQALDLKPNYVRAWANMGISYANQGMYEDSIRYYVRALAMNPKADNAWQYLRISLSCASRNDMLEACDARNLDVLQKEFPL

SEQ ID NO: 22107 - protein, 434 aa, Cenarchaeum symbiosum
MDLEREYRAKTGGSARIFARSKKYHVGGVSHNIRFYEPYPFVTRSASGKHLVDVDGNKYVDYWMGHWSLILGHAPAPVRSAVEGQLRRGWIHGTVNEQTMNLSEIIRGAVSVAEKTRYVTSGTEAVMYAARLARAHTGRKIIAKADGGWHGYASGLLKSVNWPYDVPESGGLVDEEHSISIPYNDLEGSLDVLGRAGDDLACVIIEPLLGGGGCIPADEDYLRGIQEFVHSRGALLVLDEIVTGFRFRFGCAYAAAGLDPDIVALGKIVGGGFPIGVICGKDEVMEISNTISHAKSDRAYIGGGTFSANPATMTAGAAALGELKKRKGTIYPRINSMGDDARDKLSKIFGNRVSVTGRGSLFMTHFVQDGAGRVSNAADAAACDVELLHRYHLDMITRDGIFFLPGKLGAISAAHSKADLKTMYSASERFAEGL

SEQ ID NO: 22108 - protein, 434 aa, Cenarchaeum symbiosum
MDLEREYRAKTRGSAGIFARSRRYHVGGVSHNIRYYEPYPFVTRSARGKHLVDVDGNKYTDYWMGHWSLILGHAPAQVRSAVEGQLRRGWIHGTANEPTMRLSEIIRGAVKAAEKIRYVTSGTEAVMYAARMARARTGKKVIAKVDGGWHGYASGLLKSVNWPYDVPESGGLVDEEHTVSIPYNNLEGSLEALRRAGGDLACVIVEPMLGGGGCIPAEPDYLRGIQEFVHSKGALFILDEIVTGFRFDFGCAYKKMGLDPDVVALGKIVGGGFPIGVVCGKDEVMCISDTGAHARTERAYIGGGTFSANPATMTAGAAALGALRERRGTLYPRINSMGDDARARLSRIFDGRVAVTGRGSLFMTHFTPDGARRISSAADAAACDVHLLHRYHLDMITRDGIFFLPGKLGAISAAHSRADLGAMYSASERFAGGL

SEQ ID NO: 22109 - protein, 459 aa, Capsicum chinense
MANITNEFMGHDMLAPFTAGWQSDMEPLVIEKSEGSYVYDINGKKYLDTLSGLWCATLGGSETRLVEAANKQLNTLPFYHSFWNRTTKPSLDLAKELLNMFTANKMAKVFFTNSGSEANDTQVKMVWYYNNALGRPQKKKIIARAKAYHGSTYISAGLSGLPPMHQKFDLPPPFVLHTECPHYWAYHLPGETEEEFSTRLANNLESLILKEGPETVAAFIAEPVLGAAGVILPPATYFDKVQAILRKHDILFIADEVVCGFGRLGTMFGSDKYNIKPDLVSVGKALSSGYMPIAAVLVSQKISSVILSESNKIGAFCHGFTYSGHPVACAVALEALKIYKERNITEVVNKISQKFQEGLKAFADSPIIGEIRGTGLALSTEFVDNKSPNDPFPYEWAVGTYFGAQCAKYGMLVSSTGDHVNMAPPFILSLEELDELIRIYGKALKDTEKRVEELKSQKQ

SEQ ID NO: 22110 - protein, 280 aa, Rhizopus oryzae
LDFDTGSSDLWFATTLCTNCGSSQTKYDPNQSSTYAKDGRTWSISYGDGSSASGILGKDTVNLGGLKIKNQIIELAKREASSFSSGPSDGLLGLGFDTITTVSGVQTPMDNLISQGLISNPVFGVYLGKESNGGGGEYIFGGYDSSKFSGDLTTIAVDNSNGWYGITIDGTSISGSQVSDSFSAILDTGTTLLILPSNVASSVAQAYNANDNGDGTYTISCDTSELQPLVFTIGGSTFEVPTDSLIFEQDGNTCVAGFGYGEDDFAIFGDVFLKNNYVVF

SEQ ID NO: 22111 - protein, 280 aa, Rhizopus oryzae
LDFDTGSSDLWFASSLCTNCGSSQTKYNPNESSTYARDGRTWSISYGDGSSASGILGTDTVTLGGLTITHQTIELARREASQFQSGPSDGLLGLGFDSITTVRGVTTPVDNLISQGLISNPVFGVYLGKENNGGGGEYIFGGYDSSKFKGSLTTIPVDNSNGWYGITVRGASIGGSRVSSSFDAILDTGTSLLVLPNDVASSVAEAYGASDNYDGTFSISCDTSSFEPLVFTIGSSTFEVPADSLVYEQDGYSCIAGFGYGDYDFAIFGDVFLKNNYVVF

SEQ ID NO: 22112 - protein, 379 aa, Pichia pastoris
MSTEGQIIKCKAAVAWEAGKDLSIEEIEVLPPRAHEVRVKVEFTGVCHTDAYTLSGADAEGSFPVVFGHEGAGVVESVGEGVESVKVGDSVVLLYTPECRECKFCLSGKTNLCGKIRATQGKGLLPDGTSRFRCKGKDLFHYMGCSSFSQYTVVADISVVKVQDEAPKDKTCLLGCGVTTGYGAAINTAKISKGDKIGVFGAGCIGLSVIQGAVSKGASEIIVIDINDSKKAWADQFGATKFVNPTTLPEGTNIVDYLIDITDGGFDYTFDCTGNVQVMRNALESCHKGWGESIIIGVAAAGKEISTRPFQLVTGRVWRGCAFGGIKGRTQMPSLVQDYLDGKIKVDEFITHRHDLDNINKAFHDMHAGNCIRAVITMH

SEQ ID NO: 22113 - protein, 325 aa, Rhizopus microsporus var. chinensis
AGVGTVPMTDYGNDIEYYGQVTIGTPGKKFNLDFDTGSSDLWIASTLCTNCGSRQTKYDPNQSSTYQADGRTWSISYGDGSSASGILAKDNVNLGGLLIKGQTIELAKREAASFASGPNDGLLGLGFDTITTVRGVKTPMDNLISQGLISRPIFGVYLGKAKNGGGGEYIFGGYDSTKFKGSLTTVPIDNSRGWWGITVDRATVGTSTVASSFDGILDTGTTLLILPNNIAASVARAYGAYDNGDGTYTISCDTSRFKPLVFSINGASFQVSPDSLVFEEYQGQCIAGFGYGDFDFAIIGDTFLKNNYVVFNQGVPEVQIAPVAE

SEQ ID NO: 22114 - protein, 183 aa, Guillardia theta
MKNRIIIFIIGLFCLQPVASHADVAGLVPCKNSKEFQRRLDSSVKKLESRLSKYEPNTPPYLALETQINKTKNRFTQYGNAGLLCGTDGLPHLIADGRWSHAGEFMVPGLFFLYIAGWIGWVGRNYVQFASQTDKPTEKEIIIDVPVALSFISTGYIWPFAAFKEFTSGNLIAKEDEITVSPR

SEQ ID NO: 22115 - protein, 172 aa, Guillardia theta
MPRFQKNDNFIDKTFTVLADLVLKILPATKQEKEAFSYYRDGMSAQSEGEYAEALENYYEALRLEEDPYDRSYILYNIGLIYASNGEYVKALEYYHQALDLNSQLPAALNNIAVIYHYQGVKASEKKELDLARTLFDKAAEYWKQAIRLSPNNYIEAQNWLKTTGRSDTLTI

SEQ ID NO: 22116 - protein, 408 aa, Guillardia theta
MARDKFERSKPHVNIGTIGHVDHGKTTLTAAISATLSQYTGKSKKFDEIDSAPEERARGITINTAHVEYETDKWYYAHVDCPGHADYVKNMITGAAQMDGAILVCSAANGPMPQTREHILLAKQVGVPYIVVFLNKADMVDDEELLELVQLEVQELLEKYDFPGSEIPFVAGSALLALEAVANNPTIKRGEDKWVDTIYQLMDKVDEYIPTPERETDKAFLMAVEDVFSITGRGTVATGRIERGKVKVGDTIEIVGLRETRNTTITGLEMFQKSLDEALAGDNVGILVRGIQKTDIERGMVLAAPGSITPHTKFEGEVYVLTKEEGGRHTPFFSGYRPQFYVRTTDVTGTIAQFTSDDGSTAEMVMPGDRIKMTAQLIHPIAIEKGMRFAIREGGRTVGAGVVSKIIE

SEQ ID NO: 22117 - protein, 469 aa, Capsicum chinense
PIPVPVFGNWLQVGDDLNHRNLTDYAKKFGDIFLLRMGQRNLVVVSSPESAKEVLHTQGVEFGSRTRNVVFDIFTGKGQDMVFTVYGEHWRKMRRIMTVPFFTNKVVQQYRGGWESEVASVVEDVKKNPESATNGIFLRKRLQLMMYNNMFRIMFDRRFESEDDPLFVKLRALNGERSRLAQSFEYNYGDFIPIFRPFLRGYLKICKEVKEKRLQLFKDYFVDERKKLANTKSMDSNALTCAIHHILDAQQKGEINEDNVLYIVENINVAAIQTTLWSIEWGIAELVNHPHIQQKLREEIDTVLGPGVQVTEPDTQKLPYLQAVIKETLRLRMAIPLLVPHMSLHDAKLAVYDIPAESKILVNAWWLANNPAHWKKPEEFRPERFLEEEKHVDANGNDFRFLPFGVGRRSCPGIILALPILGITLGRLVQNFEMFPPPGQSKLDTSEKGGQFSLHILKHSTIVMKPRSF

SEQ ID NO: 22118 - protein, 294 aa, Pisum sativum
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFSKDQRQVKMFLYQILCGIAYCHSHRVLHRDLKPQNLLIDRSSNALKLADFGLARAFGIPVRTFTHEVVTLWYRAPEILLGSRHYSTPVDVWSVGCIFAEMINQRPLFPGDSEIDELFKIFRITGTPNEDTWPGVTSLPDFKSAFPKWPSKDLATLVPSLEPSGLDLLSSMLRLDPSRRITARGALEHEYFKDIKFVP

SEQ ID NO: 22119 - protein, 384 aa, Pisum sativum
MAIHHHHHHHQQLHHNSLLDALYCDEEKLEEEQEDVSSQQSDVTTNNDNNILDSTSLFPLLLLEQNLFSQDEELTTLFSKEKTQQETYYEDLKNVVDFVSLSQPRREAVQWMLKVNAHYAFSPLTATLAVTYFDRFLLTFHFQKDKPWMIQLVAVTCISLAAKVEETQVPLLLDLQVQDTKYVFEAKTIQRMELLILSTLKWKMHPVTPHSFLDHIITRLGLKTNLHWEFLRRCENLLLSVLLDSRFVGCVPSVLATATMLHVIDQIEESDDNGVDYKNQLLSILKINKEKVDECYNAIVEVTNENNYGHKRKYEQIPGSPSGVIDAVFSSDGSNDSWKVGSSSYSTSEPVFKKTKTQGQNRNLSPLNRVIVGILATASATTSP

SEQ ID NO: 22120 - protein, 317 aa, Cucumis sativus
MAVFPIINLENINGDGRAKILEQIEDACQNWGFFELVNHGIPHEFLDMVEKMTRDHDKKCMEERFKETVLSKGLEAAQAEVNDMDWESTFFLRHLPESNISQMSDLDEEYKKIMKEFAKKLENLAEELLDLLCENLGLEKGYLKNAFYGSKGPTFGTKVSKYPPCPKPDLIKGLRAHTDAGGIILLFQDDKVGGLQLLKDGDWIDVPPMRHAIVVNLGDQLEVITNGRYKSVMHRVLITQTSGTGRMSIASFYNPGSDAVIYPAPALVEKDEEKKEVYPKFVFEDYMKLYLGVKFQAKEPRFEAMKANANLGPMATA

SEQ ID NO: 22121 - protein, 314 aa, Cucumis sativus
MEFPIINLEKLNGEERSSILAKIKDACENWGFFEVLNHGIDTEFLDKVEKLTKEHYKKCMEERFKEHIASKGLNDVVTEVNDVDWESTFFLRHLPVSNIADLPELSDDYKSVMKQFASKLQVLAELLLDLLCENLNLPKSYLKNAFHGSNGPTFGTKVSNYPPCPNPDLIKGLRAHTDAGGIILLFQDDKVSGLQLLKEGEWVDVPPVRHSIVVNIGDRLEVITNGKYKSVLHRAIAHREGEGRMSLASFYNPGSDAVIFPAPSLVAEEKNEIYPKFVFEDYMKLYAGLKFEAKEPRFEAMKGNNVKLDPIATV

SEQ ID NO: 22122 - protein, 366 aa, Arabidopsis thaliana
MAVKKACEMFPKSLIEDVHKWGCMKQTGVSLRYMMEFGSKPTERNLLISAQFLHKELPIRVARRAIELQTLPYGLSDKPAVLKVRDWYLESFRDMRAFPEIKDSGDEKDFTQMIKAVKVRHNNVVPMMALGVNQLKKGMNSGNLDEIHQFLDRFYLSRIGIRMLIGQHVELHNPNPPLHTVGYIHTKMSPMEVARNASEDARSICFREYGSAPEINIYGDPSFTFPYVPTHLDLMMYELVKNSLRAVQERFVDSDRVAPPIRIIVADGIEDVTIKVSDEGGGIARSGLPRIFTYLYSTARNPLEEDVDLGIADVPGTMGGYGYGLPISRLYARYFGGDLQIISMEGYGTDAYLHLSRLGDSQEPLP

SEQ ID NO: 22123 - protein, 320 aa, Emericella nidulans
MDKSQQPSSFQQLEKLGEGTYATVFKGRNRQTGELVALKEIHLDSEEGTPSTAIREISLMKELKHESIVSLYDVIHTENKLMLVFEYMDKDLKKYMDTRGDRGQLDQATIKSFMHQLMSGIAFCHDNRVLHRDLKPQNLLINKKGQLKLGDFGLARAFGIPVNTFSNEVVTLWYRAPDVLLGSRTYNTSIDIWSAGCIMAELYTGRPLFPGTTNEDQLQKIFRLMGTPSERSWPGISQLPEYRANFHVYATQDLGLILPQIDPLGLDLLNRMLQLRPEMRIDAHGALQHPWFHDLPQLQAQLQQQQMAGYGGMMPPQQAY

SEQ ID NO: 22124 - protein, 252 aa, Helianthus annuus
QYGRETRHTGDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESDFGGKTGTFQNQPSATPVGGVGLNSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 22125 - protein, 259 aa, Rhizobium leguminosarum
MQSLENAVQDDDATQEMLSLVLEEPDHWAMFLDIDGTLLNLAPTPDAIEVPEALPGQLHRLSNKLGGALALVTGRSLAYADALFKPFAFPTAGLHGAEIRNAAGMQTVEATAEFQALKHALTEEAEHYPGVLIEDKGAAVAAHYRLAPEYEKVLADRMHHYAELAGPNWALQLGKMVFELRPARSSKGDALERFFQSDPFKNRCPITIGDDLTDESMFAIANARGGVSVRVGAIGAPSCATSRLSSSALVRNVIAALAA

SEQ ID NO: 22126 - protein, 1347 aa, Schizosaccharomyces pombe
MSHLLFAYYLCNDIRSFQNLLKQDDSKVKEPRKGFSEKSGQKLRINQKDRYGRTVLHIAVSENKNSFVRSLLQHKGIDVFVQDEESGYTALHRAIYVGNLEAASLLLSKDPSFRSLRIKDKEGLSPFQFLSRVLSSTIHPVLDLPIIGNELYGFGTNVNNTLGIANGKEPSSPERVFLLKNQTESPTSGQLFSRDKILDVQASKFHSVVLTDEPSQNVYVCGIGAGGRIGFNTDVQYNFIPIPGIIHKVIQISVSHTHSLALTKFGSIYSWGKNGSGELGLSNDELKKDDPIQITPRRISAFKDYQIIGMAAGKSYSVAWTDTDIYSWGLNNGQLGISDHISVVSTPRRVAGLLSPVIHAVCTTRATICLLQNNSIIAFCNYNQVKLPFNVDFGSSLKVTKHPLSLTRFNVRKLLASENKLAVLTELGEVYEFDMKLLLDRDSTSSKNSTRTSFKFTPLWIFESSDLAALDIAWTADNSLILCTRNGTCWKRELRSKKREKSSSSPYSRGPYKYNRIENLQMVVGVRASASGSFFAIRNDYLPPPIYKPSNMLIDLLRSLLPYDHLLHVRQPRLIPPEDEDGVPIFDEDRAASSNEMQLLFEGSIPILTSYENYKQSFSDVTIYCGTSMFHSHKFILCARSSFLRKLLLQKKKSSVSNIIYIEEITQSHSTIRVEDIPPLAVAILLHYLYTDTLLSPWHLDSRFSPLKENLSKLANLLELPHLAEVLPFSVSRQPLLSLTNDILQLYNNFYVLCEETMDTVIKLKDGELKAHGLFLSLRSEYFSSYFQFVSMESNSFDIPITVNLSHLTVEHMSIVLRHVYSDLKVELFDDLKESDFHNWLETMFEILSIADELLFLELKSIAQQSLLRFLNLKTLPTLMDLSLSYHAEELYSRCIDYACHNIEFFLEANRISEWDGFHLKKVAQRLTELLSDQRVHLPSSKIANRLLIRDPVLMEKRNYELKVLREYLFSQESSQLWDDSPYRSIFEDRRCSTSAVILESGIVPSSNQSDSLNKEDAEEKSPKPNVVNVTSITKTAGASVEIQNNIESASSGGDKTQLNGPGADQPVTATITFDKTSPWRNRENLSHNNNTTRASLRELLEQEKADASTTTVLSDSRFMKAPTKKSQREKKKELSKQVPISKTNVGHIDIELGKSNHSNPWSVATHQRGSFSSSTGVKKSFNGILREAAREEGSSQVIYQESKKRISNGSPTSWNLLTKPSPRSASLPKNSQPLSISEIMTEQKEEIESQKRRSSFRKTIEEIQQEEEFQKWWEEESLRVQKELGILKTERDTSTNRKQGQASKQPQRRHRKEKDSKVSESTAEFKSLPIDIPRTTHKKGKARAVK

SEQ ID NO: 22127 - protein, 178 aa, Brassica rapa
MENMGTRVIEPLIVGRVVGDVLDNFTPTIKMNVSYNKKQVSNGHEFLPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 22128 - protein, 178 aa, Brassica rapa
MENMGTRVIEPLIVGRVVGDVLDNFTPTIKMNVSYNKKQVSNGHEFLPLAVSSKPRVEIHDGDLRSFFTLVMTDPDVPNPSDPFLKERLHWLVMNIPGTTDATFGKEVVSYELPKPNIGIHRYVFVLFRQKQRRVKFPSNIISRDQFNTREFAIENDLGLPVAAVFFNAQRETASCRR

SEQ ID NO: 22129 - protein, 177 aa, Brassica oleracea
ENMGTRVIEPLIVGRVVGDVLDNFTPTIKMNVSYNKKQVSNGHELFPLAVSSKPRVETHDGDLRSFFTQVMTDPDVPNPSDPFLKERLHRLVMNIPGTTDATLGKEVVSYELPKPNIGIHRYVFVLFRQKQRRVKFPSNIISRDQFNTREFAIENDLGLPVAAVFFNAQRETASRRR

SEQ ID NO: 22130 - protein, 177 aa, Brassica oleracea
ENMGTRVIEPLIVGRVVGDVLDNFTPTIKMNVSYNKKQVSNGHELFPLAVSSKPRVEIHDGDLRSFFTLVMTDPDVPNPSDPFLKGRLHWLVMNIPGTTDATFGKEVVSYELPKPNIGIHRYVFVLFRQKQRRVKFPSNIISRDQFNTREFAIENDLGLPVAAVFFNAQRETASRRR

SEQ ID NO: 22131 - protein, 465 aa, Trigonia nivea
  misc_feature (339)..(340): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGERDITLGFVDLXXDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 22132 - protein, 268 aa, Salmonella typhimurium
MERYENLFAQLNDRREGAFVPFVTLGDPGIEQSLKIIDTLIDAGADALELGVPFSDPLANGPTIQNANLRAFAAGVTPAQCFEMLALIREKHPTIPIGLLMYANLVFNNGIDAFYARCEQVGVDSVLVADVPVEESAPFRQAALRHNIAPIFICPPNADDDLLRQVASYGRGYTYLLSRSGVTGAENRGALPLHHLIEKLKEYHAAPALQGFGISSPEQVSAAVRAGAAGAISGSAIVKIIEKNLASPKQMLAELRSFVSAMKAASRA

SEQ ID NO: 22133 - protein, 395 aa, Escherichia coli
  misc_feature (210)..(210): Xaa can be any naturally occurring amino acid
MADKKLDTQLVNAGRSKKYTLGAVNSVIQRASSLVFDSVEAKKHATRNRANGELFYGRRGTLTHFSLQQAMCELEGGAGCVLFPCGAAAVANSILAFIEQGDHVLMTNTAYEPSQDFCSKILSKLGVTTSWFDPLIGADIVKHLQPNTKIVFLESPGSITMEVHDVPAIVAAVRSVVPDAIIMIDNTWAAGVLFKALDFGIDVSIQAATXYLVGHSDAMIGTAVCNARCWEQLRENAYLMGQMVDADTAYITSRGLRTLGVRLRQHHESSLKVAEWLAEHPQVARVNHPALPGSKGHEFWKRDFTGSSGLFSFVLKKKLNNEELANYLDNFSLFSMAYSWGGYESLILANQPEHIAAIRPQGEIDFSGTLIRLHIGLEDVDDLIADLDAGFARIV

SEQ ID NO: 22134 - protein, 354 aa, Lycopersicon esculentum
MSCFSCCDDDDMHRATDNGPFMAHNSAGNNGGQRATESAQRETQTVNIQPIAVPSIAVDELKDITDNFGSKALIGEGSYGRVYHGVLKSGRAAAIKKLDSSKQPDREFLAQVSMVSRLKDENVVELLGYCVDGGFRVLAYEYAPNGSLHDILHGRKGVKGAQPGPVLSWAQRVKIAVGAAKGLEYLHEKAQPHIIHRDIKSSNILLFDDDVAKIADFDLSNQAPDMAARLHSTRVLGTFGYHAPEYAMTGQLSSKSDVYSFGVVLLELLTGRKPVDHTLPRGQQSLVTWATPRLSEDKVKQCVDARLNTDYPPKAIAKMAAVAALCVQYEADFRPNMSIVVKALQPLLPRPVPS

SEQ ID NO: 22135 - protein, 383 aa, Lactobacillus sakei
MAEKRDYYDVLGVGRDASDDEIKKAYRKLSKKYHPDINKAPDAEAKFKEVTEAYEALSDPQKRAAYDQYGHAGMNGGFGGGAGAGQGFGGFGGGAEGFGGFDDIFSSFFGGGARQQPNGPRQGSDLQYRMDLKFEEAVFGKETKISYSREAECHTCHGSGAKPGTSAETCHKCHGAGQIQVERQTPLGRMMSRETCDVCGGTGKEIKSKCDTCHGTGREEERHTVKVKVPAGVEDGQQMRLQGQGEAGSNGGPYGDLFIVFRVAPSDEFERDGAQIFVEVPISFVQAALGDEIEVNTVHGPVKLKIPAGTQTNTVFRLRGKGAPKLHGTGNGDQKVTVNVVTPKSLNSKQRDALKAFAVASGDSVNPQDNNLFDKILNKKHKK

SEQ ID NO: 22136 - protein, 364 aa, Zea mays
MASEPVARAVAEEVGRWGSMKQTGVTLRYMMEFGSRPTQRNLLLSAQFLHKELPIRFARRALELDSLPFGLSNKPAILKVRDWYLDSFRDIRYFPEVRSRNDELAFTQMINMVKVRHNNVVPTMALGVQQLKKELGRSRKVPFEFDEIDEFLDRFYMSRIGIRMLIGQHVALHDPKPEPGVIGLINTRLSPIQVAQAACEDARSVCLREYGSAPDINIYGDPNFTFPYVTLHLHLMLFELVKNSLRAVQERYMNSDKDVPPVRIIVADGEEDVTIKVSDEGGGIPRSGLPRIFTYLYSTAKNPPELDRPNTERVTMAGYGFGLPISRLYARYFGGDLQIISMEGYGTDAYLHLSRLGDSEEPLP

SEQ ID NO: 22137 - protein, 345 aa, Rhizobium sp. NGR234
MKKIAIIGDRFMLPDVFRDKIVAACGDGHDIRTLEQPWPDVPMEHGYAVEGMDGLKEYLGKPKEIVDFIGDAEILVTQLAPLSRAMFSELPRLKLVAVSRGGPVNIDMDAARDAGVRVVNTPGRNASAVAEFTIGAILAETRLIRVGHEALRKGEWRGDLYRADRTGRELSELTIGVIGYGNIGTKVVRLLRAFGTEVLVHDPYVQLSAEDRNAGVEHVSRDDLLARSDVVTLHPRVTAETRNMMNAETFAKMKPGAVFVNTARGPLCDYEALYESLVSGHLSSAMLETFAVEPVPEDWPLLKLPNVTLTPHIAGASVRTVTHAAEMAAEEVRRYIAGLPPVNPC

SEQ ID NO: 22138 - protein, 255 aa, Rhizobium sp. NGR234
MSKSRLWVGTSWKMNKTLSEAIAFADGLAAADAKRDDRIQRFVIPPFTVVREMKERLKETSVKIGAQNMHWEDAGAWTGEISPLMLKDCGLDLVELGHSERREHFGETDRSVGLKTAAAVRHGLVPLICIGETLAEREAGEADAVLKRQVEGAFALLDGAAKQAPILLAYEPVWAIGVNGIPATADYADARHQRIAEVAEAALGVAVPVLYGGSVNPGNCEELIAQPHVDGLFIGRSAWEVDGYLDILERVAGTI

SEQ ID NO: 22139 - protein, 408 aa, Rhizobium sp. NGR234
MSHIVIVGAGECGARAAFALREKGFEGEITLIGAEPHLPYERPPLSKSGLAGAEPPKYVAGPERYEEAGITLLTGASVEAIDRPRKAVQLADGRTIDYDRLLLATGARPRVLQGVPDNAERIRMLRTHADALAIRGALAPGRKLAIIGGGFIGLELAATARKLGAEVVLIEGLPRVLCRGVPEEIAAVVAERHRQEGVEIVCDARIAALEAGDNGARILFADGASRLADLIIVGIGAVPNTELAEAAGLLVENGIAVDETLRTSDPDIYAAGDCCSFPLSHYGGRRVRLEAWRNAQEQGTLAAANLLGVAEPVASVPWFWSDQYELTLQIAGLADGAATTVRRDLTDGAFILFHLDGEGRLVAASGIGPGNAVARDIRLAEMLIAAGSRPDPTALSSPETKLKKLLAA

SEQ ID NO: 22140 - protein, 487 aa, Rhizobium sp. NGR234
MQRFQCYIDGEFADGEGRFESVDPATGAAWAEMPEAREADVDRAVEAAHKALDAGPWSKLTATLRGKLLYRLADLVAENAQRLAELETRDTGKIIRETSAQIAYVAEYYRYYAGIADKIEGSYLPIDKPDMEVWLRREPIGVVAMVVPWNSQLFLSAVKIGPALAAGCTMVVKASEDGPAPLLQFARLVHEAGFPAGVVNIITGFGPACGAALSRHPKVDHIAFTGGPETARHVVRNSAENLASTSLELGGKSPFIVFADADLESAANAQVAGIFAATGQSCVAGSRLIVEKSVKDRFLEILKRKAEAICIGSPLDMATEVGPLATERQRAHIQALLGRSLAAGARLVTGGTAPDGAGFFYQPTILDCDGNSTPALEEEFFGPVLSVVSFETEAEALALANATRYGLAAGLFTRDLTRAHRLMKGIRTGIVWVNTYRAVSPIAPFGGFGLSGHGREGGMEAALDFTRTKTVWLRTSDDPIPDPFVMR

SEQ ID NO: 22141 - protein, 360 aa, Rhizobium sp. NGR234
MSKPFLQIRGIRKEYGPVTAVHDVNLDVAQGEFLTFLGPSGSGKSTTLYILAGFEDPTRGDIMLNGQSLLSTPSHKRNIGMVFQRYTLFPHLSVGENIAFPLKVRRLPKAEIDAKVRDMLKLVRLEGFEDRKPAQMSGGQQQRVALARALAYDPPVLLMDEPLSALDKKLREEIQHEIRRIHQQTEVTILYVTHDQEEALRLSDRIAVFSKGVIDQIGTGPELYANPATRFVAEFIGDSDFLPCDLVTAANGRADIALAGTTVIPNVPMHGKAVAGGKAALMLRPERLRLMRSAPGGATALPVTVSDITFLGNNIHVATETAKGDALAVRLPFGHEAISSLNRGDSVWLGFDPASAHVFC

SEQ ID NO: 22142 - protein, 443 aa, Rhizobium sp. NGR234
MYRTNTPNLENYWMPFTANRQFKAAPRLLASAEGVYYRDIDGNQVLDGTAGLWCVNAGHARKEISQAVERQLNTLDFAPSFQMGHPIAFQFAEKLAEIAPGEPGKKLDRIFYTGSGSESVDTALKIAIAYQRAIGQGTRTRLIGRERGYHGVGFGGISVGGLVNNRRVFPQVPGADHLRHTHDLARNPFTKGGLPEHGAELADDLERLVALHGAETIAAVIVEPVAGSTGVLLPPKGYLERLRATADKHGILLIFDEVISGFGRLGAPFAVDYFGVTPDIITTAKGLTNGVVPMGAVFTSSKVHDALMHGPEAQIELFHGYTYSGHPVACAAGLAAMEIYEKEALLTRASELATYWEDAVHGLRSRKNVIDIRTIGLVAGIELASRSEAAGARAYDVFVDCFKRGLLIRVTGDIIALSPPLTIEREQVDELMSILADALDRAD

SEQ ID NO: 22143 - protein, 370 aa, Rhizobium sp. NGR234
MKSRAAVAWAANKPLSIETIEIGGPKTGEALIEIMATGVCHTDAYTLSGLDSEGKFPAILGHEGAGIVREVGPGVTSLRPGDHVIPLYTPECRECKTCLSQRSNLCTSIRATQGQGLMPDRTTRFSCDAGEIFHYMGCSTFSNFTVLPEIAIAKVREDAPFDKICYIGCGVTTGIGAVIHTAKVWPGANVAVFGLGGIGLNVIQGARMVGADRIIGVDLNPAKAEMARRFGMTDFVNPNEVGTGKVVEAIQDLTGGGVDFSFDATGNTNVMRQALECCHRGWGESIIIGVAEAGKEISTRPFQLVTGRVWKGTAFGGARGRTDVPQIVDWYMEGKINIDDLITHTMPLDEINTAFDLMHEGKSIRSVVLF

SEQ ID NO: 22144 - protein, 414 aa, Rhizobium sp. NGR234
MQFTLPEEGAMHYDCLIVGSGHGGAQAATSLRQNGFQGSIGILSEDRDPPYERPPLSKDYLLGGKTFDRILIRPAEFWTSRSIDLLLGHEVVKVHAKEKQVLCADGATYSYGYLIWSAGGRPRRMSCPGHDLQGIHAVRTRSDVDRLVKDLASAEGVVVVGGGYIGLEAAAALTKLGKTVTVVEAMNRVLARVAAEPLSRFYEREHRDHGVEIRLETGVDKFVGSEGRLTGVLLKDGVTLPADIAIVGIGIVPCVEPLIEAGASGENGLDVDEHCRTSLPDVFAVGDCARVKSAHGLRIESVQNAHDQATAVAKTLCGELTPYSATPWFWSNQYDLRLQTVGLSAGFDRTVVRGDPNTRSFSIVYLREGAVIALDCINSVRDYVEGRMLVERRARVSPDVLANNSIRLKSLALA

SEQ ID NO: 22145 - protein, 425 aa, Rhizobium sp. NGR234
MPSKLAGPLAKAESRSPTMARPHTAGHPSLAWETLALDGGLTIDPATKAIAPNISMSVNNLLVPGDGAFSADGVEDLTALPFLYARWTNPTVRQLELRMAALEGADDALATATGVAAIAATFLTCLKRGDHLIISDVCYAGANELARRMLPDYGIEVTAVNMSRLDEVAAAFRPNTRLVHCESPCNPILRLTDLSAVAALAHRHGALVSVDSTLATPVATRPLALGVDLVIHSLTKFINGHGDALGGIVCGRKELVEKIRSRAGVYLGASLSAQNAWLIMRGIDTLFPRLKAMSDSAMRIAHFLRDHPGVRSVTYPGLETHPQHALARRQMRIFGGIVTFQTDDPQKIALRLAERLRVVHYAFSLGHQRSIVVLLDTKEMMNSTYGLEGPQLDDYRAFAGDGVFRLSVGLESVDDIIADLDRALR

SEQ ID NO: 22146 - protein, 336 aa, Rhizobium sp. NGR234
MLHTTVTQLIGQTPVMSIDVPERDATLVLKIEKNNPGGSMKDRMARSMVVAALEDGRLAPGGTIVESSSGNTGTGLALAALEFGLRFIAVVDHHAAPDKIRMMRALGAEIRYVEGDFAEDQVAVVERQRLAAQLGAQLPGAMFMNQSDNPANPDGYAGLVDELIAQLPGGIDAFVGCVGTGGSMTGIAQRLKRHNPAVRTIAVEPAGSIVFGKPGHPYYQSGTGTPAGDEVGKVLDYGCIDEGVQVTDVQAFETARYIARRKGLLVGGSTGGAIFKALEFIVEGKLTGTVVTTVADGGEKYLGTIFDDEWMAKRRLLEPAIAAQLDGWLAGRARAA

SEQ ID NO: 22147 - protein, 401 aa, Rhizobium sp. NGR234
MREPPSRQARRAGAMHAPVRERRHHPDFNMLDSQGWKALEAEAKLSGKGWGREKQWALEMGLPGSESLTDKSIPTFARGELPHFAGINTFLKAPYVENVRDVGKYDAAVLGIPFDSGTTYRPGTRFGPQGIRRISALYTPYNYEMGVDLREQMTLCDAGDVFTIPANLEKSFDQITRGVSHVFSSGALPIMLGGDHSIGFPCVRGIAECTSKRIGIIHFDRHIDIQQKDLDERMHTTPWYWATNLPNVSPKNLVQLGIGGWQVPRDGVKVARERGTNVLTIDDIEKLGPEKTAEIALELAWKDADAVYISFDVDSIDCGFVPGTGWPEPGGFLPREALKILGLVAAEGLCGLEVVEVSPPYDTSDITALFGVRVVVEALGSMLAHGKLGSHKHLIDKPVSF

SEQ ID NO: 22148 - protein, 327 aa, Rhizobium sp. NGR234
MARVFISWPGYSPRDEDTGARLIAAGHELVLRPKRGNRTADELATLLEDCDAAIVSTDPFTREVLAGDRNLKVIARVGVGTDSIDHDAAKEFGVGISVTPGMNAETVADQTLAMILGLMRRVVTQDQAVKAGRWDRVGEATPTELYRKTVGLIGAGIIGKAVIRRLLGFGVRVLYFDAMVEKVHGAERCGSLDQLLGSSDIVSLHAPLLADTRELMNAARIALMPKGSYLINTSRGGLVQQPAVFAALRSGHLAGAALDVFEVEPPGAEALADVPNLIASAHIGGISTESIARMTRSATTSVLSVLNGEIPDTVINPDALRERLAGA

SEQ ID NO: 22149 - protein, 325 aa, Rhizobium sp. NGR234
MASNSYETGRLNLPFVGICTFGKNPYQPDWDAIDADVAILGAPFDCGTQWRAGTRFGPRAIREASTLFSFGHRGAYDHEDDITYLPSGEVSIVDIGDADIVHTDTMKSHANIEFGVRKILAAGALPVVLGGDHSVNIPCVNAFDEDCARKGPIHIVQIDAHLDFVDERHGVRYGHGNPMRRAAEKPYVSGLSQLGIRNVSSTAKEGYEDARKMGSDILSVRQIRVLGTDAVVERVPAGARYYVTIDIDGFDPSIAPGTGTPSHGGFIYYEVLEILAALAKRGTVVGIDLVEVAPDYDHTGGTSILAAQVLMNLIGRVMHAKAKQR

SEQ ID NO: 22150 - protein, 502 aa, Rhizobium sp. NGR234
MDESVRNYLDQYGVSDATRRFLAKPQKMFIDGAWSDSSNGATFDIFEPSTGGLITRAPSGTPEDLDRAVRAARRQFDGGAWRRLKPLERERLLHSLADLIEAHSDELAEIEAIDMGKSVTFAREIDIRGTVDTFRYFAGWASKLHGRTVEPSLPGNYLAYTRKEPLGVVAAIVPWNFPLQTLAWKLAAALAVGCTAIVKPAELTSLSTLRFAELVQEAGIPDGVVNIVTGKGSIIGAAMSTHPGINKVTFTGSTPVGQEVGRTAVGNLKHVTLELGGKSPVLVLDDADLQSAAVAVANGVFFNSGQVCDAGTRVYVQGSVHDAFLDELVSVTSALKIAPGLDRDCYIGPLVSAQQKKVVSGYIEAGRREGAELIHGGASLHRQGHFIEPAIFSHCKPQMSIVREEIFGPVLVTSPFDDLDDAVSLANDTPFGLAAAIYSNDLSRVHTLIPRLHAGSIYVNAHSTIDPAMPFGGFKASGFGKDLGPEQLDYLMETKAVWITLP

SEQ ID NO: 22151 - protein, 253 aa, Rhizobium sp. NGR234
MLNCAKDQPTLISLEDVQKWYGAFHALKSISLSVRKGEKIVLCGPSGSGKSTLIRCINALETIEDGKIVVEGQLLDGSTKSVDAIRREVGMVFQSFNLFPHMTVLQNCTLAPMRVRGTSRTDAERLAQKYLERVRILDQAEKYPAQLSGGQQQRVAIARALCMEPKVMLFDEPTSALDPEMVKEVLDTMIGLARDGMTMICVTHEMGFARQVADRVIFMASGEIVEEAEPDVFFKSPKHQRTKTFLGEILAHH

SEQ ID NO: 22152 - protein, 293 aa, Rhizobium sp. NGR234
MTSIDQSGTFTLGDCTVKRLGYGAMQLAGPGVFGPPRDQDAALAVLRQAVAAGVNHIDTSDFYGPHITNKLIRQALAPYPDDLVIVTKIGARRDENGGWLPAFSAEELTQAVHGNLRSLGLDVLDVVNLRIMFDAHGPSEGSIEAPLAALAELQQQGLVRHIGLSNVTPAQVTEGRRICDIVCVQNRYNLAHRADDALIDDLARDGIAYVPFFPLGGFTPLQSSTLSAIAQRLAATPMQVALAWLLRRAPNILLIPGTSSVAHLRENIAAAKINLSDDTLKDLDYMAENAGSA

SEQ ID NO: 22153 - protein, 458 aa, Rhizobium sp. NGR234
MYSNSLIELDRAHLIHPVASYRGHEKLGVRVLASAKGATVTDASGRQLIDGFAGLWCVNAGYGHESIVEAATRQMRELPYATGYFGLGSEPAIRLASELAERAPGNLDHVFFTLGGSDAVDSTIRFIRYYWIGRGEPQRDQFISVEQGYHGSSTVGAGLTALPAFHAGFGIPFDWQHKIPSHYAYRNPVGDDPQAIIDASLAALRQKVEEIGPERVAAFYAEPIQGSGGVLVPPKGWMKAMRQLCQELGILFVADEVITGFGRTGPLFACHEDEIVPDFMTVAKGLTSGYVPMGAVFMGDHIYQTIADSAGAGAVGHGYTYSAHPVSAAVGLEVLKLYENELLDNGRKAGARLMAGLESLKDHPLVGDVRGRGMLAAVELVVDKEKKTPLPAKAEPARRIFDRAWENGLVIRAFANGVLGYAPPLCCTEAEIDGIVERTRKVLDETLEDPAVRSGLSD

SEQ ID NO: 22154 - protein, 484 aa, Rhizobium sp. NGR234
MKLKDKELFRQAGVIGGEWIGAASGDVVEVFDPASQAVLGTVPDMGTAETRAAIEAAETAFGPWKKKTHAERAALLERWHALMIEHLEDLALILTLEQGKPLDEARGEIRYGAAFVKWFAEEARRIGGHTIPSPTPDRRIVVLKEAVGVCAIVTPWNFPNAMITRKVAPALAAGCTVVIKPSEFTPFSALALGVLAERAGIPAGVVNIVTGMPTAIGNEIMANETVRKISFTGSTRVGSLLMRGAADSVKRLSLELGGNAPFIVFDDADLDLAVEGAIASKFRNGGQTCVCANRILVQSGVYDAFAEKLAARVNAMKVGPGTEPGVAIGPMINAAAIDKIDRHVEDALAKGAKIAARGRSLPVGRQYTAPLVLTGATTEMLLASEETFGPVAPLFCFETEEEAITIANGTPFGLAAYFYTENLKRSWRVAEALEFGMVGLNTGAISTEVAPFGGVKQSGLGREGAQVGIEEYLELKSFHIGGLA

SEQ ID NO: 22155 - protein, 487 aa, Rhizobium sp. NGR234
MTLSFDPDSLPLPVGHFIGDRLLPAEGFIDMHRPSDGKAYAGCPIADEALVDQAVETAKKALKASNWGGLRPRERTVALQRWADLIESEAETLAKLEALSSTRPVGHLVAGDIAVSAEQIRFFAEFADKEGSDLVPTDDSNLGMIMTEPYGVVAAITPWNFPVSMAAWKLGPALAAGNAVVLKPSEMTPFSTVYLAELAIRAGMPAGLINIVLGDGTVTGTAITGHPDIAKVSFTGSTGAGAAIMANIARTGVKPMTLELGGKSPQLVFADADLDKAAAAIAQSMLSNAGQACVAGSRLIVEESVAAPLAEAIVTRMKAAKPGPTWDEATEYSPIISKRQLNRIHGIVEAAVAAGGECLFGGKQMDAPGYFYQPTLMAVRDSSSPAITEEIFGPVLTMQTFADEEEALALADHPTYGLAAGLFTRDLSRALRLTRRLQAGTVWVNRYSRSRDHILPTGGYKRSGIGKDLGREAYHANRKSKSVLISL

SEQ ID NO: 22156 - protein, 475 aa, Rhizobium sp. NGR234
MKHARKFYIDGEWVEPSVSKTLEVIDPSTEQPMGTIALGSAADAEKAVAAARRAFASYSQTSKQERVELLRRILTILKRRNDELGDIISREMGAPLAMARAEQAGIGAAHFEQAIKSFETFAFDYMQGTTRIVHEPVGVVAMITPWNWPINQIACKVAAALATGCTMVLKPSEIAPFNAVLFAEIMDEAGVPKGVFNLVQGDGPTVGAALASHPDVDMVSFTGSTRAGIAVAQAAAPTVKRVHQELGGKSPNIILRSADFPAAVAAGVRRCFGNSGQTCTAPTRMLVPAERMDEAGAIAARQADALVVGPPSDSRTDLGPVASAAQFDKIQALIERGIAEGAELVAGGLGRPSHLNAGYYVRPTVFARVTNQMSIAREEIFGPVLSIIGYDSEDEAIAVANDTPYGLAAYIQGDPKETRALAGKLRSGTVRLNSSGWDSAAPFGGYKQSGNGREYGKFGLHEFTEIKGIVGFLNE

SEQ ID NO: 22157 - protein, 456 aa, Rhizobium sp. NGR234
MSKQATTLPKGFRGDMPNGFNPQDTSHLTSEDLAHITRRQRLLGPAYRLFYKSPVEVSRAKGVFLYDRHGNEYLDAYNNVVSLGHSHPRVVEAIQKQLEVLCTHTRYMQEPLLDYAEALINTFGGELGRTGCAMFTCTGSEANDLALRIARYHTRKTGVIVTAEAYHGNSGAVAAISPSLGKKSALDPYLRTVAAPDSYRLPVEEIGRRMAEDVARQIADMERHGGGLAAFIADSVFSSDGLYVDPTDVLAPVAEVVRKAGGLFIADEVQSGFGRTGTHLWGHSRHKVDPDIVTMGKPMGNGYPVAGVVLRPELVAEFGSSMRYFNTFGGNSVAIAAARAVLDTILEEGLMDNAAKVGSEILDGLRDLQTKYEFVGDVRGAGLYFAVELVKDRDRKTPDMDRALAAVNALRDRRILISATGVDAHILKIRPPLIFTSANAARLLEGVDEALRSVQI

SEQ ID NO: 22158 - protein, 444 aa, Rhizobium sp. NGR234
MSTDLMPNRFTPGEATIPPRESELIARRDSVLGASYRLQYRRPVLFVRGEGIWLYDPDGRRYLDFYNNVPSLGHCNPEINAAVADQASRISANTRYLEPRLVDYAERLVATFPGELNRVVFTCTGSESNDLALRIARLTSGNEGVIVSSHAYHGTSAATAMVSPNLGDAVKLSPAVRMVSLPGPAGISEAQAADFFEAQVRAAITDLNRRGTGIAALLIDSIFSSDGVWVDPPGFIVGGVRAVREAGGLVIADEVQPGFGRTGTHMWGFERHEVVPDLVTLGKPMGNGFPIGAVVGRKAPMDRFGATARYSNTFGGNTVGIAAADAVLTILQRDQIPEHAHAMSERLRLGLEHLAKLHPGIRGIRNAGLFFGIDIGLDGAEEASRRAMALDIVNLMRDDGVLISTTGANEDTLKVRPPLICQAAHVDRFLEAMECALKKAVAQM

SEQ ID NO: 22159 - protein, 168 aa, Elaeis guineensis
MLVYQDLLTGDELLSDSFPYKEIHNGMLWEVEGKWVIQGAVNVDIGANPSAEGGEEDEGVDDQAVKVVDIVDTFRLQEQPAFDKKQFVTFMKRYIKNLTPKLDAEKQELFKKHIEGATKFLLSKLSDLQFFVGESMHDDGCLVFAYYKDGATDPTFLYFAYGLKEIKC

SEQ ID NO: 22160 - protein, 349 aa, Chenopodium rubrum
SKTHFKMTTLETEQEQQPFSQNSPLFLDCLYCEEKYWDYDYHDEDDFGSLNSSKLHDCSLICCEDDEEIQLNALVSKEEKINFDEGDLGGNQLVMETRREALEWMIRVNYHHNFSVITLVLGVNYFDRFMLSFGFQKEMPWMTHLAAVACLSLASKVEETHVPLLLDFQVEHEQIFEAKVVQRMELLVLQHSNGKMNAVTPLSYFGHLIRKLKLKPHFHCKILTRCENIIVSVILDPRFLCYVPSVLAAASMVQTLKEIGLWSILEHQNDIMNTLKLDKVKVEDCYNFIQEVSSNEKARKRKWYNNISSANRNPNNVLELVVSSESSNNDLPSETLPKKCRTMGPPCFG

SEQ ID NO: 22161 - protein, 326 aa, Quercus suber
MSGGAGKIVCVTGASGYIASWLVKLLLNRGYTVKASVRDPNDSKKTNHLQVLDGAKERLHLFKANLLEEGSFDSAVEGCDGVFHTASPFYHNVTDPEAELLEPAVKGTLNVLNSCAKFPSVKRVVVTSSMAAVHCNKKAKAPDVVVDETWFSDPDVCKETKQWYMLSKTLAEENVWKFAKEKGIDIVTINPAMVIGPLLQPTLNTSAAAILNLINGTHQTFPNVAFGWVNVKDVANAHIQAYEIPTASGRYCLVESVIHHSEVVRVLRKLYPSVQLPEKCADDKPFAPTYQVSKERTRSLGIEYIPFEVSLKETVESLKEKKFISF

SEQ ID NO: 22162 - protein, 238 aa, Lycopersicon esculentum
MADPDTTRTVVGIIGNVISFFLFLSPGPTFVQILKAKSVMEFKPDPYIATVLNCAVWVFYGMPFVHPDSLLVITINGFGLAIELLYVSIFFIYSDWSKRQKIIIALVIEAIFMAILIFVTLTFLHGTKDRSMLIGIVAIVFNIIMYTSPLTVMKKVITTKSVKYMPFYLSLANFANGIVWACYALLKFDPYILIPNGLGSLSGLVQLILFAAFYRTTNWDEDEKEVELSTSKSNKSDV

SEQ ID NO: 22163 - protein, 309 aa, Pisum sativum
WGIDKFRNVVEEYYGKKFEPFRSLPEWEFKSYLGWHQQGDGGLFCGLHVDNGRIAGKMKTALREVIEKYHLNVRLTPNQNLILTDIRAAWKRPITTILSQAGLLLPRYVDPLNITAMACPAFPLCPLAITEAERGIPSILKRIRDMFEKVGLKYNESVVVRITGCPNGCARPYMAELGLVGDGPNSYQIWLGGSSNQTSIARSFMDKVKLQDLEKVLEPLFYHWKQKRQSKESFGDFTVRLGFEKLKEFIEKWEGPAVPPTRHNLKLFTDKDTYEAMDGLAKLQNKNAHQLAMEVVRNYIASNLNGKGE

SEQ ID NO: 22164 - protein, 173 aa, Vibrio vulnificus
MEYNTSALCDIYMDQVDVVEPMFSNFGGRASFAGQITTVKCFEDNALIRETLEQDGVGRVLLVDGGGSLRRALLDGELAAIAEENEWEGIVVYGCVREVDELEDMNIGIQALASIPVGAAMQGVGEVDVPVNFGGVTFLPEDYLYADTTGIILSQEPLSADLEEDEEEPELLD

SEQ ID NO: 22165 - protein, 170 aa, Corynebacterium efficiens
MTDTHGTFIPTADLVDIIGDDVRSCDTQFRNLGGRTDFHGTITTVKCFQDNALLKSILGEDNPGGVLVIDGDASLHTALVGDIIAGLGRDHGWSGVVVNGAIRDSAVIGEMEFGCKALGTNPRKSSKTGAGERDVVVSFGGVDFTPGHYLYADSDGIVVTENPVKAPASN

SEQ ID NO: 22166 - protein, 440 aa, Tuber borchii
MITKIHARSVYDSRGNPTVEVDLTTTDTGLHRAIVPSGASTGQHEAIELRDKDKTKWAGKGVLKAVENVNTIIAPALIKEKFDVKDQATIDKFLIDLDGTPNKAKLGANAILGVSLAVAKAGAAAKKVPLYAHVADLAGTKKPFVLPVPFMNVINGGSHAGGRLAFQEFMIVPSEAPSFTEAMRQGAEVYQILKTLTKKKYGQSAGNVGDEGGWPDIQTVEEALDLITDAIDKAGYTGQIKIAMDVASSEFYKEDAKKYDLDFKNPDSDSSKWLTYQELADLYKSLAQRYPIVSIEDPFAEDDWEAWAHFYKTSDFQIVGDDLTVTNPIRIKRAIDEKSCNALLLKVNQIATLTESIQAAKDSYSAGWGVMVSHRSGETEDVTIADIVVGLRAGQIKTGAPARSERLAKLNQILRIEEELGEQAIYAGTSSEPPHLYIFI

SEQ ID NO: 22167 - protein, 196 aa, Schizophyllum commune
MQAIKCVVVGDGAVGKTCLLISYTTNAFPGEYIPTVFDNYSANVMVDGKTISLGLWDTAGQEDYDRLRPLSYPQTDVFLICFSLVSPPSFENVRTKWYPEISHHAPQTPVVLVGTKLDLREDPATIEKLRDRRMSPIQYSQGVAMMKDIGAVKYLECSALTQKGLKTVFDEAIRVVLYPSARSDNKRSKGRSCIVA

SEQ ID NO: 22168 - protein, 465 aa, Chrysophyllum oliviforme
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 22169 - protein, 465 aa, Clethra alnifolia
VGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHSGTVVGKLEGERDLTLGFVDLLRDDYVERDRSRGIYFSQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTI

SEQ ID NO: 22170 - protein, 465 aa, Diapensia lapponica
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENENSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHAGTVVGKLEGERDITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIRQAAKWSPELAAACEVWKEIKFEFEAMDTL

SEQ ID NO: 22171 - protein, 465 aa, Diospyros virginiana
VGFKAGVKDYKLTYYTPDYETKDTDILAAFRVTPQPGVPPEEAGAAVAAESSTGTWTTVWTDGLTSLDRYKGRCYHIEPVGGEETQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGERDITLGFVDFLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 22172 - protein, 465 aa, Styrax americanus
VGFKAGVKDYKLTYYTPEYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFFAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRLSGGDHIHSGTVVGKLEGEREITLGFVDLLRDDFVEKDRSRGIYFTQDWVSLPGILPVASGGIHVWHMPALTEIFGDDSVLQFGGGTLGHPWGNAPGAVANRVALEACVQARNEGRDLAREGNEIIREASKWSPELAAACEVWKEIKFEFEAMDTI

SEQ ID NO: 22173 - protein, 465 aa, Akebia quinata
VGFKAGVKDYKLTYYTPDLSTKDTDILAAFRVTPQPGVPPEEAGAAVAAESSTGTWTTVWTDGLTSLDRYKGRCYDIEPVAGEENQYICYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFLQDWVSLPGVLPVASGGIHVWHMPALTEIFGDDSVLQFGGGTLGHPWGNAPGAVANRVALEACVQARNEGRDLAREGNEIIREARKWSPELAAACEVWKEIKFEFEAMDTL

SEQ ID NO: 22174 - protein, 465 aa, Calycanthus chinensis
VGFKAGVKDYKLTYYTPDYQTKDTDILAAFRVTPQPGVPAEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYTKTFLGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSMPGVLPVASGGIHVWHMPALTEIFGDDSVLQFGGGTLGHPWGNAPGAVANRVALEACVQARNEGRNLAREGNEIIREASKWSPELAAACEVWKEIKFEFEAMDTL

SEQ ID NO: 22175 - protein, 465 aa, Chimonanthus praecox
VGFKAGVKDYKLTYYTPDYETKDTDILAAFRVTPQPGVPAEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYTKTFLGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSMPGVLPVASGGIHVWHMPALTEIFGDDSVLQFGGGTLGHPWGNAPGAVANRVALEACVQARNEGRNLAREGNEIIREASKWSPELAAACEVWKEIKFEFEAMDTL

SEQ ID NO: 22176 - protein, 465 aa, Cinnamomum camphora
VGFKAGVKDYKLTYYTPDYETKDTDILAAFRVTPQPGVPPEEAGAAVAAESSTGTWTTVWTDGLTSLDRYKGRCYHIEPVPGEETQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHVHAGTVVGKLEGERDITLGFVDLLRDDFIEKDRSRGIYFTQDWVSMPGVLPVASGGIHVWHMPALTEIFGDDSVLQFGGGTLGHPWGNAPGAVANRVAVEACVQARNEGRDLAREGNEIIREAAKWSPELAAACEVWKEIKFEFAAMDTL

SEQ ID NO: 22177 - protein, 465 aa, Cocculus trilobus
VGFKAGVKDYKLNYYTPEYETKDTDTLAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRVPISYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 22178 - protein, 465 aa, Hernandia ovigera
VGFKAGVKDYKLTYYTPDYETANTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 22179 - protein, 465 aa, Schisandra sphenanthera
VGFKAGVKDYRLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQRNHGIHFRVLAKALRMSGGDHIHSGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREASKWSPELAAACEVWKEIKFEFEAMDVL

SEQ ID NO: 22180 - protein, 465 aa, Xanthorhiza simplicissima
VGFKAGVKDYKLTYYTPEYTPKDTDTLAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLCDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSLELAAACEVWKEIKFEFEAMDTI

SEQ ID NO: 22181 - protein, 505 aa, Vinca major
MAIVDFLAAFLIFILTQKLIQTLFRRTYRRKLPPGPKGWPVIGALPYLGTMPHTSLAYMAKKYGPVMYLKVGTNDMVVVSTPDAARAFLKTLDINFSNRPPNAGATHLAYGAQDMVFAHYGPKWKLLRKLSNLHMRGGKALEDWSNVRISELGHMLETMYESSKKGEAVVVAEMLTYAMANMIGQVILSRRVFVTKGSDSNEFKDMVVELMTSAGLFNIGDFIPSIAWMDLQGIEGGMKRLHKKFDVLLTKLLEEHKESSSKRKGKPDLLDYVLANRDNSEGERLTTTNIKALLLNLFSAGTDTSSSIIEWALSEMLRNPSILKRAQHEMVQVIGRNRRLVESDISRLPYLQAICKETFRKHPSTPLNLPRIATEACEVNGYYIPKGTRLSVNIWAIGRDPDVWENPLEFNPDRFLSGKNAKIDPRGNDFELIPFGAGRRICAGTRMGILLVEYILGTLVHSFDWNLPSSVTKLNMDESFGLALQKVVPLAALVTPRLPINAYSP

SEQ ID NO: 22182 - protein, 395 aa, Monascus purpureus
MVVFSKITAVAAGFSTLAAAMPTLNRPNVKSFSLSQSAIPRQQKNFNFAATYAKTLAKYGGQIPASLKAAAEKGSVNTYPEPQDAEYLTAVDVGGTTLNLDFDTGSADLWVFSAELPSSEQSGHAIYKPSGNATKMSGYSWSISYGDGSSASGDVYKDTVTVAGITAPRQAVEAASTISSEFTQDKNNDGLLGLAFSSINTVHPKAQTTWFDTVKEDLDSPLFAVALKHNAPGTFDFGYVDKSKYTGSLTYADVDNSQGFWQFTADSYSVGSQSGSKSIVGIADTGTTLLLLPDDVVEAYYKQVEGAENDSQAGGYVFPCDSQLPSFTAVINGYSAVVPGSLINYASAGDGSNNCLGGIQSDQGIGQAIFGDIFLKSQYVVFDADGPRLGFAPQA

SEQ ID NO: 22183 - protein, 486 aa, Pseudomonas putida
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQGSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 22184 - protein, 446 aa, Cynodon dactylon
MAATIQSVKARQIFDSRGNPTVEVDVFCSDGTFARAAVPSGASTGVYEALELRDGGSYYLGKGVSKAVNNVNSVIGPALIGKDPTAQTEIDNFMVQQLDGTKNEWGWCKQKLGANAILAVSLAVCKAGASIKRIPLYQHIANLAGNKQLVLPVPAFNVINGGSHAGNKLAMQEFMILPTGAASFKEAMKMGVEVYHHLKSVIKKKYGQDATNVGDEGGFAPNIQENKEGLELLKTAIEKAGYTGKVVIGMDVAASEFYSDKDQTYDLNFKEENNDGSQKISGDSLKNVYKSFVSEYPIVSIEDPFDQDDWVHYAKMTEEIGEQVQIVGDDLLVTNPTRVAKAIKEKSCNALLLKVNQIGSVTESIEAVKMSKRAGWGVMTSHRSGETEDTFIADLAVGLSTGQIKTGAPCRSERLAKYNQLLRIEEELGAIAVYAGAKFRAPVEPY

SEQ ID NO: 22185 - protein, 447 aa, uncultured bacterium
MTTDRRPQSRGTCKTCGSGLARDGSVSGDINAGCTCLIASKLAPTGIGDYHDGHPTPAFMRSRMTFDFDQVFDRHNTGSTKWSRYPADVLPMWVADMDFAAPPVIVQGLQKRLEHPLLGYSVPQDDLRAAIVADLWNKYAWRIEPQELIFLPGVESGFNMALKALVQPQQNVVVQVPNYPPLRHAPGHWGLNKVELGFEAQADGTYVTPLDTLSQSLQGGGALLLSNPHNPLGKAFPREELQAIADICLEHGAWIISDEIHAELCFDGRQHIPMATLSPQVAQRTITLMSASKAYNIAGLKTSFMIIQDRHLREKVNHARCGMVDSVNPLGLEATRIAFSEAGPWLAELKDYLQSNRDYLVDAVRTRLPGITMNVPQSTYLAWLDCTALGLDNPQQFFLEHAKVGLSAGLDFGDDGQQFVRLNFGCPRSLLEEGISRMERSLRHLKC

SEQ ID NO: 22186 - protein, 207 aa, uncultured bacterium
MYRVPPDQECTMDLSRRQFFKVAGIGLAGSSLGALGMAPTSAFAEQVRHFKLAHTHETRNTCPYCSVGCGLIMYSQGDAAKNVAQNIIHIEGDADHPVNRGTLCPKGAGLLDFIHSPGRLQYPQVRKPGSTEWTRISWDEALDRVADLMKADRDANFIEKNAQGQTVNRWLTTGFLAASAASNEAGYITHKVVRSLGMLGFDNQARV

SEQ ID NO: 22187 - protein, 377 aa, Pseudomonas sp. M18
MDFNLDDSQKKLARQIAETCRERLPERPTAHFSPEQWAVCGEAGLLGLSIPRDYGGQGLGALSTAVAMHAFGHSCADMGLVFAAAAHQFACAMPIVEFASESLRRDLLPKMASGELIGSNAITEPGAGSDSTALKTRALPQDDGGYILDGFKSFAGNAPVADVFVAYATTQPEYGALGITGFVVESERPGVMVSEPLRKVCLRSCPAGEVTFAGCRVPVANRLGEEGQGRFVFQSSMGWERACLFAAFLGMMERQLEETLAYARSRRQFGKAIGAYQAVSHRIAEMKFRLESSRLLLYRACWGMDQGDPQQLHIALSKLAISEGALASSLDAVRIFGGRGCLEGFGIEEMFRDSVGTVIFSGTSDMQREIVARELGL

SEQ ID NO: 22188 - protein, 497 aa, Pseudomonas sp. M18
MKLLHECLVRSAREYPGNIAVVDQAGSCSYAELDARAEAYAGLLVALGVGRGERILLWAEKSVELPALMQGALRQGVVYVPVDPLGPVSRLEKILADSGASLVFSTASRLADLDALERRPRIVVLDDPACPLHWSHVELPASASAPEEIGEHDLAYILYTSGSTGTPKGVALSHRNALAFVEWANERFAFEARDRFSNHAPFHFDLSVLDLYCAFSRGAAVCLVPEGIAFSPALLTAFLQEQRISVWYSVPSVLLMMMRDGNLLQSCPDSLRVVLFAGEPFPIKHLRVLREAFPGLRMANLFGPTETNVCTCYEVVAVDPARLQPVPIGTAASGDEVWAEKDDGRRCEVGEEGELIVRGPTVMLGYFGQPAVTGSYRTGDLVRQLDDGNYEYLGRRDDMLKVRGYRIERGEVEAALLAHPRVREAAVIVAGGGMDAALWAFLVPSDGEAVSLIELKRHCAERLPRYMIVDRAKTLAELPRNANGKVDRFKLKALVED

SEQ ID NO: 22189 - protein, 178 aa, Escherichia coli
GKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAG

SEQ ID NO: 22190 - protein, 149 aa, Bacillus thuringiensis
KSFIDKGALVPDEVTIGIVRERLSQEDCVRGFLLDGFPRTVAQASALEEIMKDLGKKIDYVLNINVDSGLLLKRLTGRRICKECGATYHLEFNPPATADVCDKCGGELYQRSDDNEETVANRLDVNIKQTKPLLDFYDELGYLKSINGE

SEQ ID NO: 22191 - protein, 149 aa, Bacillus sp. AH 1131
KSFIDKGALVPDEVTIGIVRERLSQEDCAKGFLLDGFPRTVAQASALEEIMKDLGKKIDYVLNINVDSGLLLKRLTGRRICKECGATYHLEFNAPAKADVCDKCGGELYQRSDDNEETVANRLDVNIKQTKPLLDFYEELGYLQSINGE

SEQ ID NO: 22192 - protein, 149 aa, Bacillus sp. AH 1247
KSFIDKGALVPDEVTIGIVRERLSQEDCVKGFLLDGFPRTVAQASALEEIMKDLGKKIDYVLNINVDSGLLLKRLTGRRICKECGATYHLEFNPPANADVCDKCGGDLYQRSDDNEETVANRLDVNIKQTKPLLDFYEELGYLQSINGE

SEQ ID NO: 22193 - protein, 149 aa, Bacillus sp. AH 546
KSFIDKGALVPDEVTIGIVRERLSQEDCVRGFLLDGFPRTVAQASALEEIMKDLGKKIDYVLNINVDSGLLLKRLTGRRICKECGATYHLEFNPPAKADVCDKCGGELYQRSDDNEETVANRLDVNIKQTKPLLDFYDELGYLKSINGE

SEQ ID NO: 22194 - protein, 149 aa, Bacillus sp. AH 614
KSFIDKGALVPDEVTIGIVRERLSQEDCIKGFLLDGFPRTVAQASALEEIMKDLGKKIDYVLNINVDSGLLLTRLTGRRICKECGATYHLEFNPPAKADVCDKCGGELYQRSDDNEETVANRLDVNIKQTKPLLDFYGELGYLESINGE

SEQ ID NO: 22195 - protein, 149 aa, Bacillus sp. AH 627
KSFIDKGALVPDEVTIGIVRERLSQEDCIKGFLLDGFPRTVAQASALEEIMKDLGKKIDYVLNINVDSGLLLTRLTGRRICKECGATYHLEFNPPAKADVCDKCGGELYQRSDDNEETVANRLDVNIKQTKPLLDFYGELGYLGSINGE

SEQ ID NO: 22196 - protein, 149 aa, Bacillus sp. AH 641
KSFIDKGALVPDEVTIGIVRERLSQEDCIKGFLLDGFPRTVAQASALEEIMKDLGKKIDYVLNINVDSGLLLTRLTGRRICKECGATYHLEFNPPAKADVCDKCGGELYQRSDDNEETVANRLDVNIKQTKPLLDFYEELSYLQSINGE

SEQ ID NO: 22197 - protein, 149 aa, Bacillus sp. AH 663
KSFIDKGALVPDEVTIGIVRERLSQEDCIKGFLLDGFPRTVAQASALEEIMKDLGKKIDYVLNINVDSGLLLKRLTGRRICKECGATYHLEFNPPAKADVCDKCGGELYQRSDDNEETVANRLDVNIKQTKPLLDFYEELGYLQSINGE

SEQ ID NO: 22198 - protein, 149 aa, Bacillus sp. AH 675
KSFIDKGALVPEEVTIGIVRERLSQEDCIKGFLLDGFPRTVAQASALEEIMKDLGKKIDYVLNINVDSGLLLKRLTGRRICKECGATYHLEFNPPAKADVCDKCGGELYQRSDDNEETVANRLDVNIKQTKPLLDFYEELGYLQSINGE

SEQ ID NO: 22199 - protein, 149 aa, Bacillus sp. AH 685
KSFIDKGALVPDEVTIGIVRERLSQEDCIKGFLLDGFPRTVAQASALEEIMKDLGKKIDYVLNINVDSGLLLTRLTGRRICKECGATYHLEFNPPAKADVCDKCGGELYQRSDDNEETVANRLDVNIKQTKPLLDFYEELGYLQSINGE

SEQ ID NO: 22200 - protein, 149 aa, Bacillus sp. AH 727
KSFIDKGALVPDEVTIGIVRERLSQEDCVRGFLLDGFPRTVAQASALEEIMKDLGKKIDYVLNINVDSGLLLTRLTGRRICKECGATYHLEFNPPAKADVCDKCGGELYQRSDDNEETVANRLDVNIKQTKPLLDFYEELGYLQSINGE

SEQ ID NO: 22201 - protein, 389 aa, Oryza rufipogon
MVAEHPTPPQPHQPPPMDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVVRPPPSAATPRHYPDFTWADLMRFTQRHYRADTRTLDAFTRWLAPPAADAAATAQVEAAS

SEQ ID NO: 22202 - protein, 475 aa, Rickettsia montanensis
MNLLKNITGKNYINGEFIEFGKQISVINPATLKEIATVPNLGLSEINSAINNTVTSFSSWSQSSFEARIAILRRWYNLVIENIEELSHILTLEQGKVLAESKKEILYGVSFIDWYTYAIHNIHSTIKPGNSKAHKIVTQYEPVGPSAAITPWNFPNAMITRKVVPAIAAGCSVILKPSSLTPLSALVLAKFASDAGLPAGVFNVITGSSDIIGKAFCEDFRLRKLSFTGSTNVGKILYQNAANTLKRLSLELGGNAPFIITADNNLEKVVSDLITAKTRNSGQSCISPNRIFIEESIYEKFIEILKAKFTKLKAGDGFDKESDVGPLINSAAIEKIQKLLADAQSKGAKLICGGKAVDNFIEPTIIIDCLDNMDIFRTEIFGPVVACYKFKDLDEVIERANNTEYGLQGYVYSNNISVVQMIASKLDFGMVSINDPLPANAKAPFAGRKASGFGVEGSFEGIFEYLNTKYINLQH

SEQ ID NO: 22203 - protein, 475 aa, Rickettsia rickettsii
MNLLKNITGKNYINGEFIEFGKQISVINPATLKEIATVPNLGLSEINSAINNTVTSFALWSQSSFEARIAILRRWYNLVIENIEELSHILTLEQGKVLAESKKEILYGASFIDWYTYAIHNIHSTIKPGNSNTHKIVTQFEPVGPSAAITPWNFPNAMIARKVVPAIAAGCSVILKPSSLTPLSALVLAKFASDAGLPSGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDVGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 22204 - protein, 219 aa, Prunus persica
FIGSWLVMRLLERGYTVRATVRDPTNQKKVKHLLELPKAETHLTLWKADLADEGSFDEAIQGCTGVFHVATPMDFESKDPENEVIKPTINGVLDILKACLKAKTVRRLVFTSSAGTVNVEEHQKSYYDETDWSDVEFCRSVKMTGWMYFASKTLAEQAAWKFAKENNIDFITIIPTLVIGPFLMPSMPPSLITGLSPLTGNTSHYSIIKRGQYVHLDDL

SEQ ID NO: 22205 - protein, 471 aa, Salmonella enterica
MIIPIIMAGGSGTRLWPLSRSLYPKQFLSLTSQHSLLQETLNRLKGLDCLSPIIVSNNEHRFIVAEQLRQLGINNFQIILEPVGRNTAPAVALAALKALELYGDHLMLVLAADHAIQNVDAFHTAIVAAEKEALNNKLVTFGIVPTKPETGFGYIKKGERVNDSSFQVESFVEKPDIETAKDYLKQNCYLWNSGMFMFKASTYLEELNKYRPDILSACKESLSGACTDLDFIRLNSEKFAACPDESIDYAVMEKTQDCVVVPLDANWSDIGSWSSLWDISEKDKNKNVSHGDVINYNSKNNYIYSESALISTVGVNNLIIVQTKDAVLVAQQDNVQDIKKIVEILKDSKRNEHISHREVYRPWGRYDSVEHGERYKIKRIMVKPGECLSSQMHHHRAEHWVVVAGTAKVTCGEQTYYVAENESTFIPIGTIHSIENPGKIPLEVIEIQSGPYLEDDDIIRLADKYGRVGEK

SEQ ID NO: 22206 - protein, 358 aa, Paenibacillus sp. Dex50-2
  misc_feature (241)..(241): Xaa can be any naturally occurring amino acid
NCISKAEGLPSAGDDKYAWGGEFFLCGPRLEQYLKEMNEEVLSKYDVMTVGEMPGVTPELAARYTDPANKELNMVFHFETMDIDAGEGGKWNFTKWKLADLKAVTNKWQYGLNGRGWNSLYLNNHDQPRMVSRFGDDTVYRKESAKLLATFLHTLQGTPYIFQGEEIGMTNVKFDNIDQYRDIETLNFFKEAVHDGGMPVEQAMAAIYAKSRDNARTPMQWNESKHAGFTTGEPWIGVNPXFKEINVEDALRDKDSIFHYYKKLIQLRKQHPIMIYGDYDIVAEEHEQIYAYTRTWRNEKWIVILNFSDREAEFTLPEKLEEYRSGNQLIISNYENVTETPIRELNLRPYEARVYRLV

SEQ ID NO: 22207 - protein, 377 aa, Saccharomyces cerevisiae
MIPKLYIHLILSLLLLPLILAQDYYAILEIDKDATEKEIKSAYRQLSKKYHPDKNAGSEEAHQKFIEVGEAYDVLSDPEKKKIYDQFGADAVKNGGGGGGPGGPGAGGFHDPFDIFERMFQGGHGGPGGGFGQRQRQRGPMIKVQEKLSLKQFYSGSSIEFTLNLNDECDACHGSGSADGKLAQCPDCQGRGVIIQVLRMGIMTQQIQQMCGRCGGTGQIIKNECKTCHGKKVTKKNKFFHVDVPPGAPRNYMDTRVGEAEKGPDFDAGDLVIEFKEKDTENMGYRRRGDNLYRTEVLSAAEALYGGWQRTIEFLDENKPVKLSRPAHVVVSNGEVEVVKGFGMPKGSKGYGDLYIDYVVVMPKTFKSGQNMLKDEL

SEQ ID NO: 22208 - protein, 334 aa, Saccharomyces cerevisiae
MASKTLRVLFLGPKGTYSHQAALQQFQSTSDVEYLPAASIPQCFNQLENDTSIDYSVVPLENSTNGQVVFSYDLLRDRMIKKALSLPAPADTNRITPDIEVIAEQYVPITHCLISPIQLPNGIASLGNFEEVIIHSHPQVWGQVECYLRSMAEKFPQVTFIRLDCSSTSESVNQCIRSSTADCDNILHLAIASETAAQLHKAYIIEHSINDKLGNTTRFLVLKRRENAGDNEVEDTGLLRVNLLTFTTRQDDPGSLVDVLNILKIHSLNMCSINSRPFHLDEHDRNWRYLFFIEYYTEKNTPKNKEKFYEDISDKSKQWCLWGTFPRNERYYHK

SEQ ID NO: 22209 - protein, 305 aa, Schizosaccharomyces pombe
MGTSGIEIFAALNDFTDAIVSVPESVCGKFTSLKEIDAQVRDIRQNVIQEIGVVLKNEKNDELSGEERCERLQKTLKEILPYSDSKICLATDAMNNIKSCIDRLDAGFEYVELEIPQQLRLGYPDDRALMNYHSTVTPQTSERRRETRRHQNNQHSQQYSSQERSSSYNNFEDASSPQSSYHTPTKRRKNAVPRKSSSPPLSSTKHAPQSTERRPVRRSESRLKQTNGEPLVKHDTLDSSDISREGEQLYCYCQQVSYGQMIGCDNENCKREWFHLPCVGLVEPPKGIWYCKECEELAKSSESRQ

SEQ ID NO: 22210 - protein, 401 aa, Populus nigra
MATKKSVSSLKEADLKGKSVFVRVDLNVPLDDNFNITDDTRIRAAVPTIKYLMGHGARVILSSHLGRPKGVTPKYSLKPLVPRLSELLGVDVKMANDCIGVEVEKIVAEIPEGGVLLLENVRFYKEEEKNDPEFAKKLASLAEIYVNDAFGTAHRAHASTEGVAKYLKPAVAGFLMQKELDYLVGAVANPKKPFAAIVGGSKVSSKIGVIESLLEKVDLLFLGGGMIYTFYKAQGHSVGSSLVEEDKLDLATSLIEKAKVKGVKLLLPADVVVADKFAPDANSKVVPASEIPDGWMGLDIGPDSIKTFSEALDTTKTIIWNGPMGVFEFEKFAAGTEAIARKLAELSGKGVTTIIGGGDSVAAVEKAGLADKMSHISTGGGASLELLEGKPLPGVLALDDA

SEQ ID NO: 22211 - protein, 401 aa, Populus nigra
MATKKSVSSLKETDLKGKRVFVRVDLNVPLDDNFNITDDTRIRAAVPTVKYLMDHGARVILCSHLGRPKGVTPKYSLKPLVPRLSELLGVEVKIANDCIGEEVEKLVAEIPGGGVVLLENVRFHKEEEKNDPEFAKKLASLAEVYVNDAFGTAHRAHASTEGVAKYLKPAVAGFLMQKELDYLVGAVANPKKPFAAIVGGSKVSSKIGVIESLLEKVDFLFLGGGMIFTFYKAQGYSVGSSLVEEDKLDLATSLIEKARVKGVKLLLPTDVVVADKFASDANSKVVPASEIADGWMGLDIGPDSIKTFSEALDTTKTIIWNGPMGVFEFEKFAAGTEAIAWKLAELSGKGVTTIIGGGDSVAAVEKVGLADKMSHISTGGGASLELLEGKPLPGVLALDDA

SEQ ID NO: 22212 - protein, 481 aa, Populus nigra
MASATAPTTLSLLKTAAASTSTSARASLLPVSTSGLRTTSLRGLGFSAADPLFSSHVVSKIRSFKSNGRAPRAVVSMAKKSVGDLTAADLKGKKVFVRADLNVPLDENQKITDDTRIRAAVPTIKYLISKGAKVILSSHLGRPKGVTPKFSLAPLVPRLSELLGIQVVKADDCIGPEVEKLVASLPEGGVLLLENVRFYKEEEKNEPEFAKKLASMADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLAVGSSLVEEDKLDLATTLLEKAKAKGVSLLLPSDVVIADKFAPDANSKTVPASAIPDGWMGLDIGPESVKTFSEALGTTQTVIWNGPMGVFEFEKFANGTEAIAKKLAELSGKGVTTIIGGGDSVAAVEKVGVADVMSHISTGGGASLELLEGKELPGVLALDEVERVAV

SEQ ID NO: 22213 - protein, 327 aa, Saccharomyces cerevisiae
MSSNDSNDTDKQHTRLDPTGVDDAYIPPEQPETKHHRFKISRDTLRNHFIAAVGEFCGTFMFLWCAYVICNVANHDVALVAAPDGSHPGQLIMIAIGFGFSVMFSIWCFAGVSGGALNPAVSLSLCLARAVSPTRCVVMWVSQIVAGMAAGGAASAMTPGEVLFANSLGLGCSRTRGLFLEMFGTAILCLTVLMTAVEKRETNFMAALPIGISLFIAHVALTAYTGTGVNPARSLGAAVAARYFPHYHWIYWIGPLLGSILAWSVWQLLQILDYTTYVTAEKAASTKEKAQKKVKPAVPLLWLKSNFPLLFFISRSLALNVIIFGKN

SEQ ID NO: 22214 - protein, 309 aa, Rhizobium etli
MADLQATLDSIYTDILPRIGEGKVADYIPELAKIDPRQFGMAIVTVDGQVFRVGDADIAFSIQSISKVFMLTLALGKVGEGLWKRVGREPSGSTFNSIVQLEHESGIPRNPFINAGAIAVTDVVMAGHAPREAIGELLRFVRYLADDESITIDDKVARSETQTGYRNVALANFMRAYRNLDHPVDHVLGVYFHQCALAMSCEQLARAGLFLAARGSNPMTGHSVVSPKRARRINALMLTCGHYDGSGDFAYHVGLPGKSGVGGGIFAVAPGIASIAVWSPGLNKVGNSQLGAVALEMLAARTGWSVFGD

SEQ ID NO: 22215 - protein, 246 aa, Arabidopsis thaliana
MATGGAAADLEDVQTVDLMSELLRRLKCSQKPDKRLIFIGPPGSGKGTQSPVVKDEYCLCHLSTGDMLRAAVASKTPLGVKAKEAMEKGELVSDDLVVGIIDEAMNKPKCQKGFILDGFPRTVTQAEKLDEMLKRRGTEIDKVSTLLLMTQSLEERITGRWIHPSSGRSYHTKFAPPKTPGVDDITGEPLIQRKDDNADVLKSRLAAFHSQTQPVIDYYAKKAVLTNIQAEKAPQEVTSEVKKALS

SEQ ID NO: 22216 - protein, 369 aa, Alcaligenaceae bacterium FB188
MAIGYVWNTLYGWVDTGTGSLAAANLTARMQPISHHLAHPDTKRRFHELVCASGQIEHLTPIAAVAATDADILRAHSAAHLENMKRVSNLPTGGDTGDGITMMGNGGLEIARLSAGGAVELTRRVATGELSAGYALVNPPGHHAPHNAAMGFCIFNNTSVAAGYARAVLGMERVAILDWDVHHGNGTQDIWWNDPSVLTISLHQHLCFPPDSGYSTERGAGNGHGYNINVPLPPGSGNAAYLHAMDQVVLHALRAYRPQLIIVGSGFDASMLDPLARMMVTADGFRQMARRTIDCAADICDGRIVFVQEGGYSPHYLPFCGLAVIEELTGVRSLPDPYHEFLAGMGGNTLLDAERAAIEEIVPLLADIR

SEQ ID NO: 22217 - protein, 413 aa, Mycobacterium vanbaalenii
MTSRVVIVGSSVGGVRTAQALRSQGYDGDVVLVGEETALPYDKPPLSKALLAGTSDIAAVTLLSRDAAAADAIELLLGRRAIGVDVAACQVEFADDEPLRYDHLVVATGASARPSPWGHGSGVHVLRTLEDCLRLRADLVAGARLVVIGAGFIGAEVASTARSLGLQVTVVDPVPVPMSRVLTEEIGGWFVDLHRDHGVHTRFGVGVENIEGERGNLKIGLTDGTVLEADTVVVGIGAVPNDGWLMPSGLVVDDGLVCDEFCRAVTSQNIYAVGDVSRWFHRARGVTMRIEHWTNAVDQASCVAHNILYPDELRCYEPVEYVWSDQYDWKIQFCGQTTHLGEPLVVGDRLSDNRFTALYPDREQRLSGAAIVNWPRALIECRRALKAGSDLETVRERLELLTNPPDTAATRSP

SEQ ID NO: 22218 - protein, 271 aa, Gloeobacter violaceus PCC 7421
MFPVLADKRSDEPISPQPSEAAVSRPASAPARAPSGSDTPVESTWPRRELLAEAVGTFVLVFAGTGAVVVNAVSGGALTHLGISFVFGAVVAALIYTLGHISGAHINPAVTLTLWALGRFPARRVVPYMLVQLAGAAAASVAVLVCFGNQAKLGATLPLAGNWAQAFAVELLLTFILMLVICGSALDARAPRGFAGLAIGLTVGLEAGFGGPISGASMNPARSFGPALVAGAWEAHWVYWLAPIAGALLAGWVWHQMRDPLEETSSRLDGG

SEQ ID NO: 22219 - protein, 432 aa, Gloeobacter violaceus PCC 7421
MVTSAFQTAQSHRLFAEAQQLMPGGVNSPVRAFKSVGSEPVFIERAEGAYLWDVDGNRYIEYINTWGPSIVGHSHPEVISALREALPKGTSYGAPTRLENQMARTVIDAIPAVEMVRFVNSGTEATMSALRLARAFTGREKIIKFEGCYHGHADMLLVQAGSGVATLGLPDSPGVPKSTTAATLTAPYNDLAAVEALFKQYPSDVAGLILEPVVGNAGCLVPEIGFLEGLRDLTHAHGTVLIFDEVMTGFRLSYGGAQARYGIEPDLTCLGKIIGGGLPVGAYAGRREIMQMVAPAGPMYQAGTLSGNPLAMTAGIKTLEILQRPGTYERLEGLSARLADGLLAAAREAGHAATGNRVGAMFTLFFTEGPVRNFADAKRSDLQKFARFHRGMLERGVYLAPSQFEAGFMSLAHTEEDIDYTVAAARTVLAAL

SEQ ID NO: 22220 - protein, 326 aa, Gloeobacter violaceus PCC 7421
MEQRQLGKGGPRVSALGLGCMGMSDFYGKADEQESIATVHQALDAGITLFNTGDFYGMGHNEMLLREALADRREQVFLSVKFGAQRAPDGTFLGFDARPAAVKTALAYTLRRLGTDHVDLYQPARIDPAVPIEETVGAIAEMVQAGYVRYIGLSEASAATVRRAHAVHPIAALEIEYSLLTRDIEAEVLPTVRALGIGLVAYGVLSRGLLSDRATGTFAADDFRAHLPRFAGENLQNNLALVEALRALAAEKGVGVAQLAIAWVLARGEDIVPLVGARRPARLSEALAAAQVHLSAEDMARIEAAVPTAAVAGTRYSTDQMAMLDS

SEQ ID NO: 22221 - protein, 129 aa, Gloeobacter violaceus PCC 7421
MAPLQGRDLLKLIKENQGKSAKQLAELAGYTTTTKSGQKRVKMLAFQSAILQANNISLIPRHEEGEGVRGGRKASYRIQVQQNGNLLIGTAYTRQMGLEPGTEFEIQIGRKHIKLVQLDSPDSPQTNED

SEQ ID NO: 22222 - protein, 248 aa, Gloeobacter violaceus PCC 7421
MSLVKRSVAEFIGTFWLVLGGCGAAVLAAAFPNLGIGFAGVSLAFGLTLLTMAFAIGHISGCHINPAVSIGLWAAKRFPATELLPYIAAQVLGGIAGAGVLYLIAGGKAGFSLSGGFASNGYGLHSPGGYTLLACLVCEVVMTFMFLMIILGSTDRRAPKGFAPIAIGLSLTLIHLISIPVTNTSVNPARSTGPALFVGDWAIAELWLFWLAPIVGAALAGLFYHAFLDEPGEETEGTPASAQLRTEA

SEQ ID NO: 22223 - protein, 127 aa, Gloeobacter violaceus PCC 7421
MGAVAGKELLQLIKQNPGRSAKQLAEMAGYTTTTKTGQQRVKMLAFQNAVLQANNINLRPVEEEQTNGVRGGRKATYRIQVQQNGNLLIGAAYTRQMGLTPGTTFEIQIGRKHIKLVQVDTDGAPLE

SEQ ID NO: 22224 - protein, 502 aa, Gloeobacter violaceus PCC 7421
MNLSRILDRQVQLHPDAPAFIGPEKSLTFGELARASAAVAGGLAQLGVVCGDRVAVMLPNVLPFPIAAYAIWRLGAQLVTVNPLLKPQEVRHLLTDSGARVLVSLGQLLPPIAELIAELNIQVVTVGGGELGTPFEHLFAAPPLLEPAAVAPEDVVAVLYTSGTTGRPKGAMLTSRNLGYDSEACAAALEIGPSDRLFMVLPLFHAYGMTIGLLVCTRNGASVYLEPRFVPAQALAHLKQFECTAFIGVPALFAALLTTEGTALTNLRFCISGGAPLPLPVLEAFEAKFQTVILEGDGPTECSPVTAVNPLRGVRKAGSIGIPLPGQQMTIRDPQSGEFLSDGEVGEILVRGPNTFKGYLNLPEETAQVFVDDWLRTGDLGYRDGDGYFYIVDRLKDLIIVAGLNVYAREVEEVLQSHPRVRMAAVVGEFDELRGEVVHAFVEPISEQEPPEAQEIIRYCREKLADYKCPRRVTVMAELPRSTTGKILKRVLKEGFKGYSAQ

SEQ ID NO: 22225 - protein, 320 aa, Gloeobacter violaceus PCC 7421
MSTHVLCLGEMLLDCLADQPDRPEAQVASWTSYPGGAPANVACALAAIGGKSCFVGCLGADPEGERLLAVLERSGVNTAGVQRAPWPTRKVYVTRTAAGERTFASFGGHPPDAFADTHLQAEKITPDLFDGAAFLTLGTLMMAFPDSARAVEGALDLADERFVKICLDVNWRPVFWEQPEQAPAVVRGLIERCDVLKVSEEEAEWLGMPSIEAITAAFDHLEGILLTRGENGCLWQVGERRGEHLGYRVPTVDTTGAGDAFVAALLHRLSRAPLRAWESEAAAVVDYACAAGALSTMIPGGIGSTPDEAAVQAFLRAQAL

SEQ ID NO: 22226 - protein, 277 aa, Gloeobacter violaceus PCC 7421
MILRVAFLGPSGTYAEEATLALLGNECERLAHPSIQGTLRAAAAGEVDCAVVPVENAVEGTVSATLDTLWLYPQLRVRRALVLPVRHCLIGPVQHLTDIQAVYSHPQALAQCQGWLEEHLGAVERIPTASTSEALRHIGAHTAAIASERAARLHGLRVIFRAINDHPDNCTRFWLVSEKPLTETLPPPGGCTSIAFALRRNQPGVLHEVLSIFARHRINLAKIESRPTKKVIGEYLFFADLEGGVEAEPVNTALRQVAAVVAELNILGSYAVEQSGG

SEQ ID NO: 22227 - protein, 404 aa, Gloeobacter violaceus PCC 7421
MVAVMTVQQAFEQHVMHTYARFSVVFERGEGCYLEDSEGRRYLDFVAGIATCVLGHAHPVLSAAVAEQARTLIHVSNLYYTPQQACLAEWLTAHSAADQVFFCNSGAEANEGAIKLARKYGRTVLGIAEPQIICAHQSFHGRTMATVTATGQPKYQKHFHPLVPGFVHVPYNDFEALRAQVTDATAAVLIEPIQGEGGVVPGDVEFFQKLRRFCSERRILLMLDEVQTGMGRTGRLFGYEHLGIEPDVFTLAKALGGGVPIGALCAKEAFAIFEPGDHASTFGGNPLACAAALAVCQTLEAEQLVDNARERGAQLAAGLGRLVERFKPLVRTARGRGLMQGLVLSEPRAAEIVRLAMEQGLLLVSAGPEVIRFVPPLIVSAIEVDEALAILEGVFARLPVTVTA

SEQ ID NO: 22228 - protein, 499 aa, Gloeobacter violaceus PCC 7421
MPIALLSVSDKTGLVDFARALVTEFEYQLISSGGTARALAEAGVPVQEVGDFTGAAEMLGGRVKTLHPKIHGGILARRDQESDRRDLETHSIAPIDLVVVNLYPFEQDPRIEQIDVGGPTMVRAAAKNHAFVTVLVSPGQYEGCLAELRRNRGVTTLPFRAACAAAAFARTAAYDRAIAAWFAGSEPVLGERLVLELERVQPLRYGENPHQAAAWYRHGPAAGWSTGRILQGKALSFNNLIDLEASRRLVAEFDDTPAAVIIKHTNPCGVAADATIAAAYRRAFDADSASAFGGIVALNRPCDEPTAALLGQTFLECVVAPAFTLGALALLERKKNLRLLELADLTTPPVFDVKPISGGFLIQQVDAPVRAEDWKVVTEAVPDEDQRAELLFAWKVCQHVKSNAIVVSHLRQTLGVGAGQMNRVGSARLALAQAGEKARGAVLASDGFFPFDDTVRAAAERGIRAIVQPGGSLRDEDSIRACNELGVAMVFTGVRHFLH

SEQ ID NO: 22229 - protein, 507 aa, Gloeobacter violaceus PCC 7421
MSEQPIGIAPMDVHNTRLVAHTHPLDWVNPKPAGRYNLVVIGGGTAGLVSAGGAALLGGKVALVERHLLGGDCLVAGCVPSKALIRSARAMADVKDAHRYGIRVHGNVEADFGAVMERLRRVRADISPHDAAERFKNWGVDVFLGAARFTGPDTVRVGEVELRFKRAIVATGGRAARPEIAGLAEAGFLTNETVFSLTERPERLVVIGGGPIGCELAQSFARLGSQVTLLHKNERVLDREDPETSRIVGCALERDGVRVLTKARIEKVSRAGSIKTVHLAGGEQVACEAILLAAGRVPNVEGLGLEAAGVRYGKGGVEVDDRLCTSNPRIYACGDICLPWKFTHAAEASARIALENALFGGTLVLGQKKTSALTMPWCTYTDPEIAHVGLGEDEARKRGIAFDTIRLPLAESDRALTDGEEDGFIAVLLKQGSDKILGATLVARHAGEMISEITLAMVAGKGLATLSQVIHPYPTQAEIIRKVADAYESRSLERLRPFTEKWLAWLR

SEQ ID NO: 22230 - protein, 171 aa, Gloeobacter violaceus PCC 7421
MPRNQRNDNFIDKSFTVMADMILQMMPVKRQAKEAFAYYRDGMAAQADGDYAEALEYYNEALKLEEDAYDRSFIHYNIGLIHAANGAHDVALDYYDKALEENPRLPQALNNIAVIHHFRGAKVEEEGQPEQAEEHYAKAAAAWIRAVRLAPDNYIEAQNWLKTTGRFELLY

SEQ ID NO: 22231 - protein, 320 aa, Gloeobacter violaceus PCC 7421
MVSTEIGPSALGSVQPPAETDLLQWVGNTPLLRLERVTAGLSPDVEVYGKAEWFNPGGSVKDRPALNMILEGERSGRLTREKIILDATSGNTGIAYAWIAARRGYRVKLALPLNASEERKRILKAYGVDLILTDPTLGSDGAIQEARRLYAADPERYFYPDQYSNNANWQAHYLTTGVEIYQQTGGRVTHFVAGLGTSGTCMGVGRRLKEFDPAVRVIAMQPDSPFHGLEGLKHMETAIVPAIYNPALPDRQVEVSTEEAQRTVKRLAREEGMLVGISAGGNVAAALRLARELDRGVVVTILCDSADKYLSERFWDDPNL

SEQ ID NO: 22232 - protein, 320 aa, Gloeobacter violaceus PCC 7421
MHIAHDITELIGRTPLVQLNRIPAAEGALARIVVKLESFNPAASVKDRIGVSMINEAEKSGFILPGKTTLVEPTSGNTGIALAMVAAARGYRLILTMPETMSSERRALLRAYGAQLELTPGSEGMRGAIRRAEEITREVPDAFILQQFRNPANPKIHRETTAEELWRDTDGQMDIFVSGVGTGGTVTGVGEVWKVRKPGVQIVAVEPAASPVLSGGKPGSHLIQGIGAGFVPDVLRRDVIDEVIAVADEKAIEYSRRLAKEEGLLSGISTGAALWAALQLAKRPENTGKLIVFIQPSFGERYLSTALFQNEGQSPTAVAR

SEQ ID NO: 22233 - protein, 326 aa, Gloeobacter violaceus PCC 7421
MKVRALGNQGLVVSELGLGCMGMSEFYGATDETESIATIHRALELGINFLDTADMYGPYTNEQLVGKAIRDRRDKVVLATKFGIVRSEDRGFRGVNGSPEYVRSSCEASLERLGVEVIDLYYLHRVDPKVPIEETVGAMAELVQAGKVRFIGLSEAAPQTLRRAQRVHPISALQSEYSLWSRDVEDEILPTLRELGIGFVPYSPLGRGFLSGSITSPDDFAPDDYRRQSPRFQGENFTKNLQLVEKVRELATQKGVQPSQLALAWILAQGEDLVPIPGTKRVAYLEENVAATEIVLAPEELASIEAIAPRGAASGQRYADMSGVNR

SEQ ID NO: 22234 - protein, 436 aa, Gloeobacter violaceus PCC 7421
MLSLNRYQWTVLFAAWLGWGFDIFDSLLFNFVAPNCVPTLLGLTIGSPEAKEATLQWTGILTSLLLLGWAAGGILFGKIADQIGRTKTLLFTIILYAVGTASCAFAPNIWVLALCRLVASLGIGGEWAAGATMVAEVVPENKRVEAGAILYTAAPAGLLLATFLNLQVAGVFLKSSPETSWRYVFLFGLIPAAAALFVRLFLKEPERWQQVAGKQKPPAIAELFERQNLPLTLSGFLMAVTALLTWWSSSAFIPVVATGLAASEAALRGLAKPETQGLIENWKAIASNSFNLGGLIGTLLTVPAAKYLGRRTMFALYFLLSGAALLVTFGLELPPEVRLYLYFPIGLTVFGVFGSFTYYLPELFPTRLRATGAGFCYNVGRIVAAGGPFLVGYIASQGANSLQSALSTLFWVGFVPLVGLLFIPLVIETRGQVLAD

SEQ ID NO: 22235 - protein, 240 aa, Gloeobacter violaceus PCC 7421
MRRKVLAGNWKMYKTRGEARAFLEAFVPLISPGAENREVILCGPFTCLDLLSAQAGPYAVGAQNVHWADHGAYTGEIAPQMLVELGVHYVIVGHSERREYFNETDSTVNRRLNNAQDHDLVPILCVGETESVRKDGITEAHIRSQLDRDLELVDMRRLIIAYEPIWAIGTGKTCEANEANRVCAMIRKHVNFEGVPILYGGSVKPENIDELMAQSDIDGVLVGGASLEAKSFARIVNFEV

SEQ ID NO: 22236 - protein, 472 aa, Gloeobacter violaceus PCC 7421
MAKTPDDVLKMIQDEDVKIVDLKFIDLPGTWQHCSFATNQIDADAFAEGIPFDGSSIRGWKAINESDMLMVPDPSTAFIDPFFKETTLSLTCSIREPRTGEPYGRDPRTIAAKALEYLKGTGIADTAYFGPEAEFFIFDDVRFDQTQNAGYYYLDSVEGNWNTGRNEGPNLGYKPRNKEGYFPVAPTDSMQDIRTEMLLTMGSLGVPIEKHHHEVASGGQAELGVRFLSMVEAADALQIYKYVIKNVARKHGKVATFMPKPIFNDNGTGMHTHQSLWKDGQPLFAGDKYADLSEMALYYIGGLLKHAPAILAFSNPTTNSYKRLVPGFEAPVNLAYSQGNRSASIRIPLSGKSPKAKRLEFRCPDASSNAYIAFAAMLMAGLDGIKNKIDPGEPLDVDIYELSAEELAKVPSTPGSLSEALKALEEDHAFLTEGGVFSEELINVWIEYKLEKEVIPMSLRPHPYEFSLYFDV

SEQ ID NO: 22237 - protein, 483 aa, Gloeobacter violaceus PCC 7421
METSALQSGAQATHEKPSIGLIGLAVMGENLALNIANHGFPISVYNRTAAKTQELAEGRARGKALYPTFTMEEFVASMERPRKIIILVKAGAPVDAVIDQLKPLLEKDDVIIDGGNSLFTDTEKRSGEIEALGLRFVGMGVSGGEEGALKGPSLMPGGPKTAYDDLAPILTQIAAQVDDGPCVTYIGPRGAGHYVKMVHNGIEYGDMQLIAEAYDLLRQTLGLGAAELHDIFAEWNAGELKSFLIEITADIFTKIDPETGKPLVDLILDKAGQKGTGKWTSQNAYDLGIPIPTINAAVESRILSAYKSERVAASKILSGPERPPFTGEKKQFIDAVRDALYCAKICSYAQGMALLKAASHEYDYHLNLSELARIWKGGCIIRAIFLDKIKNAFLRDPALTNLLIDSEFSGDIQARQANWRYAVQTAAQLGIPAYATGASLAYYDAYRTAQLPLNLTQAQRDYFGAHTYERIDKEGVFHTEWFS

SEQ ID NO: 22238 - protein, 504 aa, Gloeobacter violaceus PCC 7421
MNLPLVHRAYEHGPRTAIVTADGQFSYQDLLSLSSQVATRLLDGADDLREQRVASLVPAGFEYVATQWGIWRAGGIAVPLCVSHPRPELEYVITNSGASIVIAHPSFESLLRPIAEAHQLRFILTSESLPPDTAQLPEVEPTRRALILYTSGTTGKPKGVVTTHGNIQAQVTSLISAWEWTSGDRILHVLPLHHIHGIVNVLTCALWAGAECHMLSKFDAETVWEHICEGNFTLFMAVPTIYTKLIATWEKAAGDRQMDMSRGCAGMRLMVSGSAALPVQVLERWTHISGHFLLERYGMTEIGMALSNPLHGQRRAGYVGMALPQVDVRLVDESGVSVPAGTPGEIQVKGPGVFLEYWQKPEATAKAFQDGWFCTGDLAVVEQDCYRILGRISVDIIKTGGYKVSALEIEEVLRTHPDIQECAVVGVADPEWGERVCGALVLQSGCNLALEPFRSWAKERLAAYKVPTRILSVEELPRNAMGKVTKPAVAQLFRAQQIAESQPA

SEQ ID NO: 22239 - protein, 503 aa, Gloeobacter violaceus PCC 7421
MNLAHLLDDQLRHRPEKVAFEGDGRSLSYAQLAHLSENFAASLTTAGYGPGDRIAVVLPNVPEYALAMFALWRRGAVPVLINPQLTGRELDYILRDSQARAVILPEALLGVLAPLRSELPNLRAIVLGVPADEDLNFAGLAATPGQCPVAERHGDDIAQMMYTSGTTGTPKGALISHGNLLANARSGIERLSVTGDDHLFCILPVFHAFAFTAALVIMPLVGGSVSFEYRLSPKKLMEHLSDPRVSVMVAVPSLLSTILRFPTELKLSAALRCILCGGGPLPPQLEAAFAQRFGDLVRQGYGMTECSPYAAFSPPDRPSKPGSIGLPMPQGHKLAVRDPISGDFAAPGTVGELVVSGPHVFKGYWNQPEATSEAFVEGWLRSGDLGYIDEEGYFFLVDRLKDMIIVGGEKVYSREVEDVLLAFAPLREVAVVGQPDPDKGEIVRAFVSLQEGAAIGEEEIIRFARERLAPVKVPRSITVLAELPKSATGKILKRELRKQFAPK

SEQ ID NO: 22240 - protein, 269 aa, Gloeobacter violaceus PCC 7421
MAIPVVVVGCAGKMGREVVKAVHAAPDMAVVGAVDRSHIDEDAGELAGIGPIDVLVTDNLEITCAMVAQERAPGVMVDFTHPRGIYDRVRSAIAYGVRPVVGTTGLPPEHIEELAEFADKASTGCIVAPNFAIGMILLQQACLRAAEYFDHVEIIELHHNRKADAPSGTALATAQMIATTGKTFNVPEVSESELVAGARGGMTPGDIRIHSLRLPGLLAHQAVIFGGLGQSYTLRHDTTDRAAYMPGVLLAIRKVLGLKSLVYGLEKII

SEQ ID NO: 22241 - protein, 218 aa, Gloeobacter violaceus PCC 7421
MAPHQFKSKGAPTLVHVREAARFDRDGLIPAVVQDVLDGTVLMVAWMNREALERTLETGESWFWSRSRQELWHKGATSGHRQKIKALRYDCDSDVLLLTVEQQGDIACHLGERSCFHRDEAGDYDLPPADTLSQVFRVVEERKAHPHPDSYTSRLLEAGSNKILKKIGEEATEVVMAAKDGERVAEEVADLWYHTLVLLAHADVDILDVYRALQQRRR

SEQ ID NO: 22242 - protein, 307 aa, Gloeobacter violaceus PCC 7421
MLPVIYTDRFLEHRTGAMHPERPQRLAAIVERLRRSPLAPSLAWQEPRQATREQLLWVHSAELVETVEQVCRAGGGSLDPDTTVSAESFEVASLAAGGWLDGVDAVIRTGEPAWVLARPPGHHAERGQAMGFCVFANAALAAHYALRVHGRTRVAVLDWDVHHGNGTQQLLWEESRLAYISLHQSPHYPGTGHSHERGAADNVLNVPLPAGCARKEYQQALDTLVWPFIERFDPELLIVSAGFDGHIDDPLAEMALRASDYGDFARQALARTRRVLFGLEGGYDLDGLAESVFAVTEACLSVRTRQV

SEQ ID NO: 22243 - protein, 220 aa, Gloeobacter violaceus PCC 7421
MATRRLMLLGAPGAGKGTQAQLLMQELGLPQVSTGDILRAAVKEGTPLGLEAQSYMNRGALVPDAVVVGLIEDRLARPDAGGGWILDGFPRTPAQAEALDGLLAHLAQSLEAVVLIDVPEAQLIERLTGRRTCPLCKRIFHVRFNPPPAAPPFCTDHTDCPSELVQRPDDTLEVVSKRLNVYRESTEPLIRYYQEQQKLTSVDGDRSPEVVYSELRELLG

SEQ ID NO: 22244 - protein, 321 aa, Gloeobacter violaceus PCC 7421
MTQKYGPKTTTDEVLSGIELKGKRFLITGASSGIGLETARSLVSHGASVVGAVRNLAKAEPATASVRDAASQGGSLELINLDLASLQSVRACADKLLADGQPFDAIIANAGVMATPFGRTIDGFEVQFGTNHLGHFALINQIEPLLANDGRLVVLSSLAHRGADIDLDDPNFEQQAYDPWVAYSRSKTANSLFAVEFDRRYRDRGIRAASVMPGNSLTDLPRHLSPEDLQGLLQTVDAARTEAGLPPKELKEISQAAATSVWAAVVANKDEIGGHYLEDCAVVPIDDTPNPFADGVRSYALDANRAKQLWAKSEELISAAS

SEQ ID NO: 22245 - protein, 512 aa, Gloeobacter violaceus PCC 7421
MEVRPMVVAAPAASASESIFKPRYDNFIGGQWRAPLKGQYTDNITPVNGRVLCQVPRSTVEDIELALDAAHAARESWGALSAAERSNILLKIADRMEANLHKLAVAETWDNGKPIRETTGADVPLAVDHFRYFAGCIRAQEGSISEIDGNTIAYHFPEPLGVVGQIIPWNFPILMAAWKLAPALAAGNCVVLKPAGPTPASILVWLEVVGDLLPAGVLNVVIGPGPEVGKALAASKRVAKVAFTGETETGRQIMQYAAQNIVPVTLELGGKSPNLFFADVMNADDDFLDKAVEGFVMFAFNQGEVCTCPSRALVHESIYEKFIDRAVRRVASIKQGNPLDPETMLGAQVSQAQMEKIARYVELGKQEGAEVLIGGERNSEPGEGLAGGYYYKPTVMKGHNQMRIFQEEIFGPVLAVTTFKDAEEAVRIANDTPYGLGAGVWSRDINTAYRVGRGIQAGRVWVNCYHVYPAHAAFGGYKASGVGRETHKMMLSHYQQTKNLLVSYDTKPQGFF

SEQ ID NO: 22246 - protein, 232 aa, Gloeobacter violaceus PCC 7421
MAHLILIRHGQSLWNAANKFTGWVDVPLSERGRAEATIASCKLRDYRVNVCFTSMLMRAIETAVITLTECDDICGGKIPIIKHEADDENWHGWDNYDGDPAAELPIYPTATLDERYYGDLQGLDKAETTAKYGKEQVQIWRRSYSVRPPGGESLEDTRKRVYPYFTNRILGHIKQGDNVLVAAHGNSLRSIIMILETLSEEEVPKVELATGVPIVYELDKAAHMLSKAVLTN

SEQ ID NO: 22247 - protein, 385 aa, Gloeobacter violaceus PCC 7421
MDIQIGRSKTVRRAYGIDEIALVPGRRTLDPDLADTGWTIGNVTREIPIIASAMDGVVDVKMAVELSRLGALGVINLQGVQTRYENPTEVLARIASVGKEAFVGLMQELYAEPVKPELIRRRIEEIKAQGGIACASATPQVAGQYGPIAAEAGCDLFFVQATVVSTAHLSSHETLDLAEFCAAMPIPVVLGNVVTYEVALDLMQAGAAAVLVGIGPGAACTSRGVLGVGIPQATAVSDCAAARDDYFAQTGRYVPVIADGGLVTGGDICKCIACGADGVMIGSPFARAAEAPGNGFHWGMATPSPVLPRGTRIKVGTTGTLAEILRGPARLDDGTHNLLGSLKTSMGTLGAKDLKEMQQVEVVVAPSLLTEGKVYQKAQQLGMGK

SEQ ID NO: 22248 - protein, 314 aa, Gloeobacter violaceus PCC 7421
METRRLGTNGPHITTIGFGAWAVDGPWQFGWGPVDDRESAAAIRAALDAGVNWIDTAAVYGFGHSEKIVGEAVKGRRDEVFIATKCGLLGGETKSPVRSLRPKSITAEADASLRRLGVDHIDLYQFHWPDVNTPVEDSWGAMVELVEAGKVRYAGVSNFDVPLLEKILPIHPVTSLQPPYSLIKRGIEAELVPFCREHGIGIVVYSPMQAGLLTGKFDPDRLAPDDWRRRAAWFAPENLDRNLALVEHLRPIAARYGKSVGQLAIAWVLRDTAVTSAIVGARRPDQVRENVEASGFHLGEADLAEIEAILATQS

SEQ ID NO: 22249 - protein, 205 aa, Gloeobacter violaceus PCC 7421
MENFAADRRIFADLLSFKPNRHTLGGASYLIVATPDNGLRGNWLIDCPAFVEENCTLIEGVGGIGAIFLTHRGAMGQVEEFCRHFRAAVRIHEQEAYLVKAREVEVRAFDGDCELDAGLSALWTPGHSPGSSCLLWQAHGGVLFSGRHLLPTSDGGAMPVRVGRTFHWPRQLASVERLGAYSYRHICPGAATGLLRSRRTIVVEP

SEQ ID NO: 22250 - protein, 219 aa, Gloeobacter violaceus PCC 7421
MALLVMVRHGQSIWNLENRFTGWTDVPLTEKGRAEARACGELIYCVPFAVAFTSKLTRAQDTLRLILEAADQPDVPVIEDQALNERHYGELQGLNKAETAAKYGEETVRQWRRSLEGRPPGGESLKDTALRSLRYFYEKIVPELEAGKNVLVSAHGNTIRAILMELDHLSPEQVEKVEIEYCVPVAFEHQADGTFSQVLMPRCDIIRPPQPPARSIARL

SEQ ID NO: 22251 - protein, 336 aa, Gloeobacter violaceus PCC 7421
MQKVIVEAFGGVERLHLAALPDPCPTGQQVLVRLTSIGMNHADLMARRGEYRLSSGEPPFTPGLEGGGYIEAVGPAVHDRHVGQRVLLSLDAPVHPEGRVGTYGTHYLTSAAQTVIAPDALPDQLLGALWLAYLTAWSCLIWRQGLRAGQVVLLPAASSSVAIAAAQIVRHHGGVAIGTTTSALKCEKLQAMGESAYAQIVCTGERQWRKQVKKLTDNRGVDVVFDPVGAGPLLQSAIHLLAEGGTIWIYGLLGKPDVLDVTPLIRKRAALRGWLLDELSALGSEPVQRAYQHVLDRFADGTYALPIAGIFPLRDVREAHARMERGAHIGKFILVP

SEQ ID NO: 22252 - protein, 486 aa, Gloeobacter violaceus PCC 7421
MKRCKVAVIGGGISGIVTAKCLRDDGHQVTLYESTDQVGGIWVYRKTSGGTFESVRFQNSKYLSAFSDYPMPEQMSDFPHHTEILAYLNSYVDHFRLRECIRLNCQVEKVSRSRDHWKVTVSTPEGAASESFDALAICSGVFREPRWPNIPGEADFKGTLLHAKDYKEPSMFANKRVVVMGNGASGVDIAVRATDFAQKVIWSFRRNSWLVPRYFAGRPLDCNLSRLYALIPAGVRKSLYSRKFAPIWEAHRQCNLEPAFGLFASIPSANEFVIDLVAKGAIETRPTIAGFSGQRVLFTDGSSTEADIVIYATGYGVSFPFFDASVVPVHNEGTDLYKHVFHPDLPNCGFIGIIRVIGALLPCAEMQARWFSKVLSEQVHLPDTESMRAEIQRMRAQQQKDWVASGYRSFQVRQVEYTEEIARLIDAVPKVWRHWQIAWQLLTGPMLPTHYRLDGPNPWKGAEEWIRQVPDLIKIPRNASGVGVGR

SEQ ID NO: 22253 - protein, 501 aa, Gloeobacter violaceus PCC 7421
MQSSDPAIRFRAMSAVQPQLEALIDQLDTIRSHAESLKQQFAEHLQHVHPNFADSAHNLIDYLALRQFDLREIQEQLSGLGLSSLGRTEAHTMASLNAVVQVLERLAGSGGEVVSFADDYARGRDLLTAHTEVLLGPRPATRATRIMVTLPSEAEGDYRLLCALIRAGMNCARINCVHDSETVWERMVGNIRRAEREVGRACRILMDLGGPKLRTGPLAEPLTLRKGEGLVLCRDAEEGRSACEDSPARVVCAVSGIYGGVQVGEAVLFDDGKIESVVRGVAQDEIQLEITRADDKGSRLAADKGINFPESRLKLRGLSEQDLEHLDFVARRADIVGMSFANEPEDVFALQAALGERGAGHLGILLKIETRRGFEQLPRLILAAMRSYPAGVMIARGDLAVECGWERTAEVQEEILWLCEAGHMPVVWATQVLEKLAKKGLPSRAEITDAAMSQRAECVMLNKGPHIVEAVHSLADILCRMQEHQHKKTATLRSLKVSNLV

SEQ ID NO: 22254 - protein, 344 aa, Gloeobacter violaceus PCC 7421
MSILIDNVSKNFGDFQAVADIRLEIQPGNLVALLGPSGCGKSTLLRLIAGLELPDSGQIWLEGQDATRQRLQERNIGFVFQHYALFKHLTVAQNIAFGLEVRKTPKAQIKARVEELLELVQLAGYGGRYPAQLSGGQRQRVALARALAVEPRVLLLDEPFGALDARVRKDLRAWLRRLHDEVHVTTIFVTHDPEEALEVSDTIVVMNKGRVEQVGSPVEIYDHPESAFVMSFLGQVNTLPNSPELFPQLSEAVREVLVRPHDLSLSVQAGGPALAARVERLMYLGWQVQAELVLEAGQPLIVQLSREQADRLQLRPDQPVYVQVRNPKIFPAVAADKQLAEAAA

SEQ ID NO: 22255 - protein, 425 aa, Gloeobacter violaceus PCC 7421
MLITSIEAHEILDSRGNPTVEAQVALENGTTGSAIVPSGASTGEKEAVELRDSDPKRYGGKGVLSAVANVNDSIAPEIIGMEVTDQRSIDRKMIEIDGTANKATLGANAILAVSMAVARTAALSLGLPLYRYLGGTNASLLPVPCMNVINGGKHADNTVDFQEFMIAPHNAPNFAEALRMGAETFHALKSILRGKGYSTGVGDEGGFAPDLKSNEEAVEVILLAIEKAGYRPGEDISICLDPATSEMWKDGKYLFFKSDQSTKTSEEMVDLWASWAGQYPIVSLEDGMGENDWEGWKMLTDRIGATVELVGDDLFCTNAKILAEGIEKGVANSILIKLNQIGSVSETLDTIELAVKHNYKCFVSHRSGETEDTTIADLTVATAAGQIKTGSGCRSERVAKFNQLLRIERQLGEAARFAGKSAFAR

SEQ ID NO: 22256 - protein, 135 aa, Gloeobacter violaceus PCC 7421
MRNAMETSQMLSPDIDIVASTVLRPWGSFTVLGEGNGYKVKRIEVKPGHRLSLQMHHHRSEHWVVVSGTARVVCNDRIELIHANQSTYVPPCATHRLENPGIIPLVIIEVQNGQYLGEDDIIRFEDDYKRIEPRS

SEQ ID NO: 22257 - protein, 474 aa, Gloeobacter violaceus PCC 7421
MSYTKTQAKAGYQAGVKDYRLTYYTPDYTPKDTDVLAAFRVTPQPGVPIEEAGAAVAAESSTGTWTTVWTDGLTELDRYKGRCYDIEPVPGEDNQWICYIAYPLDLFEEGSVTNVLTSLVGNVFGFKALRALRLEDIRFPIALVKTYQGPPHGIVVERDKINKYGRPLLGCTIKPKLGLSAKNYGRAVYECLRGGLDFTKDDENINSQPFMRWRDRFLFVQDAIVKSQAETGEIKGHYLNCTAGTCEEMMERAEFAKELKTPIIMHDYLTGGFTANTTLAKWCRRNGILLHIHRAMHAVIDRQKNHGIHFRVLAKCLRLSGGDHIHTGTVVGKLEGERASTMGFVDLLREEHVERDLSRGIYFTQDWASMPGVMAVASGGIHVWHMPALLDIFGDDAVLQFGGGTLGHPWGNAPGATANRVALEACVKARNEGRDLMREAGDIIREAARWSPELAAACELWKEIKFEYEAVDKL

SEQ ID NO: 22258 - protein, 483 aa, Gloeobacter violaceus PCC 7421
MRRAAGDRPVAGPMRELLQGPGVENPPASSGPYLQRQAQRESNARSYPRRIPFAFKKAEGVYLTSVEGKQYIDCLAGAGALPLGHNHPVAIQAIQTVIRGKFPLLTLDLPTPLKDRFVDELFACLPAEFARNARIQFCSPAGTDAVEAALKLVKTATARRGILSFQGAYHGMSHGSLSLTGNLAAKVVPNLMPEVQFLPYPYELRCPFGLGGEVGYRTGLHYIENLLKDPEGGVPSPAGIILEVVQGEGGVIPAPDEWLRGLRRITQEQQIPLIVDEIQTGFGRTGKLFAFEHSGIVPDVLLLSKAIGGGLPLAVVVYRESLDRWQPGAHAGTFRGNQLAMATGLATLRHILEHRLWEHAQVMGERLLTHLHQIRSSWIGEVRGRGLMLGVEIVDPTGEPDYRGIAPHAGAMARRIQAECLERGVIVEVGGRDGSVVRFLPPLIVTDSQIDTIAEVFHDAVHAATRITSTAPDSRIALPTAAL

SEQ ID NO: 22259 - protein, 508 aa, Gloeobacter violaceus PCC 7421
MSGLCACTLVGAAQVQQLEAALFAAGMPVEALMEKAGLRLAAAIAADYPAGGYPRVGVLVGPGHNGGDALVVARELWLVGRSVQVFCPRPPIKPLARAHLDYFQSLGGRVHTGAVPEEPGVDLWVDGLFGFGLERPVAEPYAGLMAQVNASGVPVAAVDLPSGLSSETGEALGGLAVRAARTYCLGLWKRGLWQDAALDWLGVPVRLEIGFSEAQVRSVLGEDHRSARLLLPDAARAGLPLARPATAHKYSVGTLLAVAGSRQYGGAATLVALGARSGGPGMLYLALPESLADRVAARLPEAIVHPCPQAENGALADLPGVDLEKFDAVVCGPGLGKAEQALVLRLAREAAGALVLDADGLNLIAGQLEVLAQRAAPTVLTPHPGEFKRLFPDIALADRQGAARTAALRSHAWIVLKGARTVVASPSGQVWVNPGGSPALARGGSGDVLAGLLGALLAQCENPEPAVLGAVWWHAAAGEWLAARHTVLGVDAETLALGLLPFLAADGP

SEQ ID NO: 22260 - protein, 407 aa, Gloeobacter violaceus PCC 7421
MAKKTVEALGAADLKGKRALVRVDFNVPLDESGQITDDTRIRAALPTIGMLTGGGARVILVSHLGRPKGFDDQLRLTPVAKRLGELLGQTVYKADDVIGPEVEEAVKKLEDGDVLLLENVRFYPEEEKNNPEFAQKLAGLAELYVNDAFGTAHRAHASTEGVARYLRPAVAGLLLQKELEYLGKALESPERPVLAIMGGAKVSDKIQLIQNMLTKVDSILIGGAMAYTFLKAQGVDVGASRCETSTTKKDGTTVDLLQLALDLLAEAKERGVTFLLPVDHRTNDKFGDLADPPVTPDANIPEGQMALDIGPKTEELYVAEVQKSGTVIWNGPMGVFELPGFSKGTFAVAHALAESDNLSIVGGGDSASAAEKAGVVDKLSHVSTGGGASLEFLEGKTLPGVAALDEA

SEQ ID NO: 22261 - protein, 456 aa, Gloeobacter violaceus PCC 7421
MASTSGGVLRRSLGLIDGAALIVGITIGSGIFASPGRVVEQVGSVGMALAVWVVGGLLSLAGALCYAELGAALPVAGGEYAYLSRTLGRPLGFMFTWTQFFVMKTGSQAIISIVFASYLGSVLFGLDPRGAGVDGDWRIKAIAVATILLLTAVNCLGVRQGAVVQVVFTALKLLALAGIIAMGFAAFFQGGSSHFVDPFAGSIAAPSAFGLAMITCLWAYDGWNNLNYVSEELREPERNLPRAIVFGTLGVMAVYVLANVAYLSALTPAQMAGSRAVATNLAVQVIGPIGGVLVPIAVAISTFGSTNGSLITGARVFYAAARDGQFPRFFGYVSPRAVPAAALVAQGAWASMLVLPGDFGTLVDYFGFAAWLFYALAVVGLMILRAQAPDLPRPYKVRPYPLVPLVFLAASGFLIVNSLLTTPQSWFALGFMGLGLGVYFLFFRVPRVAVPTTSQP

SEQ ID NO: 22262 - protein, 480 aa, Gloeobacter violaceus PCC 7421
MAKTRSQFTCTECGYENVRWLGRCPGCDAWNSFVEETVSPTPAAHRSPTPAAPRPRAAVALDAIDQSQHSRVPSGFGELDRVLGGGVVPGSLVLIGGDPGIGKSTLLLQTACRLSQAQTVLYVAAEESAQQVKLRAERLGVAAPGLFLLAETELEAVLSELESLKPGIAVVDSIQAVYLGALTAAAGSVSQVRECTASLMRLAKRTRITLFIVGHVTKEGSLAGPKVLEHLVDTVLYFEGDRFQSHRLLRSVKNRFGATHEIGVFEMGERGLAEVENPSELFLTSRDEPAPGTATIVACEGTRPLVVELQALVSPTSYGSPRRTATGIEYNRFLQILAVLEKRVGIPLSKLDAYVASVGGLDVSEPAADLGVAVAVAASFRDRIVDPHTVLLGEVGLGGQVRPVSQLELRLKEAFKLGYRRAIVPRGSAIAAPGMEIVPVSRVVEALVAALGGPQNPAPPVRHPAEETDALRPESEFRKS

SEQ ID NO: 22263 - protein, 436 aa, Gloeobacter violaceus PCC 7421
MTVPLSELAREKGIRYFLISFTDLFGTQRAKLVPTQAIDAIAASGAGFAGFAAWMDMSPADPDMFAHPDAGSVFQLPWQPEVAWMPADLFTPEGTAIAQTPRLVLKRVLKLALELGYRVRTGVECEYFLLAADEVQIADSRDFQSKPCYDQQALMRRYAVISEICDAMNALGWGAYQNDHEDANGQFEMNWTYADALVTADRHAFFKYMVKTVAEKHSLRATFMPKPFMHLTGNGCHTHLSVWDSEGKVNRFDDPRGELGLSPLAYHFIGGVQHSAEALCAFANPTVNSYKRINAPITASGATWSPNTISYSGNNRTHAIRIPEPGRFELRLADGAANPYLLPAALTAVGLDGIAHQRDAGPRRDNNSYTNPLPPESAKPLPANLLDALRALESDTVLSEAMGADFVASYLKLKHREWQDYCARVTPWELEHTLDC

SEQ ID NO: 22264 - protein, 276 aa, Gloeobacter violaceus PCC 7421
MSSLASPGRIARVFAALHARREVAFIPFITAGDPDLETTAEALLTLDRNGADLLELGLPYSDPLADGPTIQAAATRALARGTTPGAVLDLVARLTPELRAPLIVFTYFNLILAVGIEAFVERLAASGASGLLVPDLPVEEGDALQTAANVQGLDVIWLVAPTSPPERLRRIAERTTGFVYLVSTTGVTGARTQVASSVRTSLAQLRALTTRPVAVGFGISTPEQAHEVASLGADGVIVGSACVQLLATAAPEERLGQLAEFCRQLKKASQTLPVKS

SEQ ID NO: 22265 - protein, 345 aa, Gloeobacter violaceus PCC 7421
MQYTRLGNTGLIVSRLAFGAMTFGSGEGAFASVYKVDQAGADRLVAQALDAGINFFNTADAYAGGQSEIMLGKALGNRRQDVAIATKVGMRTGEALVHSGLSRRHIIASAEGSLRRLGTDYIDVYLVHRIDPYTPLEETLEALDSLVRQGKVRYVGYSNWPAWLAAKAVGLQREHGWERFRANEMYYSLVGRDLEHEVVPFALDAGVGITVWSPLAGGFLSGKYTREDPEGGGGRLTGFDFLPFDRERGYAVVDKLREIAAVHGATPAQVALAWLLSRPYVASILVGASRASQLADNLGAADLALTTEEIYGLDASTEPVATYPNWFNAKVYDGAVQDALGSGHT

SEQ ID NO: 22266 - protein, 181 aa, Gloeobacter violaceus PCC 7421
MSNKQSRVPFGAALLGILTLLLLFETGAFAQTQVKDPLKLCKDVPAYQELKTQRLEAAQKAQADGKPVTFNEAGTKQKFERYDTAYCGQDGYPHLITSGQLDRAGDFLIPSVLFLWIAGALGWAGRLYLAESKGPEDEIIIDLPKAIKCLLLGLIWPVQAIPELISGKIRVPEDRVTISPR

SEQ ID NO: 22267 - protein, 177 aa, Gloeobacter violaceus PCC 7421
MVKVLYSEEQIAKQVQLLAGQISVHYAPLVSISYPLVVLPVLKGAFVFSSDLLRRLTVPLRVEFLRASSYRGGTVSGGLELDIPETAFLSGHHLLLLEDIIDTGKTASQILAALKSCGPASLQVCALLDKPARRVAPVEVGFRGFTAPDRFVIGYGMDLAERYRELPYVGELEECTF

SEQ ID NO: 22268 - protein, 139 aa, Gloeobacter violaceus PCC 7421
MTPVSGKELLKLIKQNPGKSAKQLAEMAGYTTVTKTGQKRVKMLAFQSAVLEANNIAIKPEQEEVETVRGGRKASYRIQVQQNGNLLIGSAYTRQMGLIPGTEFEIQVGRKHIKLVQVGMAGSGEDSGEAAESKELMAV

SEQ ID NO: 22269 - protein, 329 aa, Gloeobacter violaceus PCC 7421
MRAVAIKSFGGPENLAACQMPDPQPEVGEVTIDVEYAGVNYLELMFRRGFVAVPLPFVPGIEVAGHIRAVGEGVTDLQVGQPVAALTIVGQGGYAEVVRSPAALTFALDTLERPVDLAAAAAFPCTMITAYLVLSAAARFTPGDAVLVHAAAGGLGSALGQVARRLGAGQVLGTVGSPDKIAYAQAHGYDRVFLREHYREAVIAATGGAGVQIVVDPVGGNLRSESLEVLSVLGQLIVLGNAGNGEDTFQSTNGLWLSSKGVQGFNLLAVCLQAPEKIKDAARRVLEWIARDELHVPISGVLPLEAADEAHRRIEQRATTGKLILKIGR

SEQ ID NO: 22270 - protein, 330 aa, Gloeobacter violaceus PCC 7421
MKAAVVPNLHGRWEIRDLPIPEPGINQVLIRIKASGLCYTDIHITEGAWPADSFPRTLGHEPVGEIVALGAGVRTRRLGDRVGVPWLQLACGRCEWCRRGKALFCKDQQGTGVQTQGGHAEYMLAQAEATVLLPDALAYEQAASLFCAGYTVWAGLRFADPKPHERVAVLGIGGLGHLAVQYGKAAGFETFAITHSPSKEKLVRSLGADGVFPSGAALREAGGADVILACSNSYRATGEALQGLRPDGRLVLMGLPSDNQTLAVSGDLLVNRWRIIGSQQNGPEHLFEALDYAAKGKVKVVAETYSLDEINLAFDRVFSGDVRFRAVIIP

SEQ ID NO: 22271 - protein, 327 aa, Gloeobacter violaceus PCC 7421
MQMRRLGKDGPQVSAMGLGCMGISDAYGTRDEQEALATLHRAIDLGINFLDTADVYGQGHNEQFVGRAIRTRRDRVCLATKFGLLRDAQGRLTGVCGTPAYVRSACEASLRRLGIDTIDLYYQHRLDRTTPIEQTVEALAALVREGKIRHIGLSEVDAETLHRAAAIHPIAAVQSEYSLWTRDPEDEILPACRELGVGFVPFSPLGRGFLSGRVNSMSDLPPEDFRQRLPRFQGDNFERNRAWVSQLEALAAQKGCTPSQLALAWVLAQGEDIVPIPGTKRRAYLQENLGALEIRWEAEELAALEQVAPRGVAAGARYPEALLQITR

SEQ ID NO: 22272 - protein, 333 aa, Gloeobacter violaceus PCC 7421
MRVVQFRVFGGSEVLEVADAVLPQPHRGEIAVDVRYAGVNFADIMLRRGALAGTPLPTVPGLEVAGTVAEIGPGVSGFAYGEPVAAFSWTPGKAMGGYAQRVVLDSRLAVPLRRAERELRYEEGAGFACAAVTAYQLLADVARLRPGETVLVQSAAGGVGSLAVQFARALGAARIFGVVGSASKTEAALAAGCDRVVLREGWIEAVRSFTGGRGVDIALESVGGDSLAACLQVLAPFGRVAYFGDASGSGPISLPAFDLWFGTKGVLGYNIGGLAAASPESWNGAANRAIELIANGAVRLAPTRIYPLERAAEAQHALETRASTGKMLLQVTS

SEQ ID NO: 22273 - protein, 450 aa, Gloeobacter violaceus PCC 7421
MEKADVIVIGSGQGGVPLAVDQARSGRRVVLFERGALGGSCINYGCTPSKALLAAAHAAGRARLAAPLGIHAEVTVDFARVMERVRGIRASFRQGIEQRLADAGVQIVHAEASFAGSSTVVGGGVEVQAPLVVINTGTGPTIPELPGLAGLPLLTNLNIFDLETLPRCTLILGGGYIGLELGQGLARLGSEVHIVHNHERLLNHEEPEVGEVLAEALRRDGIHLHLQSEVSQAVYQDGICALTLEDGQILRGEAALLAAAGRTPNTAALGAPAAGIALDKQGYVAIDEHFRTTAAGVYAIGDVARQPAFTHVSWEDYRRLQAILGGEERTRSDRVLGYAVYTEPQVGRVGLTLDQALAKGHRARSVTLPMAHIARAIEWGHDLGFYRLVVDEDTDKILGATLVGYEAAEIVHVLLAHMQADSTWKVLEQSVHIHPTYCEALPSLARLLKQ

SEQ ID NO: 22274 - protein, 144 aa, Gloeobacter violaceus PCC 7421
MAAQQPAPGRSGFEPELGGLLRDGVERSGHEPELGGALRQKGVYVDEVTCIGCGHCAYVARNTFYLEAEYGRSRVVDQNGDATELIQEAIDCCPVDCIHWVDYTELPALEEQRRYQEIPDIGLPPTARKVRSRRPSVRRPRPKD

SEQ ID NO: 22275 - protein, 302 aa, Gloeobacter violaceus PCC 7421
MCACGVCHSDLHMIDNDWGRSRYPLVPGHEVVGEVVEIGSEVRHLKPGDRVGVGWQRSACLQCLDCLRGNENLCAHSQATIVTGYGGFGDYLAIDARFAFKIPAGIPTHVAGPLLCGGITVYSGLRAAGMSSGQEIGVIGVGGLGHLAVQFAGRLGNRVTVFTTSEDKARQAAALGAHRAVIVPPGDSPPPPVERLDIIISTIPYALDAVGYLAHLATDGTLVFVGVPPEPLALPVRELIRGRRRLMGSGIGSRSRIVEMLSVAERFGVMPLVETFAMAEANAALERVRRNRVRYRAVLLAE

SEQ ID NO: 22276 - protein, 459 aa, Gloeobacter violaceus PCC 7421
MAFDYDLLIIGCGVGGHGAALHAVAHKLKVAVVEARDLGGTCINRGCIPSKALLAAAGRLRVLRESEHLGISVGEISFDRAKIAHHAASVVDKIRADLTKSLQKLGVTILHGHARLKGSQTVEIDPGEGGGEVQVLTARDVLIASGSQPFVPPGIVTDGKTVYTSDEGVRLEHLPEHICIIGSGYIGLEFSDVYTALGTKVTMIEALDRLMPGFDPDIARLAARLLVKSRDIDTKVGVFAKKVTPGQPATVELSTGEQLQFDAVLVACGRTPDTKNLGLESVGLETARGFIPVDGRMATSAEHLWAIGDATGKMMLAHAASAQGIVAVDNMLGHERTIDYRSIPAACFTHPEIGFVGLTEPQAKEQGYKVGVVRTYFGGNSKAIAQGDTEGMAKIVYDQTTGELLGCHIIGPEASLLVAEAAQAIAGRDRIERLAHLVHTHPTLSEILDEGYKRAAAVL

SEQ ID NO: 22277 - protein, 313 aa, Gloeobacter violaceus PCC 7421
MEYRDYYEILGVPKSADEQQIKSTYRKLARQFHPDLNPGDKQAEEKFKTISEAYEVLSDPSKRSRYDQYGRYWQQAGRSGGTPAGGAAPAGAGVGGFEGFDFDFSRFGSFDEFIDSLMGNLRGSGGERAARANVRTTQRPGRSEDVEMSLELTLEEALNGTKKRVRTATGKVVEVNIPAGVHEGTKVRVAGEGSGRGDLFLVVKLKTHPFFAVDGDDLLCEVPLTPAEAALGTKVEVPTLTGRVRVTIPAGTSTGRTLRLAGRGLPRRGGGRGDQLVKIRIEVPTALSSEERDLYEKLSRTESFRPRARFDSQ

SEQ ID NO: 22278 - protein, 433 aa, Gloeobacter violaceus PCC 7421
MSLPHRSARWPICFLSSATSTATDMRAFWGWLVLCLAAGLFAAEIARAAPGPAVPPPKALEEQVRAALKAQPREPRLWNNLGVSLRRQGRNAEAISAYRQAVRLDSKYADAYSNLAVALTAIGRHDEALGAIRTALKLDRDNPVYRLNLATVYEGLGRDGEAAIEYRAYLQRAGESAAVYERLAKIQQKLGRNAQARTSRQKAVDLEPENGAYRLAYGQALAAAGQDFAAIAQLEAAVRLKAMDARSWLLLATLYNGQQQTDAAAAALREAAALDPGSARVQNDLGVTLSKLKLTDQAAEALNRAVTLAPSYAEAWSNLGVVLRGQGKMNEAEQAYQRALGIESRLPQIYNNLGVLYLESERVQEAVPQFQQALVLEPGYWEARRNLAMALGRLGKWGAAADQLKLALEAAQVPSALITQVQADLQKLQEASR

SEQ ID NO: 22279 - protein, 146 aa, Gloeobacter violaceus PCC 7421
MCWARCGLLCTVLLLAGCGEASKIEIALKDLAVVNCPPGTKGGPSISLNDSVNVPTRCYRIRGTAVNPAEKPAKNVDVFGKITDANGTLAITRRRVGSLAEVAAGTSPFALDVYLPETAKPPFKLENMKAAGFPNQVDRRQNAGGS

SEQ ID NO: 22280 - protein, 473 aa, Gloeobacter violaceus PCC 7421
MQPLDRRTKVVATIGPASSSPEVLRQLVKAGINVARLNFSHGSYEDHARMVKLLREVSEELDTPITLLQDLQGPKIRVGQMPEGGLALGEGDELTLLPVAEFAGEPGTVSIDYPYLVEEATPGTQVLLDDGLLEFAVVEVKGNAVRCRVVRGGVLKSRKGVNLPSLDLRLPSMTEKDKQDLEFGLEQGVDWVSLSFVRRGEDIRVLKGLLAEHGAADVPVIAKIEKPQAIANLEEILDEVQGIMVARGDLGVEMSPEKVPLLQKRIIRLCNRRGIPVITATQMLDSMIRNPRPTRAEASDVANAILDGSDAVMLSGESAVGDFPVQSVEMLVRIAKEVEREFTFDNNPPAKSDEIHALCESLGTIDKILALHCIATFTTTGFSASIAAAERPKAPVVAFTPDLKVYHRLNLVWGVKPLLLEHPAAELEKLIEQMESCLVERNLAAPGDRMLVLGGSPVQRAGGTNFLKIHTLH

SEQ ID NO: 22281 - protein, 391 aa, Gloeobacter violaceus PCC 7421
MRLATRLEKLQSNVFSLMDEAKARARRAGLEVVDLSLGSSDLSPPAHALERIRESILDPTSHGYLLFQGTRSFREACAAWYERRYGLALDPETEILPLIGSQEGTAHIPLAVLDPGDVALLTDPGYPSHEGGVHLAGGQIYPLALRPETGYLPQLEQIPEEVLERSRLLVLSYPHNPTAATATLAYFERAVAFCRAHDIVLVHDFPYADFHLSGEQPPSILQADRERAVAIEFFSLSKSFHMGGFRIGFAVGNRDLVAALRQVKASIDFNQYRGILDGAEAALRGPQDYVREAVAVFRARRDRAVAALAQAGWQVPAPEATMYLWAALPECWRGSSAEFCIRLVEQTGVALAPGSGFGSSGEGYVRFALVRSEDMLERAIAQIAGFLQRSC

SEQ ID NO: 22282 - protein, 233 aa, Gloeobacter violaceus PCC 7421
MAKPVVVAPSILSADFARLGEEIHAIDEAGADWIHVDVMDGRFVPNITIGPLIVKAIRPVTQKVLDVHLMIVEPEKYIADFAKAGADIITVHCEHNSTVHLHRALSQIKELGKQAGVSLNPSTPLSLIEYVLDLCDLVLVMSVNPGFGGQSFIPQVLPKIARLKSMCEERGLDPWIEVDGGLKPSNTWQVLEVGANAIVSGSGVFGVGPARYAEAIEGVRASHRPAVEVAAQV

SEQ ID NO: 22283 - protein, 223 aa, Gloeobacter violaceus PCC 7421
MQAAVIESFGGPQVFEYRHLPVPVPKGRELLIRVKATSVNPLDCQIRRGNYKEQVSLPAILGHDVSGVVEAVGDAVRDFAEGDEVFYVPRIFGGPGSYAQYHVVEEAIVAHKPANLSHAQAAALPLAGGTAWDALVVRAALRVGESILIHAGAGGVGSLAVQLARAMGAQKSRVARLSAAAHFSNRQIHEQAYRRSVPGCLGHRNQLAACSASSALATASGSP

SEQ ID NO: 22284 - protein, 216 aa, Gloeobacter violaceus PCC 7421
MMSEVQTQPSAADVFRAAYENRYTWDADFPGFEADFTLVLNDETHTGTAAILKDLSVRVETADAKAQEWLYNQLKDVVVHRKRSSFEAAHSKHTFSFDGEADETGALPVTVGGDAMGSNYKIRDNQVVQVSRTMGRMAFTINHLAKIDTSTGYLSTAYNAVFRNAQSGEVTAQRRFEDTYEEYEGYWVMTRQVVHSREGDTSTVTEITFTNLRPVQ

SEQ ID NO: 22285 - protein, 480 aa, Gloeobacter violaceus PCC 7421
MQIHTPNWVKHAIFYQIFPDRFSRTQQLKQKLLQAVSFEDWAAAPTLYGYKGGDLWGVIERLDYLSDLGINAIYFTPIFQSASNHRYHTHDYYRVDPLLGGNEAFKALLDAAHARDIKVVLDGVFNHASRGFFFFHDILENGQLSPWLDWFKIEGWPLSPYNVEQPANYACWDNNRALPQFNHANPMVREYIMEIAEYWIKAGIDGWRLDVPACVEAEGFWQEFRERVKAINPEAYIVGEIWEDARQWLDGTQFDGVMNYLFAAPTIAFTAGDRVQVQYVQDRSYRPYPALFAVEYKEAIDKLLGLYDWEIQLAQLNLLDSHDTARVLTIAGGDRASVELATLLLLTFPGAPSIYYGDEVGLPGGIDPDSRQGFPPESQWNGELLALHRDLIALRHRHEALRIGKYKSVYASGQCYVFERRLEAEVLLVAVNAGTEPARVTLEAPGETYPRKVLFGPGQVEAAEGHLELSLPARSGLVLG

SEQ ID NO: 22286 - protein, 290 aa, Gloeobacter violaceus PCC 7421
MSKAAVLGMGAMGSRMAAALLKAGHQVTVWNRNSQKTAPLAEMGAKAAQTPRAAVEEVDFAVCMVRDDAASRFVWLDFETGALAGLPADAVAIESSTLSVAGVQELAEHFQARGKTLLDAPVSGSRPQAEAGQLIFLVGGDAGAVAKAGPILNAMGGTVHHAGPLGNGAAVKLAINALLGVQVAAMGELIALLRHCGIDEVRAVEIIGSTSVCSPAARGAASAMAVGNYAPLFPSALMEKDLGYLQNMAAAHRARAPLTQAARSVFGEAMSRGYGEDNMTGVAQLYWQGP

SEQ ID NO: 22287 - protein, 310 aa, Gloeobacter violaceus PCC 7421
MRVLVTCPPMLRRIEHFKDHFEARGAEVYCPPVVQTLSVAELVDLLPGFDGWIIGDDPATRAVFAAGVRGRLKAAVKWGVGVDNVDFAAARALGIPIANTPAMFGAEVADVAVSYVTALARETFSVDREVRAGGWPKPCGVSLAGKTVALVGFGDIGKATARRLVAAEMRVIAYDPRYVPEAGSEAVEPALWPERLGEADFIVFTCALTPENRHMLGVAAFGLTKPGVRVVNVARGPLIDEQALIVALASGRVHSAALDVFEVEPLAADSPLRAHERCIFGSHNASNTADAVERASFKAMALLFGFLGID

SEQ ID NO: 22288 - protein, 354 aa, Gloeobacter violaceus PCC 7421
MHLFAPLTLRDITLRNRIAVSPMCQYSSIDGLANDWHFVHLGSRAVGGAGLVIFEAAAVEARGRISPQDLGIWSDAHIEPLRRINDFIHRQESVAGIQIAHAGRKASTARPWEGGGPLTEGEGGWADSVAPSALPFDAGYPVPEALDEAGIAATVQAFAAAARRSLAAGFRVLEIHAAHGYLLHSFLSPLSNRRTDRWGGLFENRIRLLLAVVEAVRGVWPERLPLFVRISATDWTEGGWDLEQSVLLAQVLARSGVDLIDCSSGGVIPGVRIPAGPGYQTRFAERIRAEADMLTGAVGQITSAEQADHIVRTGQADLVLIGRQLLRDPYWPLKAAVELRAPGPWPEQYQRAKP

SEQ ID NO: 22289 - protein, 498 aa, Gloeobacter violaceus PCC 7421
MSTPIHCLNYIDGQWQPAQSGETLEDLNPADRREVVATFPRSGAADVEAAVTAARKAYRGWRLVSAPARAEIVFRIGEILRGRKEALAQLMSREMGKTIVEARGDVQEAIDCAFYYAGEGRRLFGQTTPSEMDNKFAMSVRSPVGVCSLITPWNFPVAIPCWKALPALVCGNTVILKPAEDTPACATALIDVFREAGLPAGVANLVHGTGEETGRALVAHPGVDLVSFTGSSVVGAEVASVCGRTHKRVCLEMGGKNAQIVMEDADLELALKGALWGAFGTTGQRCTATSRLILHRDIKQVFTEKLIEQARQLRLGPGIDPNTEVGPLINESQLSRVHEYIEIARQEGLKILLGGEPVRSEELVHGHFFEPTILDEVPPASRLAREEVFGPVVVLMTVDSFEQAVELLNDTPYGLSSSVYTRDVNRAFRAIRDIEAGITYINGPTTGAEVHLPFGGVKQTGNGHREAGAAVLDVFSEWKTVYVDFSGQLQRAQIDNRS

SEQ ID NO: 22290 - protein, 439 aa, Gloeobacter violaceus PCC 7421
MLSLPTKEASLPRVPRLVGPLPGPRAQALIARDEAVTSPSYTRGYPLVAARGEGCMLEDVDGNVFLDLTAGIAVTATGHAHPVVVRAIQEQAANLLHMSGTDFYYEPMAELAEALCERAPFPTAAGRPRARVFFSNSGAESNEGALKLARYYTGRQQVVAFLGAFHGRTYGAMSLTGSRAVQRQGFGPLVPGISHIPYGTHASLDYLEDKLFPAVLPPEEIAAIVVESIQGEGGYIVPEDGFHERIRQICTRHGILMVVDEVQAGMGRTGKLFAIEHWGVQPDIVTLAKGIASGLPLGAILSRPEIMTWPAGSHATTFGGNPVACAAANATLKLLEAGLIENAERMGRVLQAGLGQLADRFSFVSASRGKGLMVAVDLFDAAGNLDRERRDQIVDLAFYRGLLLLGCGKAAIRFCPPLVIDADQVRVALDILRQIFEEQ

SEQ ID NO: 22291 - protein, 160 aa, Gloeobacter violaceus PCC 7421
MATVSDITVQTVDGQARSLGRYKGQVLLIVNVASYCGYTPQYAGLEKLYRRYKDAGLRVLAFPCNDFGGQEPGSNAEIAEFCSRYDVSFELFDKVGARGYYKHPLYVRLSEAAEPAGEVSWNFEKFLIAKSGEIVGRYRSGIGPEDPQLVADIERELAKS

SEQ ID NO: 22292 - protein, 392 aa, Gloeobacter violaceus PCC 7421
MKTAARLDRIPPYLFAEIDRRRDEAVARGVDIINMGIGDPDKPTPPVVLEAMHAAIDDPSTHNYPPYKGTKAYREAAAAWFERRFGVGGFHPDTEVISSIGSKEAIHNTFLAFVDPGDYTLIPDPAYPVYRTSTIFAGGEFFAMPLLPENQLLPDLEAVPETVARKAKLLWLNYPNNPTGAVASLEFFEKVVHFAKKHDILVCHDNAYSEMAYDGYKPPSILQVPGARDVAIEFLSCSKAYNMTGWRVGFVIGNRTGIAGLGQVKTNIDSGVFKAIQQAAIAAFGLDDERLHALMAVYQNRRNIIVEGLRSLGWPLEAPKATLYVWAPIPKSFGSSVEFVGALLDKCGIIVPPGNGYGEHGEGFFRIALTVPDERMREAIGRMEAAGIRFEG

SEQ ID NO: 22293 - protein, 339 aa, Gloeobacter violaceus PCC 7421
MTKMRAMIVPEAGAKFQMIERDLPVPGPREVRLSVSACGVCHSDSVTVEGTMRGIAYPRVPGHEVIGTIEALGPEVLGWEVSMRVGVGWFGGSCGYCAHCRRGSAFACETVSAVTGVTRDGGYATHMLADVSALAHVPTDLDVVESAPLLCAGITTFNALRNCGAGPGELVAIHGIGGLGHLGIQFAARQGFRTVAVNRGRDKEELARSLGAHEYIDSEEGDPAAALLAMGGAKAILATVTSEKAMQALVGGLGPNGTMMLIGAVPTLTVNPTELLLKRAAVKGWYSGTAADSEDTLLFSHRNGITSMNEIYPFENAQAAYDRMMSGKARFRVVLSMGV

SEQ ID NO: 22294 - protein, 262 aa, Gloeobacter violaceus PCC 7421
MSQSPPARKPIIEFRGVSKSFGTQRILDGLDLKVHYGEALVIVGPSGTGKSTILRLMCGLLEPDSGEVLLGGLPLQAEQLQRKPIQVGMVFQQAALFDSLTVEENVGFLLYEHSKLPRTKIGELVREKLEMVGLDPVLARQMPAELSGGQRKRVSFARAIMEDPTVPDDETQLLLYDEPTAGLDPIASTVIENLIRSLKQRGSCDSYVVITHQETTIRSTADRILLIYQGKVRWEGQAPEIDACQDPYVRQFFDGKIDGPIQ

SEQ ID NO: 22295 - protein, 450 aa, Gloeobacter violaceus PCC 7421
MQKHYDLVVLGTGVAGSSVAKRCREAGWKVAVVDSRPFGGTCALRGCTPKKVLVQAGELLDRWRHLAGKGLRAEEARIDWPELMRFKRSLIEPLPAAREAEYAEAGIESYHGVARFVGATALEVEGAHLQGEKVLIATGSRPATLGIEGEEHLASSDDFLELGTLPRRIVFVGGGYISMEFAHLAARAGSQVHVLHQDERPLAPFDPDLVDRLIEATRELGALCLCHKVKAIEKTAQGLLVHTDGDGGPYAADLVVHGASRVPNVEALDLDGAGVEAGKKGIKVNAHLQSVSNPAVYAAGDVADAPGPQLTPVAGLHAETVAENLLKGNTRSLEQAVFASTVFTVPALAGVGLLEEQAQAQGLHYRVLQADHRDRLAVRSLAAPYAAHKILVEEPGGRILGAHLLGPFATEIINVFALAIQAQVDIDQLRATHFAYPTGSSEIFAMLSKG

SEQ ID NO: 22296 - protein, 369 aa, Gloeobacter violaceus PCC 7421
MQVKAAVAMEAGKPLQIESVELEGPKAGEVLVEIKATGICHTDAFTLSGADPEGLFPAILGHEGAGVVVEVGPGVTSVKLGDHVIPLYTPECRQCEYCLSRKTNLCQAIRTTQGRGVMPDGTSRFSLGGEPLYHYMGTSTFSNFTVLPEIAVAKIREDAPFDKVCYIGCGVTTGVGAVLYTAQVEPGANVVVFGLGGIGLNVIQGCRMVGADKIIGVDTNPAKKELAEKFGMTHFVNPKEVEGDLVPYLVELTKGGADYSFECIGNVNVMRQALECCHKGWGVSVIIGVAGAGQEIRTRPFQLVTGRIWKGSAFGGARGRTDVPKIVDWYMEGKINIDDLITHVLPLGEINQAFDLMHEGKSIRTVVTF

SEQ ID NO: 22297 - protein, 226 aa, Photorhabdus luminescens subsp. laumondii TTO1
MKDFLIAPSILSANFARLGEDTDKVLAAGADVVHFDVMDNHYVPNLTIGPMVCQALRDYGITAPIDVHLMVKPVDRIIPDFAKAGATYITFHPETSEHIDRSLQLIKEHGCKAGLVFNPATPLSHLDYVLDKLDIILLMSVNPGFGGQSFIPGTLEKLRQVRKIIDESGYDIRLEVDGGIKASNIAAAATAGADMFVAGSAIFSQPDYKTVIDNMRSELSKVSHGK

SEQ ID NO: 22298 - protein, 1090 aa, Photorhabdus luminescens subsp. laumondii TTO1
MVAPFWKRAYLALLSSTFVLLLASCDNNRSLPKTPEKPMAHIPNKVPSEAATAGNFQAVIHLVDIAKLSQSPTTNRDYSTNTLYLWNDKNCDALASLSSSWNDTSATPTGSDSYGPYWVIPLTKNEGCINFIVRDGNNNKLIDSDLKISFSDFSNRTVSVIPGNYQIYGSRAAAFNSVFGVSQASAHWVDNQTLLWSGGADKPYVRLYYNRNGKVEANDEGNFIDSYLTLTPTTLSQKTAERFPHLKKLTAFHLPEDTDVDTLLTGELVALATNEAGLLLSATQVQTAGVLDDRFANVADTLEYGALINDTGVTFRLWAPTAQHVGLVIYDANKQIIANHAMKRDPASGSWSWQGDKELVGAYYRYALTVYHPYSRHVEHYEVTDPYSHSLSTNSEYSQVINLDDEALKPQNWDSLIMPRSQNTPADIARMTIYEAHIRDLSVADGTVTETWRGKYLALTADNSDMFKHLKTLSQAGVTHMELLPVFDVASINEFSNEVADLNHPFSRLCQVNPRVKNSRFANYCSGSQTVGEVLQALQRGDNANNPQVQELNAMIAETDSYNWGYDPFHYSVPEGSYATDAEGSVRINEFRAMIQAIKQQLGMNVIMDVAYNHTNAAGPAHRSSVLDKVVPWYYHRLDEITGNVESNTCCHDTAPEHRMFAKLIEDSLVTWVKDYKIDAFRFDLMGYHPKAQMLSALAKVRAINPSVYFFGEGWNSGQDDRFEIASQINLKGTGIGTFSDRLRDAVQGGGPFDSADTIRINQGVGNGAGTLLNEMAWLDANETRHLADLVRLGMAGNLADFVLINKDGAVKTGREINYKGAIAGYAADPIEVINYVSKHDNQTLWDIISYKAAREANLATRVRMQAISLATTFLGQGLAFAQHGSELLRSKSFTRDSYNSGDWFNRVSYTYQDNNYDVGMPDQRVDGENYALIEKVKNVVDKPGRTELLQMTAFYQELLRLRQYSPLMTLGDGTSVKQRVDFRNVGPHQQLGLLVMTIDDGNTTGDDRDSRFDGLVVMINAAPYPATVRDLNVKGLKLNDIQRELGHTSLAAGTRIAKDGTVTLPAWSVAVLVLPQDGKRGIGLPVRRK

SEQ ID NO: 22299 - protein, 489 aa, Photorhabdus luminescens subsp. laumondii TTO1
MRIQNKMLINGDWIDASDGQTIEVMNPHDGSLITRVAEAKEADVDCAVAAAKAAYPAWGRLQASERGALLLKLADKIEEHAAELAQLETMDTGHPIRDTLNIDVPRTAYCFRYFGGMADKLEGSVIPVEEGFLNYTTREPIGVVGQIVPWNFPLMFTSWKMAPALAAGNTIVIKPSEITPLSTLRIAELMMEVGFPPGVINVVVGYGNSAGARLSEHEDVGKIAFTGSTMTGQSIVAASAGNLKKVQLELGGKGANIIFEDADLTKAVGGSAWAIFHNQGQACIAGSRIILHESIADAFLEKFLTLAGSIRLGDPLLPETEMGPVTSLQHRERVLAYCDVARSQGCEILLGGKPPADPALANGCYIEPTVVRAKYSDRIAQEEVFGPFVTVITFKNDEEALAIANSTEYGLGSGLWTKDISRAHRFARDMHAGMVWINCYKRVNPASPFGGVGRSGYGREMGFEVMREYTQVKSVWVNVDAKIPPFYQR

SEQ ID NO: 22300 - protein, 469 aa, Photorhabdus luminescens subsp. laumondii TTO1
MSVEHVLTMIEEHQVKFIDLRFTDTKGKEQHMTIPAHQVNADFFEDGKMFDGSSISGWKGINESDMVLMPDPSTAMLDPFFDDATLTLRCDILEPGTMQGYDRDPRSISKRAENFLRSSGIADTVLCGPEPEFFLFDDVRFSSAMSHSYYHIDDIEAAWNSGTQYEGGNKGHRPAVKGGYAPLPPVDSSQDLRSAMCLTMEEMGLVVEAHHHEVGTAGQNEIATRFNTMTKKADETQIYKYVVHNVAHNFGKTATFMPKPLVGDNGSGMHCHMSLSKNGTNLFAGDKYGGLSELALFYIGGIIKHARALNAFTNPTTNSYKRLVPGYEAPVMLAYSARNRSASIRIPVVASTKARRIEVRFPDPAANPYLAFAAQLMAGLDGIINKIHPGDAMDKNLYDLPPEEAKEIPTVASSLDEALAALDADREFLTRGGVFTDDAIDAYIDLKNSEIERVRLTPHPLEFELYYSV

SEQ ID NO: 22301 - protein, 407 aa, Photorhabdus luminescens subsp. laumondii TTO1
MAKLSSFNIHDPKFIKNPYDFYDILHKQDLVYFEQSQNSYFIGKYEDVDAILKSSIFNTKPLTALAEPVMGDRVLAQMEGEEHACKRKFIMQGLSRDYFNRYYEPMIRKITEDLLQPYMEKGNIDIVNDFGRDYAVLVTLSILGLPSDNYRDIAEWHKGIASFITQFDQTELEKMHSLECSQKLIRLLKPIIDQRRRNPSKDIISIFCQDTAMSMSEITALCLNILLAATEPADKILAMMLNHLISNPSMLDVVLKDRSLVRDAFEETLRLTSPVQLIPREASEDVTISGIDIPKGAVVFCMIGAANRDPSVFHKPNEFDLYRRKNTTSPQKANRKRHLAFGAGTHACAAAAFSLSQLEVSSNIILDLLHNLRFADHYHYQETGVYTRGPSKLLLSFDPIASSAIKE

SEQ ID NO: 22302 - protein, 456 aa, Photorhabdus luminescens subsp. laumondii TTO1
METIRMSKHYDYIAIGGGSGGIASINRAAMYGQKCALIEAKALGGTCVNVGCVPKKVMWHAAQIAESIHQYGPDYGFDATINRFNWKTLIASRTAYIDRIHQSYGRGLGNNKVDVIQGFARFVDAHTVEVNGEKITADHILIATGGRPVWPDIPGAEYGIDSDGFFALEEMPKRVAVVGAGYIAVEIAGVLHALGSETHLFVRQHAPLRSFDPMIVETLLEVINTEGPTLHTESVPKSVSKNADGSLTLQLQNGKEQTVDTLIWAIGREPVTDNLNLSVAGVELNEKGYIRVDEYQNTNVKGIYAVGDNTGAVELTPVAVAAGRRLSERLFNNKPEEHLDYTNIPTVVFSHPPIGTVGLTEPQAKAQFGEEQVKTYQSSFTAMYTAVTQHRQPCRMKLVCVGPEEKIVGIHGIGFGMDEMLQGFAVALKMGATKKDFDNTVAIHPTAAEEFVTMRG

SEQ ID NO: 22303 - protein, 403 aa, Photorhabdus luminescens subsp. laumondii TTO1
MKEHIAVDRNTYDQVMLPIYSPAQFIPVRGQGSRVWDQHGKEYIDFAGGIAVVALGHCHPTLVDVLKQQGEKLWHISNIFTNEPALILAQKLIDATFAERVFFANSGAEANEAAFKLARHYAIARHNPYKTKIIAFHQGFHGRTLFTVSVGGQPKYADGFGPKPADIIHVPFNDLDAVKAVIDDHTCAVVLEPVQGEGGVTAAAPAFIHGVRELCDKHQVLLVFDEVQSGMGRTGKLFSYMHYDVTPDIITTAKALGNGFPISAMLTTVNIASVMTPGAHGTTYGGNPLACAVANVAFDIINTPAVLAGVEKRHNLMVNFLNDINQKYSIFGEIRGKGLLIGAELKAPHQGKAKDILQLAAENGLMLLSAGGDVLRFTPSLIISEEEIAQGMERLEQVINQLV

SEQ ID NO: 22304 - protein, 254 aa, Photorhabdus luminescens subsp. laumondii TTO1
MKSLFKVTLLATTLAMAFSAPQVLAAKADSQSSTELNSAFKTEDQQNAYALGASLGRYMQNTLKEQKSLGIPLDKDQLLSGVQDAFNNKSKLTDSEIENTLRAFEGKVKSAAEAKMEKEASENEAKGVKYREEFAKEKGVVKSKTGLLYKIEKEGSGKKPVASDTVVVNYRGTLIDGKEFDSSYKRNEPLSIRLDSVIPGWTEGLQNVKKGGKIKLVIPPELAYGKADLPGIPANSTLVFDIELLDVKAETKAK

SEQ ID NO: 22305 - protein, 417 aa, Photorhabdus luminescens subsp. laumondii TTO1
MMENGKRFEDMLSRFVGNGPYLEIDGEKYIDAASGTFNLPLGYTNRRITEKLKQQIDRCTHLSSAYTHEMSQYILDKLVKHSPKGIDRIWLRDVSGSGAVECAIRIAQKATGRSGVISFFLAHHGQSLATAQISGNAFRIKDFHVNIDGSFKIPTPTSVMSELEPNTESNQYFDLEQFIQLGSNDNIACLIIEPIQGNGGNNVFPVDFYRKIRDICHKHDIIIIADEVQTGFGRTGTFFASTGYAKELEPDIIVFAKGAGGIGIPTGGVLMRSSLDVLESFEHSSTSGANPLSLTALNEIIDIIEEEQVLENVQRNETYLRDGLLALQHKYPEITGVRGVGYMFGFDTPSPEFAAQAIAIANSHHLIIRGSRYGKGRALKVRPPLICTQEHLNEILYKLDLTFADMTLNMLDTKEVA

SEQ ID NO: 22306 - protein, 455 aa, Photorhabdus luminescens subsp. laumondii TTO1
MTTSRSVLDMIGNTPLLELTHLNTGPCQLFIKLENQNPGGSIKDRVALSMIEQAEEQGLLQSGGTIIEATAGNTGIGLALVAALKGYKLILVVPDKMSREKVFHLRALGTDVRLTRSDVSKGHPEYYQDYALRLAQEIPGAYYIDQFNNPANSAAHTTTTGPEIWQQMDHNVDAVVIGVGSGGTLGGLSHYFAQVSPETEFVLADPTGSILVDYIEHGKYGEAGSWQVEGIGEDFVPPLGNFSRVHHAYRVSDAEAFSSARDLLLKEGVLAGSSSGTLLAAALRYCRAQTTPKRVVTLACDSGNKYLSKMFNDYWMLEQGFQSRVQQHDLSDYITYRYQDGATVFISPEDTLKTAHTRMRLYEISQLPVLKEEQVVGIIDEWDLMHTVQADPRNFSLPVSHAMTHQVRTLDKNDSLQQLMATFDAGHVALIVDNGRFLGLVTRTDVLNAWRQQLN

SEQ ID NO: 22307 - protein, 460 aa, Photorhabdus luminescens subsp. laumondii TTO1
MAKAVKRAFVCNECGADYPRWQGQCSACHAWNTITEVRLAAAPSSRNERLSGYAGDAGVSRVQKLSEISLEELPRFSTGFKEFDRVLGGGVVPGSAILIGGNPGAGKSTLLLQTMCQLSAQMKTLYVTGEESLQQVAMRAHRLGLPADNLNMLSETSIEQICLIAEQEQPKLMVIDSIQVMHMADIQSSPGSVAQVRETAAYLTRFAKTRGVAIVMVGHVTKDGSLAGPKVLEHCIDCSVMLDGEADSRFRTLRSHKNRFGAVNELGVFAMTEQGLREVSNPSAIFLSRGDEVTAGSSVMVVWEGTRPLLVEIQALVDHSMMTNPRRVAVGLEQNRLAILLAVLHRHGGLQMSDQDVFVNVVGGVKVAETSADLALLLSLVSSFRDRPLPRDLVVFGEVGLAGEIRPVPSGQERISEAAKHGFKRAIVPYANMPKKALPGMEVFGVKKLADALSVMDDFD

SEQ ID NO: 22308 - protein, 372 aa, Photorhabdus luminescens subsp. laumondii TTO1
MAKRDYYEVLGVSKTASEKEIKKAYKRLAMKYHPDRNQGDKEAESQFKEVKEAYEILTDDQKRAAYDQYGHAAFEQGGMGGGGADFSDIFGDVFGDIFGGGRRQQRPSRGADLRYSMELTLEEAVRGVTKEIRIPTLETCDICHGSGAKAGTSPVTCSTCQGAGQVHMRQGFFTVQQPCPHCHGRGQIIKDSCHKCHGHGRVERYKTLSVKIPAGVDTGDRVRLSGEGEAGAKGAPAGDLYVQVQVKSHHIFERQESNLYCEVPVNFAMAALGGEIEVPTLDGRVKLKIPAETQTGKMFRMKGKGVKSVRGGVQGDLLCRVVVETPVKLNERQKELLRELGESFGGAGEETNSPRSKSFFDGVKKFFDDLTK

SEQ ID NO: 22309 - protein, 473 aa, Photorhabdus luminescens subsp. laumondii TTO1
MKKQFPNNFLWGGALAANQVEGAHQIDGKGLSTSDMQPHGVIGHSIERNLGDFHIKDIGIDFYHRYPEDIALFAEMGFKCLRTSIAWTRIFPEGDEEIPNENGLAFYDRLFDEMIKYNIQPLITLSHFEMPYGLVKKYGGWGNRKTIAFFDHYARTVFERYQHKVKYWLTFNEINMSLFSCFTGAGLPENSKIQDIYQALHYQLVASANAVKACHEIIPDAKIGNMVAAAPYYPLTCHPDDILESLKKNREWLFFFDVQARGYYPSYMPRLFKEKNITLDITDEDKIALKETVDFLSFSYYMSSCATTNLEIIKTSGNIINPVKNPYLSSSEWGWQIDPKGIRYLLNMLYDRYQKPLFIVENGLGARDVIQNDGSIIDDYRIKYLNDHLFQIREAIEDGVQLLGYTSWGPIDLVSASTAEMSKRYGFIYVDRDDQGNGTLERRRKKSFNWYKAVISSHGNTLQAPEVENENNQ

SEQ ID NO: 22310 - protein, 176 aa, Photorhabdus luminescens subsp. laumondii TTO1
MIDDDGYRPNVGIVICNRQGQVLWARRYGQHSWQFPQGGINPGESPEQAMYRELYEEVGLGRKDVRILASTRNWLRYKLPKRLVRWDTRPVCIGQKQRWFLLQLLCNEEDINVQHSNTPEFDGWRWVSYWYPVRQVVSFKRDVYRRVMKEFASVVMPMQESVSLPRSSYSYRRKRS

SEQ ID NO: 22311 - protein, 461 aa, Photorhabdus luminescens subsp. laumondii TTO1
MQNNETQLKRGLTGRHIRFMALGSAIGTGLFYGSAAAIQQAGPAVLLAYLIGGAAVFMVMRALGEMAVHHPVAGSFSHYASHYLGPLAGFLTGWNYIFEMLIVCLADVTAFGFYMKLWFPHVEQWIWVLSIVCFIGAINLCHVKIFGEMEFWLSIVKVTAIIAMIIGGMIIMIYGFGQETDHATGIASLWEYGGFMPNGISGVIASLAIVMFAFGGIEVIGITASETKNPEKTIPKAINAVPFRILLFYVLTLFILMCIYPWNQIGQEGSPFVQIFSSLGINSAANILNIVVITAAISAINSDIFGAGRMMYGMAQEGQAPKSFTKLSRNGVPWMTVIVMSAVLLIGVILNYMIPEEIFVIIASIATFATVWVWLMILLSQVAMRRKMSKEEVKTLKFPVPMWPIAPALTIIFMVFVIVLLGYFEKTRIALIVGITWVILLSITYFFSKKKNISQIHQINK

SEQ ID NO: 22312 - protein, 351 aa, Photorhabdus luminescens subsp. laumondii TTO1
MTQQNFVELKNVTKRFGNNTVIDNLELSIPQGHMVTLLGPSGCGKTTVLRLVAGLEKPSAGKIFIDGEDVTDRSIQQRDICMVFQSYALFPHMSLGENIGYGLKMLGQPKAEIRERVKEALELVDLGGFEDRYVDQISGGQQQRVALARALILKPKVLLFDEPLSNLDANLRRSMREKIRELQQQFNITSLYVTHDQSEAFAVSDAVLVMNKGKIMQIGTPQTLYRQPASEFMASFMGDANIFPATLATDYVEIFQYRLPRPANFTTNRQSVTVGVRPEAITLSRNGNISQRCTISHVAYMGPQYEVTVDWQGQTLLLQINATQLQPDVGDNYYLEIHPFGMFILTEKNSG

SEQ ID NO: 22313 - protein, 441 aa, Photorhabdus luminescens subsp. laumondii TTO1
MQATSQEQISQHYRRWRSRLLISMIIGYAAFYLTRKSFNFVMPVMQLELGLDKGHIGWITTLFYLAYGSSKFISGVFHDRTGYRWFMGAGLVMTGVLNIIFAFCSSFSALLIIWTLNGFFQGWGWPPCARLLTHWYSRNERGFWWGYWNISINIVGITVPMLSAFLATTYSWQTALMMPGIIGILLGIWLCYQLCGTPQQHGLPSVGQWRQDSLELRHEQLSHPMPMMQILRDTILTNRTIWLLGCSYILVYLIRMAINDWGNLWLSETHGANLLSANATLSLFELGGLTGALFSGWGSDLLFRGQRAPMILLFALGLFMAVTALWLTPIHHYTLLAVCFFSIGFFVFGPQMLIGLAATEYCHKQAAGTVTGYLGLYAYLGAAIAGWPLSQVVAHYGWSGMFALLTAAAAMMGLLLMPMLMADVSKREHGVASRLSNNKQF

SEQ ID NO: 22314 - protein, 289 aa, Photorhabdus luminescens subsp. laumondii TTO1
MSQKEIWSETLHANFGQYFSVDKVLYHDKTEHQDLIIFENATLGRIMALDGTVQTTERDEFIYHEMMAHVPLFAHGNAKRVLIIGGGDGGMLREVCRHQYLESITMVEIDAGVVEFCRQYLPNHNAGAYDDPRFNLIIDDGVNFVNTTDQKFDVIISDCTDPIGPGEGLFTSEFYQGCQRCLNEGGIFVAQNGVCFLQQDEAVTSHKKLSNYFADSGFYQAAIPTYYGGIMTFAWASQNPALRHVDLATLQQRFDNASFTCRYYNPAVHVGSFALPQYLLDALFTGCTI

SEQ ID NO: 22315 - protein, 181 aa, Photorhabdus luminescens subsp. laumondii TTO1
MSKPKHIVEVMISELEVKQRIAELGKQITEHYRDSGSDLVLVGLLRGSFIFMADLCREIQIPHQVDFMTASSYGSGMNSTRDVKILKDLDEDIRGKHVLIVEDIIDSGNTLNKVREILALREPKSLAICTLLDKPSRREVGVPVEWIGYSIEDKFVVGYGIDYAQLYRHLPYIGHVILLEE

SEQ ID NO: 22316 - protein, 183 aa, Photorhabdus luminescens subsp. laumondii TTO1
MVNFIMKHTVEVMISEQEVKQRIAELGKQITEHYCDSGSGLVLVGLLRGSFIFMADLCREIQIPHQVDFMTASSYGSGMNSTRDVKILKDLDEDIRGKHVLIVEDIIDSGNTLNKVREILALREPKSLAICTLLDKPSRREVDVPVEWIGYSIEDKFVVGYGIDYAQLYRHLPYIGHVVLLEE

SEQ ID NO: 22317 - protein, 427 aa, Photorhabdus luminescens subsp. laumondii TTO1
MSQSDILYSQAKQLIPGGVNSPVRAFNGVGGTPLFIKHADGAYLYDVDGKAYIDYVGSWGPMVLGHNHSAIRNAVIKAAEQGLSFGAPTAAEVEMAQLVTELVPSMDMVRMVNSGTEATMSAIRLARGYTHRDKIIKFEGCYHGHADCLLVKAGSGALTIGQPNSPGVPVDFVKHTLTCTYNDLSSVREAFEQYPQEIACIIVEPVAGNMNCVPPQPEFLPGLRALCDEFGALLIIDEVMTGFRVALSGAQSYYDVEPDITCLGKIIGGGMPVGAFGGRYEVMEKLAPIGPVYQAGTLSGNPIAMAAGLACLKEVSQPGVHQRLTELTDNLAAGLTKSAKAANIPLVVNHVGGMFGIFFTDAETVTCYQDVMNCDIERFKHFFHLMLDEGVYLAPSAFEAGFMSIAHTDEDIQRTVNAAARCFAKLK

SEQ ID NO: 22318 - protein, 433 aa, Photorhabdus luminescens subsp. laumondii TTO1
MSKIVKVIGREIIDSRGNPTVEAEVHLEGGFVGLAAAPSGASTGSREALELRDGDKSRFMGKGVLKAVDAVNGPIAQAVIGQDAKDQANIDKIMIDLDGTENKSQFGANAILAVSLANAKAAAAAKGMPLYEHIAELNGTPGKFSMPLPMMNIINGGEHADNNVDIQEFMIQPIGAKTLKEAVRIGSEVFHNLAKVLKAKGMSTAVGDEGGYAPNLESNAAALAAIKEAVEQAGYVLGKDVTLAMDCAASEFYNPETGNYELKGEGKTFTSQEFTHYLEDLTRKYPIVSIEDGLNESDWEGFAYQTKVLGEKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGNRAPFYGLKEVKGQA

SEQ ID NO: 22319 - protein, 387 aa, Photorhabdus luminescens subsp. laumondii TTO1
MSVIKMTDLDLAGKRILIRADLNVPVKDGKVTSDARIRASLPTIEAALKQGAKVMITSHLGRPTEGEYSEEFSLKPVVDYLEEKLSSPVRLEKEYLEGVDVAEGELVVLENVRFNKGEKKDDETLAKKYASLCDIYVMDAFGTAHRAQASTHGVAKFAPVACAGPLLSAELEALGKALDNPARPMVAIVGGSKVSTKLTVLDTLSKIADQLIVGGGIANTFVAAEGHNVGRSLYEDDLLPEAKKLLISCDIPVPTDVRVATEFSETAEAILKSTHDIKDDEQILDLGDESAQRLADILKNAKTILWNGPVGVFEFPNFRQGTEIVARAIADSDAFSIAGGGDTLAAIDLFGIADKISYISTGGGAFLEFVEGKKLPAVVMLEERAKQ

SEQ ID NO: 22320 - protein, 490 aa, Photorhabdus luminescens subsp. laumondii TTO1
MTNNVNTELLRQQAYINGQWVDADNQATFKVTNPANGEVIAHVSNMGAAETERAIAAAQQALPAWRTMTAKQRSQILQRWFQLMMANQPALAELLSREQGKSQTEAMGEIAYGASFIEWFAEEGKRTYGETIPSPLPGRRIVTIKQPIGVVAAITPWNFPNAMITRKVGPALAAGCTVILKPASETPLSALALAALAEQAGIPAGVFNVVTGIDAKAIGGAMTQSPIVRKLSFTGSTRVGKLLMAQSADTVKKLSLELGGNAPFIVFDDANIDAAVQGALIAKFRNSGQTCVCANRILVQETIYDTFAERLAQAVNQLQVGPASDAKSQQGPLINQAAVDKVEEHISDAISHGARILAGGKPHALGGLFFEPTVLADVNKSMLISQEETFGPIAPLFKFRDEAEAIHLANETEFGLAAYFYSRDIGRIYRVAEALESGMVGINEGLISNEAAPFGGIKQSGLGREGSRYGIEDYLEVKYLCFGGIEDTGV

SEQ ID NO: 22321 - protein, 488 aa, Photorhabdus luminescens subsp. laumondii TTO1
MTVISHWINGKNISSKTYFETTNPATGEVLAEVASGGQEEVDQAVAAAKAAFPKWADLPMKERARLMRRLGELIDENVPEIAAMETKDTGLPIHQTQNVLIPRASHNFNFFAEICQQMNGRTYPVDDKMLNYTLVQPVGVCALISPWNVPFMTATWKVAPCLALGNTAVLKMSELSPLTANRLGELALEAGIPAGVLNVVQGYGATAGDALVKHHDVRAVSFTGGTATGRQIMKNAGLKKYSMELGGKSPVLIFEDADIERALDAALFTIFSINGERCTAGSRIFIQQSIYPEFIKRFAERANRLRVGDPQDPTTQIGALISKPHWEKVSGYIRLGIEEGATLLAGGPDKPIDLPAHLKDGHFLRPTVLADVDNRMRVAQEEIFGPVACLLPFKDEAEGLRLANDVEYGLASYLWTQDVSKVLRLARNIEAGMVFVNTQNVRDLRQPFGGVKASGTGREGGEYSFEVFAEMKNVCISMGDHPIPRWGV

SEQ ID NO: 22322 - protein, 308 aa, Photorhabdus luminescens subsp. laumondii TTO1
MSTTFSNTLLSDILRQVRPLIGQGKVANYIPALAEVPADNLAIAICTIDGQIFHAGDAEKRFSIQSISKILSLTLAMTRYQEQEIWQRVGQEPSGQPFNSLVQLELEKGKPRNPFVNAGALIVCDMLQSRLSAPKQRMLEVVRKLAGCPDICYDSKVARSEMEHSHRNAAIAYLMKSFGNFDNDVLAVLQTYFHYCALKMNCIELAKCFIYLANQGSTIGSEQQILSPRQARQINALMMTCGMYDGSGEFAFRIGMPGKSGVGGGIVCVVPGEFTVTVWSPELDRSGNSLAGCAALELLADRVGRSVF

SEQ ID NO: 22323 - protein, 385 aa, Photorhabdus luminescens subsp. laumondii TTO1
MDQNNLLKIREKVSELDLKLLILLAERRQLAFDIAQTKLQDNRPIRDKDRERELLDVLIKKGKSYGLDGFYISRLFQMIIEDSVLTQQALLQQHLNQTPQDSARIAFLGPRGSYSHIAARQYAARHFNQLIECSCHKFQDIFSLVETGQADYGMLPIENTSSGSINDVYDLLQHTNLSIVGEITIPINHCLLVATDTTLSEIKTVYSHPQPFQQCSQYINQFPHWKIKYCESTAAAMQKVAEQNSPEIAALGSEAGGALYQLQVLEQNLANQSHNITRFIIVARQPIEVAEQVPAKTTFIMATGQQAGALVDALMVLKKHNIIMSKLESRPINGNPWEEMFYIDVQANIRSINMQHVLKALAKITHSLKVLGCYPTESVVPVNPS

SEQ ID NO: 22324 - protein, 241 aa, Photorhabdus luminescens subsp. laumondii TTO1
MISLKNVSKWYGQFQVLSDCSTEVKKGEVVVVCGPSGSGKSTLIKTVNGLESIQQGEILVNDIKVNDKNTNLAQLRSKVGMVFQHFELFPHLSIIENLTLAQIKVLNRDKKAAEEKGLKLLERVGLASQANKFPSQLSGGQQQRVAIARALCMDPIAMLFDEPTSALDPEMINEVLDVMVKLADEGMTMMVVTHEMGFARKVANRVIFMDEGRIVEDSKKEDFFANPKSDRAKEFLAKILH

SEQ ID NO: 22325 - protein, 362 aa, Photorhabdus luminescens subsp. laumondii TTO1
MSIEINNISKYFGRTQVLSDITLNVFSGEMVALLGPSGSGKTTLLRIIAGLEQQTAGKLSFHGQDVSRMHAKDRQVGFVFQHYALFRHMTVFDNVAFGLTVLPRRRRPNMAAIRRKVMELLEMVQLTHFAERYPSQLSGGQKQRVALARALAVEPQILLLDEPFGALDAQVRMELRRWLRQLHEELKFTSVFVTHDQEEAMEVADRVVVMRQGNIEQVGTPQEVWRYPASRFVMEFLGEVNHFSGEIKGSQLLIGGQHLPLNVTPIHQGNVDVFLRPWDIMMNSQPTLSSPLPVQVTEVSPRGHFWQLSVQPLGWHHESVAVVWFDETSVPTRGNRYFIGGTEARLYAGDKQLQTLSLAQTA

SEQ ID NO: 22326 - protein, 293 aa, Photorhabdus luminescens subsp. laumondii TTO1
MASLEHFIGNTPLVKLQRITDKLGGEIWVKLEGNNPAGSIKDRTALSMIQQAELRGEISPGDVLIEATSGNTGIALAMIAAVKGYHLKLLMPDNMSLERQASMRAYGAELILVSRAMGMEGARDLAQQMERNGEGKVLDQFNNPDNPLAHFTTTGPEIWQQTQGRITHFVSSMGTTGTITGVSRYLKSQSNRVQIIGLQPAENSHIPGIRRWSPAYLPGIFRKELVDQVLDITQKEAEDTMRLLAQKEGIFCGVSSGGAVAGALSIAAQNPGSVIVTIICDRGDRYLSTGVFN

SEQ ID NO: 22327 - protein, 317 aa, Photorhabdus luminescens subsp. laumondii TTO1
MNKIYEDNSLTIGRTPLIRLKHFGNGRILAKVESRNPSFSVKCRIGSNMIWDAEKHGILQPGKELVEPTSGNTGIALAYVAAARGYKLTLTMPETMSIERRKLLKALGAQLVLTEGAKGMKGAIEKANEIKASDPDRYIILQQFSNPANPEIHEKTTGPEIWEDTDGEVDVFVTGVGTGGTLTGVARYLKNTKGKNITTVAVEPEESPVISQTLAGEEVKPGPHKIQGIGAGFIPDNLDLTLVDRVFKISSEEAIKTAREIMVKEGILAGISSGAAVAAAVKLSQEPEYKDKNIVVILASSGERYLSSVLFADLSDE

SEQ ID NO: 22328 - protein, 250 aa, Photorhabdus luminescens subsp. laumondii TTO1
MAVTKLVLVRHGESEWNRENRFTGWTDVALSEKGRAEAQQAGQLLKEEGFVFDFAYTSVLKRAIHTLWNILDQVDQQWLPVEKSWKLNERHYGALQGLDKAETAAKYGDDQVKLWRRGFAITPPDLTKDDERFPGHDPRYANLKPEELPVTESLATTIERVIPYWEEVIKPRVAQGEKVIIAAHGNSLRALVKYLDNMSEETILELNIPTAVPLVYEFDENMKPIKHYYLGNADEIAAKAAAVANQGKAK

SEQ ID NO: 22329 - protein, 370 aa, Photorhabdus luminescens subsp. laumondii TTO1
MRNIMLFERYSLNGLSLSNRIVMPPMTRSRAGTNGIATDLMAEYYAQRASAGLIISEGTQISQQGQGYAWTPGIYKPEQIIGWKKVTDAVHMAGGKIFAQLWHVGRVSHTILQPNNSEPVSPSALQAKGVKVFLDVAGRGPEHGIGEMVQHSQPRALTLDEIPDIVNDYVQAANNAIAAGFDGVELHAANGYLINQFIDSQTNLRDDEYGGTLQNRLRFLREVATSVASAIGKDKLGVRLAPLTTLMGSKDDTPEATYLAAASVLNDIGIAYIHIAEADWEDAPVMPVTFKEAFRLLYHGTLIYSGKYTLERAEEALTKGWADLIGFGRPFIANPDLPYRLANKLELNPPIKEKFFGGNMEGYTDYLAIN

SEQ ID NO: 22330 - protein, 468 aa, Photorhabdus luminescens subsp. laumondii TTO1
MSKQQIGVVGMAVMGRNLALNIESRGYSVSIFNRSSDKTDEVIAENPGKKLVPSYTVEEFVDSLEKPRRILLMVKAGEATDKTIASLTPHLDKGDILIDGGNTYFQDTIRRNRELSAQGFNFIGTGVSGGEEGALKGPSIMPGGQKEAYKLVAPILQEIAAKAEGEPCVAYIGPDGAGHYVKMVHNGIEYGDMQLIAEAYSLLKNALNLSNEELSEIFTDWNNGELSSYLIEITADIFHKKDEAGQYLVDVILDEAANKGTGKWTSQSSLDLGIPVTLITESVFARYISSLKDQRVAAAQVLSGPDVQPFKGDKAEFIEKVRRALYLGKIVSYAQGFQQLKAASDEYQWDLNYGEIAGIFRAGCIIRAQFLQKITDAYNENVDIANLLLAPYFKKIADEYQQALRDVVSYGVQNGIPTPTFSAAISYYDSYRSAVLPANLIQAQRDYFGAHTYKRTDKEGVFHTEWME

SEQ ID NO: 22331 - protein, 201 aa, Photorhabdus luminescens subsp. laumondii TTO1
MLTAQQIEKLDWEKVAYMMPVIVQHAISGDVLMMGYMNKEALNITISSGKITFFSRSKQRLWTKGESSGHFLNLVNIYPDCDNDTLLALADPIGPTCHFGTHSCFAPAQTEWGFLYQLEKLLASRKTADPDHSYTAKLYASGTKRIAQKVGEEGLETALAAAVNNREELTNEAADLMYHLMVLLQDQELDLSCVIRRLRER

SEQ ID NO: 22332 - protein, 1326 aa, Photorhabdus luminescens subsp. laumondii TTO1
MGSTTMGVKLDEATRDRIKAAAQRIDRTPHWLIKQAIFNYLERLENDEQIAELSSNQDVKEEKIIAEETVTDSAHQPFLDFAEHILPQSVKRSAITAAYRLPETQAIPMLLQQAQLPEDQAQATHKLAYSIAEKLRNQKNSMGRSGLVQGLLQEFSLSSQEGVALMCLAEALLRIPDKATRDALIRDKISNGNWHSHLGQSSSMFVNAATWGLLFTGKLVSTHNEAKLSNSLNRIISKSGEPLVRKGVDMAMRLMGEQFVTGETIAQALASARKLEEKGFRYSYDMLGEAALTEEDAQNYMVSYQQAIHAIGKASNGRGIYEGPGISIKLSALHPRYSRAQYERVMNELYPRLLSLTLQARQYDVGINIDAEEADRLEISLDLLEKLCFEPQLAGWNGIGFVIQAYQKRCPFVIDTVIDLAQRSRRRLMVRLVKGAYWDSEIKRAQIDGLEGYPVYTRKVYTDVSYLACARKLLSVPNLIYPQFATHNAHTLAAVYHMAGQNYYPGQYEFQCLHGMGEPLYEQVVGKIADGKLNRPCRIYAPVGTHETLLAYLVRRLLENGANTSFVNRIADTTLPLDELVADPVTKVKKLAETDGQIGLPHPKIPLPHNLYGKDRANSAGLDLANEHRLASLSSALLSSATEEQYSEPRLGGNYHHQGELPAAKPVINPATPSDIVGYVREATEQEVSHALDVATEAGAIWFATPPSERAAILVRAAELMENQMQPLLGILVREAGKTFNNAIAEVREAVDFLHYYAGQIRHDFANDTHRPLGPVVCISPWNFPLAIFTGQIAAALAAGNSVLAKPAEQTPLIAATAVKILHQAGIPLDALQLLPGQGETIGALLVGDERVRGVMFTGSTQVASLLQRNIAGRLDAQGRPTPLVAETGGLNAMIVDSSALTEQVVMDVVASAFDSAGQRCSALRILCIQDDVAERTMTMLKGAMSECRMGNPERLSTDIGPVIDAEAKAGIDRHIQAMRTKGRTIYQAAQDNVVDNQEWDQGTFVKPTLIELESFDELKQEIFGPVLHVVRFKRHELDKLLDQINNSNYGLTLGVHTRIDETIAQVTAKAKVGNLYVNRNMVGAVVGVQPFGGEGLSGTGPKAGGPLYLYRLLSCRPQNAINQTLERQDAEYPLDANVRSALMAPFDALTEWAANQHNEELNQLVQQYKLLAQGGTTRLLPGPTGERNTYTLLPRGQVLCLADNQQDTLIQLAATLSVGCQLLWQNDELHQQLFRQLPDSVRKSIHLVQDWQSEDTAFEAVIYHGDSDQLRQVCGQVAQRKGIIISVQGFARGETNLLLERLLHERSLSINTAAAGGNASLMTIG

SEQ ID NO: 22333 - protein, 468 aa, Photorhabdus luminescens subsp. laumondii TTO1
MAENIHTSLSTKTGETQLQRNLSNRHIQLIAIGGAIGTGLFMGSGKTISLAGPSIIFVYMIIGFMLFFVMRAMGELLLSNLNYKSFSDFSADLLGPWAGFFVGWTYWFCWVITGIADVVAITSYISYWQPDFPQWITSLLCVSLLLSLNLATVKLFGEMEFWFAMIKIVAIIALIATGAVLIGMHFQSPAGHTASLANIWNDGGFFPKGLSGFFAGFQIAIFAFVGIELVGTAAAETKDPMKSLPRAINAIPIRIITFYVLALIIIMSVTPWRSIIADKSPFVELFVLIGLPAAASIVNFVVLTSAASSANSGVFSTSRMLFGLAKEGDAPQQFSRLSRRSVPASGLIFTCLCLSCGVVLIYLIPDVMHVFTLVTTVSAILFMFIWSMILCSYLVYRKRRPALHKASTYKMPLGIIMSWVCLTFFAFVLILLTLRDDTRQALIITPVWFLILIIGFQIVKKRRTRLYS

SEQ ID NO: 22334 - protein, 351 aa, Photorhabdus luminescens subsp. laumondii TTO1
MPTLFDPIRIGDLDLPNRIIMAPLTRNRAEGEGRVPNALMAEYYAQRASAGLIISEATSVTPQGVGYENTPGIWSDEQVAGWRLVTDAVHAAGGRIFIQLWHVGRISDPVFLNGERPVAPSAIAADGHVSLLRPKRPFVVPQALESEEIPGIVEAFRRGAENAKTAGFDGVEIHGANGYLLDQFLQDNANLRTDQYGGSVENRARLLLEVTDACISVWGSSRVGMHLAPRGGHYSMADSNPVATFGYVARELGKRGIAFIFSRDAVVDGDLSKVIKEAFGSTYIANEELTKESAEQVLADGRADAVAFGQLFISNPDLPHRFLVKAPFNEQQPETFMVPGAIGYTDYPALT

SEQ ID NO: 22335 - protein, 231 aa, Photorhabdus luminescens subsp. laumondii TTO1
MLRKLAAELLGTFVLVFGGCGSVVFAAAFPELGIGFVGVSLAFGLTVLTMIYAVGHISGGHFNPAVTIGLWAGGRFRAVEVIPYIISQVIGGILAAAVLYVIASGQVGFDATTSGFASNGFGEHSPGGFSLQSAIVAEIVLTAIFLIVIIGATDRRAPPGFAPLAIGLALVLINLISIPITNTSVNPARSTAVAIFQNTWALEQLWFFWVMPIIGGIVGGGIYRLLFAEKQ

SEQ ID NO: 22336 - protein, 480 aa, Photorhabdus luminescens subsp. laumondii TTO1
MSRRLRRTKIVTTLGPATDRDNNLEKIIAAGANVVRLNFSHGTAEDHLQRASKVREIAARLGCHVAILGDLQGPKIRVSTFKEGKIFLNIGDKFLLDANLGKGEGDKEKVGIDYKGLPTDVVPGDILLLDDGRVQLKVLDVQGMKVFTEVTVGGPLSNNKGINKLGGGLSAEALTEKDKEDIITAARIGVDYLAVSFPRTGEDLNYARRLARDAGCETQIVAKVERAEAVSSDKTIDEIILASDVVMVARGDLGVEIGDPELVGVQKKLIRRARQLNRVVITATQMMESMITNPMPTRAEVMDVANAVLDGTDAVMLSAETAAGQYPAETVAAMARVCLGAEKMPGLNVSKHRLDTIFDSIEEAIAMSTMYAANHLNGVKAIIAMTESGRTTRIMSRISSGLPIFSMSRHEKTLNQTALYRGVTPVYCSSHTDGITAANEAVNRLRDKGYLVSGDLVLVTQGDQMGTIGSTNTCRILEVE

SEQ ID NO: 22337 - protein, 334 aa, Photorhabdus luminescens subsp. laumondii TTO1
MKLVVYSTKQYDHKHLEQVNKKLGFGYDFEFFDFPLSSKTAKNAIGADAVCIFVNDNADRKVLEELAEMNIKILALRCAGFNNVDLDAAEELGIQVVRVPAYSPEAVAEHTVGLMLCLNRRIHRAYQRTRDANFSLEGLIGFNMHSRTAGIIGTGKIGIATLRILNGFGMRLLAHDPYPNQAVLNLGAQYVDLDTLYAQSDVISLHCPLTPENHHLLNEVAFSKMKNGVMIINTSRGALIDSVAAINALKQQKIGALGMDVYENERDLFFEDKSNDVIQDDIFRRLSSCHNVLFTGHQAFLTEEALTSISETTLRNIQQLINGKNCPNIVSKYP

SEQ ID NO: 22338 - protein, 1139 aa, Photorhabdus luminescens subsp. laumondii TTO1
MSEQNQTVTLPDKKDIGLLTEEGLWDNWLDIDAVKKLVNHPLLIAMSEERITLSGMRYFLIQHHYYSRNFTRFLCALISHIDNFNDIHHLMENLREEMGVNGEGKVTHAELFQRSLMETGAQVSSIPALEETSHLASCVLNYCRSGEIADGLAALCLGAEAIVPMIYKPVLHALTHLGVAERGLEFFKLHIEEDEDHAITMMHILHNIIENNEQLSKRVKAVGKNTILLRCRMFDAVYENIKNEILFTEDACRTFEKYESNVRSYCRNYPAIFTTASNALVTDKQGKSWIDFLSGAGSLNYGHNNPRLKSHLIEYIEKDGITHSLDLYTNAKRAFIESFNQQILKPRGLQYRFQFTGPTGTNAVEAAMKIARKVTGCSDIVAFTNAFHGMSLGALAATAREKKRNAAGVSLNNIVRLPFENFLSQNDTSLDVLEKMLVSPGSGIDLPAAIILETIQAEGGVNVASVEWLRGVAEIAAANNILLIVDDIQAGCGRTGTFFSFEDAGIKPDIICLAKSISGYGLPMSLVLMKPELDIWQPGEHNGTFRGNNLAFIGATYALDYWHDPHFLRSLKDKSEIVHKYLLGLHQRYPQLIRTIRGKGMLWGLELFSSQAAENVRNQATELGLIIETCGPLGQVIKLLPPLTIEINVLEHGLLLLEKSLKQVSVQLGMENKINTSSLTPHDTLFYQDEILIEKKLLSLDENEKSSLLEAQKSLSQKLIDGGLNFEGKNYPVSIRPLLLSDNLIRQLASIGERFTEVFEKFAHAWVENVSIREYFPTYKKSEHYLFNLPNHTPLTRIFRLDGLFSEDGTYQILETNTDCPGGVIQNGIAGALWSEVSNPLLNGIEASADFQPFVQNPDLFLETLLETHRERTGEPARRAAIVTYKGRFKNEVTWMVNGFNRLGVPTEEIDASLLRRHNNKVIDPQGRVIDVVYNKLDLRDLIDEPEVEEYLTATSHGEVTFINPLICQWPLADKAIMAVLSDPQMLFFLPEEEKAFCLKHIPWTRILRACQTTSPQGRQIDLVDWAIQERGTLVLKPSNATRGEGLLVGPFTTAQEWETALHLAAQSDETWVIQRYIRGRVISVVHPDIGVTDSMWSGVDTYVYGGRFAGFQARASFDPVMNVGCRGILLPVVKIKEA

SEQ ID NO: 22339 - protein, 394 aa, Photorhabdus luminescens subsp. laumondii TTO1
MRNQTFIIVGAGQAGAMAAATLRQQQFDGDIILIGKEYHAPYERPILSKDYLINPEEAPKYLFSEDFYLEKQIDLRIGQLVSQIMPSKHCVVLENGGKLRYDKLLLTMGARARRFPLLDQLGENIYTLRTLDDAQRLRQAVKKDKRILIVGGGVIGLELAATSCELGANVTVIEQADNIMGRCAPPLLQDYLLNRHQEKGVQFFLDTNIVSAQKQGSELVLILNTGEKVIGDIIIYGIGAEFRDQLAADAGLVTDGGIVIDSRCQTSEPDIFAAGDVCLQREPLTGDLQRRETWENANRQATIAAHAMMGLAPPQPGAPWFWTDQWGINIQMVGNMQAEEWHIQGDLQSDKAILFGTENEVLVGAVAINQGREMRNLRKLLANPAQVVSGVEWA

SEQ ID NO: 22340 - protein, 443 aa, Photorhabdus luminescens subsp. laumondii TTO1
MSKTHYSESLNLKSHWMPFSANRSFQRDPRLIVAAEGQWLKDDKGRQIYDSLSGLWTCGAGHTRTEIQQAVAAQLSTLDYSPGFQFGHPLSFQLAEKIANLTPGDLNHVFFTSSGSESVDTAVKMVRAYWRVKGQPEKTKLIGRALGYHGVNIAGTSLGGIGGNRKMFGQLMDVDHLPHTLQTDMAFTPGMAETGGAELANEMLKLIELHDASNIAAVIVEPVSGSAGAIIPPKGYLQRLREICDQHNILLIFDEVITGFGRMGRWTGAEYFGVTPDLLNFAKQITNGAIPLGGVVASSEIYEAFMSQSLPEHSVEFSHGYTYSAHPVACAAGLATLDLLDKNHLIQRSAELAPHFETALHALRNCPNVTDIRNCGLVGAIELAARDGDTAVRPFDASMALWKAGFYVRFGGDTLQFGPMFNAERADLDRLFDAVGEVLHHID

SEQ ID NO: 22341 - protein, 306 aa, Photorhabdus luminescens subsp. laumondii TTO1
MPLDKNVEKWLASTPEIAIGEDSPLEQLRIVLEHALIQQQGEWNDATYNSSFTVLAEDGFPIPVRMYVPYGKEKMSDKPALVYAHGGGWCLGSLDAWDRPCRKLAESMGCVIFSVDYRLAPENPFPVPLTDFYAALCYVTDNAEKFGINRQQIAVGGDSAGGNLAVAACLMSRNQEGPAICYQLLFYPALDASMETDSYDKYGEGYVLTKQMMAFFWQAYINEHNSRTNPLISPSHLTHFEGLPDATILLCEYDPLRSEGEAYAQQLRDAGVSVQIETIEGMIHGAMHMTAVTPSVEAFYKKFCFC

SEQ ID NO: 22342 - protein, 480 aa, Photorhabdus luminescens subsp. laumondii TTO1
MKNKFPTGFLWGGAVAANQVEGYWNQDGKGMSIADVMTKGEHGVNRVITHGIEENKIYPNHQGVKFYSHYKDDIALFAEMGFKCFRTSIAWSRIFPHGDELQPNEAGLKFYDDLIDELLKYNIEPIITLSHFEMPYHLVKEYGGWHNRKLINFFMNFSLTVMERYKNKVKYWITFNEINNQINWQYPLFGYCNSGVIYQDYDNPEQVMYQTIHHQFVASAKVVKLGHEINPNFKIGGMIHMSPLYPASCKPEDVLYAQQAMRQKYLFSDVQLRGYYPSYLIKEWERKKIELHIEDDDLNWLKEGCADYLAISYYMSNIVSSSTEMLEKNSQSLSFFEKGRDNPYLKSSEWEWQIDPIGIRYSLSELYERYQKPIFIVENGLGSVDKLPQNGVINDDYRIEYLASHLSEIKKSILFDGVDILGYTSWGCIDCVSFSTGEYRKRYGFIYVNVDDNGNGDFVRYKKKSFSWYKKVIATNGEDI

SEQ ID NO: 22343 - protein, 338 aa, Photorhabdus luminescens subsp. laumondii TTO1
MHSQINSLPQYMLAISIIKPGGPEKLHLVQVPLPRPGKGYLLVKVAAAGVNRPDIFQRMGSYPPPPDASPLPGLEIAGEVVAKGEGCERWNLGDKVCALVAGGGYAEYCLVHDSVALPIYGLDFVQAAALPENFFTVWANVFQTGQLKPGENLLIHGGTSGIGSVTIMLAKAFGAKVITTVGSDEKAKVAHSLGADFVINYHKEDFVDRVLKITGNHGVDMVVDLIGGDYVNKNYKVAAKFGRIIQIGMMKGNPENLNLMPLMLKRLTHTGSTLRSRSVEEKAEIAKELEKQVWPLLKSGKVTPLICKVFDLKDAADAHRMMEAGDVIGKVMLVNVSP

SEQ ID NO: 22344 - protein, 425 aa, Photorhabdus luminescens subsp. laumondii TTO1
MTESMLAKRRSAAIARGVGVTTQVYAERAENAEIWDVHGQRYIDFAAGIAVVNTGHCHPRVIAAAREQMEQFTHTCHQVVPYENYVALAERLNRLVPGNFAKKTVFVTTGAEAVENAVKIARAATGRSGVVAFSGAFHGRTFLGMSLTGKVAPYKMGFGPLVSDVYRVPFPVGLHGISVEQTLNALENLFKADIEPTRVAAIIIEPIQGEGGFYPAPPELLKALREIADCHGIVLIADEIQTGFARTGKLFAMEHHEVVADLTTMAKSLAGGLPLAAVTGRAELMDAVVPGGLGGTYGGNPVAIAAAHAVLDVIEEEKLNVRATQLGEQLKQRLHELRPHVPQIADVRGLGLMIAVEFNHADSQEPDANFTNAVRQKALECGLILLMCGVHGNVIRFLPPLTIQNDVFNEALNILESVLLDLTKQ

SEQ ID NO: 22345 - protein, 476 aa, Photorhabdus luminescens subsp. laumondii TTO1
MPVPTLRHFINSQYVESKSSEYFDLISPVTGETYARSPNATIADVNEAYASAKEAFKIWGRSTPSARQQALLALADAVEKNSERLIEAQSRNTGQLKHLIASEEVAASVDHIRFFAGAARFLEGKATAEYLPDMTTSIRREPLGVVGQVTPWNYPLMMAVWKIAPALAAGNTVVLKPSDTTPESTLLLAELAAPFFPTGAFNVVLGNASAGALVVSHKTPAMVSITGSVRAGLQVASSAAANLTRAHLELGGKAPVVVFADADMDKAVETIATAGYFNAGQDCTAASRVLVHESVYDTFVAKLVAAAKATRFGYPEDEEALYGPLNNARQLEQVKGFIARLPAHACIETGGRQAERSGYYFEPTVITGLEQHDEAIQTEIFGPVITVQKFRDEQDAIEKANDVKYGLASSVWTRDHGRALRLSRELDFGTVWINTHIPLTAEAPHGGFKSSGYGKDLSAYGFDEYTRIKHVMSSND

SEQ ID NO: 22346 - protein, 268 aa, Photorhabdus luminescens subsp. laumondii TTO1
MERYEQLFKQLESRKQGAFVPFVTLGDPTPELSLKIIDALITGGADALELSIPFSDPLADGPTIQNANLRAFSSNVTPTLCFELLTKIRAKYPDIPIGLLMYANLVFHHGIDEFYRRCKDTDIDSVLVADVPMSESRPFRTAAMKHGIAPIFICPPDAEDELLREIASYGRGYTYLLSRAGVTGIERRGEKPLNHLVNKLREYHAAPPLQGFGISEPKQVKETLASGAAGAISGSAIVKIIEENLSQPEIMLKELTEFVSKMKSATQL

SEQ ID NO: 22347 - protein, 301 aa, Photorhabdus luminescens subsp. laumondii TTO1
MSQSIQKIGIIGLGAMGMGIARALIRAGIPTYGFDLNQKACDQLLQAGAKAATNNAANWASELDAILLVVVNGAQIESILFEGETPLVNQLKAGTIIVLHSTVAAEQAKDFAHRLSQHNLNMLDAPISGGALKAEQGQLTVMASGEPALFEQLKPVFDATTERLYHVGNEIGQGSTVKTIHQLLAGIHIAAAAESMALAAKAGISLELMYDIVTHAAGNSWMFENRVPHILAGDYTAKSSVDIFVKDLRLVLETGRDLKLPLPLSATAHQMFLTASNEGFGQWDDSAVIKTFKGITLPEKK

SEQ ID NO: 22348 - protein, 457 aa, Photorhabdus luminescens subsp. laumondii TTO1
MQKYLKEARSLLALGIPVIIAQFSQTAMGVVDTVMAGSVSATDMSAVAVGTSIWLPVILFGYGLLLALTPIIAQMNGSGRRNLIASQTQQGFWLAIFLSIIIIAILYNSKFLIDRQHNIDPILAEKAVGFIHAIMWGAPGYLFYQVLRNQCEGLSKTKPGMVISFLGLLINIPINYIFIYGKFGAPALGGVGCGVATASVYWVMFLLMRWYVKRASSQRDIRPKHRFAAPEWHILKRISALGLPIAMAVFFEITLFAIVALLISPLGVTAVAGHQIAQNFSSLMFMFPISLAAATTIRVGYNLGKKSIENARISAYTGIMVGLVFACLTATFSIILREPIALMYNDNPEVITMASHLMLFAALYQLSDAIQVVGAGVLRGYKDTRSIFYITFIAFWILGLPSGYILGLTDYIVPAMGPQGFWIGFIIGLTASAVMIFARISWTQKQPDEVILQHSTH

SEQ ID NO: 22349 - protein, 469 aa, Photorhabdus luminescens subsp. laumondii TTO1
MKKTKIVCTIGPKTESEEKLAELLNAGMNVMRLNFSHGDYEEHGQRIQNIHSVMTKTGKQAAILLDTKGPEIRTMKLEGGNDVSLTAGQTFTFTTDTSVIGNKDRVAVTYRGFPADLAPGNTVLVDDGLIGMTVKEVTKSEVICQVLNNGDLGENKGVNLPGISISLPALAEKDKQDLIFGCQQGVDFVAASFIRKRSDVLEIREHLKAHGGENIQIISKIENQEGLNNFDEILEASDGIMVARGDLGVEIPVEEVIFAQKMMIQKCNIARKVVITATQMLDSMIKNPRPTRAEAGDVANAILDGTDAVMLSGESAKGKYPIEAVTIMATICERTDRVMPSRIEAVHCRNLRVTEAVCRGAVETAEKLEAPLIVVATYGGKSAKSIRKYFPDAPILALTTNEVTARQLLLVKGVFTQIVKEIASTDDFYRIGKEAALASGLAKKGEIVVMVSGALVPSGTTNTSSVHVL

SEQ ID NO: 22350 - protein, 488 aa, Photorhabdus luminescens subsp. laumondii TTO1
MLRIKKEALTFDDVLLVPAHSTVLPNTADLSTQLTSSICLKVPMLSAAMDTVTESGLAIALAQEGGMGFIHKNMSIERQAEEVSRVKKHESGVVTDPVTVAPETTLREVKELTERNGFAGYPVVTEGNELVGIITGRDVRFVTDLDQPVTAVMTPKARLVTVKEGEAREVVLQKMHEKRVEKALVVDENFHLLGMITVKDFQKAERKPNACKDARGRLRVGAAVGAGAGNEARIDALVAAGIDVLLIDSSHGHSEGVLQRIRETRAKYPNLQIIGGNVATGEGAKALVAAGVNAVKVGIGPGSICTTRIVTGVGVPQITAISDAVEALEGTGIPVIADGGIRFSGDIAKAIAAGASCVMVGSMLAGTEESPGEIELYQGRSFKSYRGMGSLGAMSKGSSDRYFQTDNAADKLVPEGIEGRVAYKGLLKNIVHQQMGGLRSCMGLTGCATIDELRTKAEFVRISNAGIQESHVHDVTIIKESPNYRLGL

SEQ ID NO: 22351 - protein, 459 aa, Photorhabdus luminescens subsp. laumondii TTO1
MAGQSQRSTLKRGLKNRHIQLIALGGSVGTGLFLGIAQTIKMAGPSVILGYAIAGFIAFLIMRQLGEMVVEEPVAGSFSHFAYKYWGDFPGFLSGWNYWAMFTLVGMAELTAVGMYIHYWWPDIPTWVSATIFFVLINTVNLINVRLYGETEFWFSIIKVTAIICMIVFGSYLLVSGNGGPQASITNLWQHGGFMPNGISSLIMAMAVIMFSFGGLELVGITAAEAENPRISIPKATNQVVYRILIFYIGSLTVLLSLYPWGNVVEGESPFVMIFHNLDSFWVANILNIVVLTAALSVYNSGVYCNSRMLYGLAKQGNAPEMLTKVNESGVPIRAIVMSALATSIGVLINYVMPGKAFELLMALVVTTLVINWVMICMAHLKFRAEKVKQGIAPSFKAFWYPFGNYLCLVFLAFILVIILMMDSIRISVILMPFWVGVLWLGFLMSHSRRDKMKTEELG

SEQ ID NO: 22352 - protein, 493 aa, Photorhabdus luminescens subsp. laumondii TTO1
MSQQQKSVSRKPATQHLRRELKARHLAMIAIGGSIGTGLFVASGATVSQAGPGGALLSYALIGLMVYFLMTSLGELAAYMPVSGSFSTYGSKYVEEGFGFALGWNYWYNWAVTIAVDLVAAQLVMGYWLPDMPGWIWSALFLALIFLLNFISVKGFGEAEYWFSLIKVSTVIVFIVVGLLMIAGIMKGAEGAGWHNWTVGDAPFAGGFSAMIGVAMIVGFSFQGTELIGIAAGESKDPAKNVPSAVRKVFWRILLFYIFAILIISLIIPYTDPSLLRNEVGDISVSPFTLVFENAGLLSAAAMMNAVILTAVLSAGNSGMYASTRMLFTLAKEGKAPRIFGKLSKGGVPRNALYATTVVAALCFLSSMYGNQTVYLWLLNTSGMTGFIAWLGIAISHYRFRRGYVAQGLDLSKLPYRSGFFPVGPIFAFVLCLTITLGQNYQAFLQDKIDWYGVTATYVGIPLFLLIWFGYKLARKTHFIKYSEMKFPDIENQ

SEQ ID NO: 22353 - protein, 404 aa, Photorhabdus luminescens subsp. laumondii TTO1
MLAVKKSSKLDNVCYDIRGPVLKEAKRLEEEGNKVLKLNIGNPAPFGFEAPDEILVDVIRNLPTAQGYSDSKGLYSARKAIMQHYQARNMMDVTVEDIYIGNGVSELIVQAMQALLNTGDEMLVPAPDYPLWTAAVSLSSGKAVHYMCDEGSDWFPDLNDIRNKITPRTRGIVIINPNNPTGAVYSKELLLEVVEIARQHNLIIFADEIYDKILYDDAEHHSIAALAPDLLTVTFNGLSKTYRVAGFRQGWMVLNGPKKHAKSYIEGLEMLASMRLCANVPMQHAIQTALGGYQSISEFILPGGRLYEQRNRAWELINQIPGVSCVKPKGALYMFPKIDAKRFNVHDDQKMVLDLLLQEKVLLVQGTAFNWPEPDHLRIVTLPRLDELEMAIQKFARFIGKYHQ

SEQ ID NO: 22354 - protein, 484 aa, Photorhabdus luminescens subsp. laumondii TTO1
MIKNNKTQQNLSAEKFADTQTLHRGLSARHIQLISIGGAIGTGLFMGSGKTIAVSGTSIIITYAIVGFFVYMVMRAMGELLLTKLNYRSFADFVSDYLGTKASFFLGWTYWMSWIVSCIADVVVCGGYIQYWFPGVSLWVPAFITLGLLGTCNLLSVRLFGEAEFWFAMIKVIAILALIIIGVGMVMVGWQSPDGTIASVNNLTDPSVFLPNGIFGFFAGFQIAIFSFTGVELVGTMTAETKDPEKILPKAINYIPMRIMIFYIFSMLSIIAVTSWGRISAETSPFVTLFALAGLPAAAAVVNFVALTSAMSSANSGLYACTRMLYGLSTEKNAHRKFKILSRNTAIPVHSLIFSCFCMVVGTSLLFIVPNVMQLFTIVSTVASVMVIYSWCVILIAYLVYRKNYPDVHKRSIFKMPLGVLMTWLTLIFFIFTIVVMVFDPDTLIALCGTPLWFIMLSILWRVKKKNEAQKEQRYQIAKESFRS

SEQ ID NO: 22355 - protein, 402 aa, Photorhabdus luminescens subsp. laumondii TTO1
MLENIQRSWFEHYMVPCFSPAKFIPVRAKGSKVWDQDGKEYIDFAGGIAVNSLGHAHPELKDELIYQIDKIWHIGNGYTNEPVLKLAKRLVENTFADKAFFCNSGAEANEAALKLARKYAADKYGKNKNEIISFKDSFHGRTLFTVTVGGQPKYSQDYAPLPQEITHLPYNNLSAIREHISENTCAVIVEPIIGEGGVIPADPAFLQELRTLCDRFQALLIFDEIQTGVGRTGYLYAYQEYGVEPDILTSAKGLGGGFPIGAMLTKQHIAAVFQPGTHGTTFGGNPLATAVANKVLSIVNQAELLTGVLQRHDYFMDKLSKLNQRYQIFSCLRGKGLLLGAELDKAWQGKAKQLTNLAAEEGLIALIAGPDVLRFAPALNIEFADIDEGLVRLESAIMRFVG

SEQ ID NO: 22356 - protein, 440 aa, Photorhabdus luminescens subsp. laumondii TTO1
MNSTKTVSIQHVINNQKFSKVQWQVLILCFLIVVIDGFDTVLMGYIAPAVVNDFKVEGAILGPAMSAALVGLSLGSIFAGPLADRFGRKSVLTISVTVFGLLSLATAIADSIQTLTILRFLTGLGLGAAMSNAITLISEYAPENRRSLLINIVFCGFPLGAAVGGIISAWIIPHFGWQGVLILGGILPLFLSLFLFSLLPESLRYLVSKGGAEGNIRRILSKMTGNTLNDINKFTFDGEEIIHKSSIKTVLSNRFLIGTAMLWITYCMGALVFYVLTSWMPFLMNDVGFSVSMAATLTALFPLGGVISTVFSGWLMDRINPHKVVATNYALAGILVFFIGQEENVLLLSILIFLAGITMNGAQASMGSISAQFYPTHCRATGVAWMLGFGRFGGIFGTLFGAELIRLELSYSTIFAILSIPAIIAALSLTFKDVSYRRHK

SEQ ID NO: 22357 - protein, 375 aa, Photorhabdus luminescens subsp. laumondii TTO1
MKILVDENMPYADQLFQQLGDVQAIPGRPVPEGVLDHADAFMVRSVTKVNEELLKGRAVKFIGTATAGTDHVDQSWLSQAGIGFSAAPGCNAIAVVEYVFSALMLLAERDNFELKDKVVGIVGVGNVGSRLAERLAVLGIRTLLCDPPRADRGDAGEFWSLEKLVKEADILTFHTPLNKSGPYKTHHLVDVELLSVLPDNRILINASRGEVIDNQALLTALKCGKKLRVVLDVWEPEPDLSLPLLELVDIGTPHIAGYTLEGKARGTTQVFEAYCEFLGQPRKVALSDLLPEPDFSRVTLHGNVTQSTLKRLMHLVYDVRRDDTPLRQVAGQKGQFDYLRKNYLERREWSSLTVCCDNRESAELLAALGFSTELI

SEQ ID NO: 22358 - protein, 464 aa, Photorhabdus luminescens subsp. laumondii TTO1
MQASLQLERGLNARHIRFMALGSAIGTGLFYGSAEAINMAGPAVLLAYLVGGAAVFMVMRALGEMAVHRPDAGSFASYAHQYLGPLPGFITGWTYTFEMIIVCLADVTAFGIYMGLWYPEVPRWIWVLSIIFIIGALNLCKVKVFGEMEFWLSILKVAAISAMIIAGTGIILFGFSGHFQATGVQNLWQHGGFMPNGLGGIIESLAVVMFAFGGIEIIGITSSEAKNPAKVIPQAINSIPFRILLFYVLTIFVLMAIYPWNSIGQEGSPFVAIFQGLGIGSAANILNIVVITAAISAINSDIFGAGRMMYGMAEKGLAHKKFMHLSRNGVPWVTIMVMTLALLCAVVLNYLLPKQVFVIVASIATFATVWVWLMILLSQFAMRRKMSPGEAQKLQFPVPMWPVAPILTIVFMIFIIAVLSYFPATRIAFYVGGAWIALLTSAYYLWIRKNVIIVSAQSAKETRC

SEQ ID NO: 22359 - protein, 173 aa, Photorhabdus luminescens subsp. laumondii TTO1
MDYFTLFGLPARYTVDREQLASCYQELQRQFHPDRFASQPEREKTLALQQAVTINDGYQTLKHPLKRAEYMLSLHGFDLANEQHTMNDNAFLMEQLMLREELECIADKANPEVALADFAARLNGMIKTRSQLMVQQLDEQQWEQAADTVRKLRFLDKLQQQVEQLEERLLDDF

SEQ ID NO: 22360 - protein, 453 aa, Photorhabdus luminescens subsp. laumondii TTO1
MAKFSNWRELKQLLFFSFPIIVSQIARTAMSFVDIVMSGHYATADLAAVTLGSSIWFPIFVLGYGTIIMLAADVAKQKAQHDDEGIKDSLKNYLFLAVILSIPIIILLMLVSWLLSFIGIDEHILEITQGYVIALACGVPSVMIFNVFRSFLQGLEDTKIAMYLSAGALLLNIPLNYILIYGKLGLPEMGGIGAGITTAIINNLIAVCLIIYFLLKKEYRRYRPDFSLPKYNSLIRTFYIGMPSGLALFVEMVFLDVIAITAAPLGAQVIAAHNIMLNITSIIYTITGGIAAAVTVRVGSYIGKRDKISLTGTIKISIALILSISAVIGVLIYYFAGSFISLYTNDNGVIIIALNIIFLLCLFQFFDSCQAALSGILRGFHDTRSVFYAPLFGYWLVGLPLGFILALTDWVTERMGIIGFWYGLVLGLFVNAILLFIILKVRQRGMISRLISY

SEQ ID NO: 22361 - protein, 436 aa, Photorhabdus luminescens subsp. laumondii TTO1
MEIDEIFNNYESKARSYCRRFPVIFRNGIGSTLIDIDGKSYIDFLCGAGALNYGHNNTIIKQQIFKYIQDDGIIMGLDLYSEAKMEFISTFVDKILKPRQLEYRLQFTSPTGTSVIESAVKLARKYTKRENIVCFTNAFHGMTGVSLSLTGSQHHRQPGLYSQITRLPFDGYIDGEFDYIGYFRKLLTDSSSGVDLPAAVILETVQGEGGLNVASVEWLRALRKLTQEFNILLIVDDIQSGCGRTGTFFSFERASIKPDLVCLSKSIGGIGLPMSLLLISPDIDVWKPAEDNGTFRGNNLAFVASKAMLNEYWGDSSFQKIIEHKAELIRAYLDSLAKEYHEFVLRVKGIGFMQGIEMVDSSLTQYLVKHCFENGLIVELCGPNDEVLKLMPALTIDEDTLVKGLRIIEQALASLKSRNSNNCESEFQRVSASSNY

SEQ ID NO: 22362 - protein, 413 aa, Photorhabdus luminescens subsp. laumondii TTO1
MVKVSLEKDKIKFLLLEGVHQSTVENLRAAGYSNIEYHKGALDPKELKEAIRDTHFVGIRSRTQLTEDIFQAAEKLVAVGCFCIGTNQVDLKAAAKRGIPVFNAPFSNTRSVAEMVLGELLLLLRRIPLANAKAHRGVWDKQAKGCYEVRGKKLGIIGYGHIGTQLGILAENIGMDVYFYDIENKLPLGNAHQVRHLSELLNMSDVVSLHVPETPSTKNMIGATELTLMKPGSILINASRGTVVDIPALCDALESEHLSGAAVDVFPVEPATNNDPFESPLRKFDNVLLTPHIGGSTQEAQENIGYEVAGKLAKYSDNGSTLSAVNFPEVSLPVHADDTNRFLHIHENRPGILNSINQVFAEQDINIAAQYLRTSGDMGYVVIDIVTENPAQAEMVFQKLKALPGTIRSRLLY

SEQ ID NO: 22363 - protein, 476 aa, Photorhabdus luminescens subsp. laumondii TTO1
MMSTEIKAQVVVLGAGPAGYSAAFRCADLGLETVLVERYSTLGGVCLNVGCIPSKALLHVAKVIEEAKALADHGIVFGEPKTDIEKVRVWKEKVINQLTGGLAGMAKGRKVKVVNGFGKFTGANTLVVEGEGGATTINFDNAIIAAGSRPIQLPFIPHDDPRVWDSTDALALTTVPGRLLVMGGGIIGLEMGTVYHALGSQIDVVEMLDQVIPAADKDVVKVFTKRISKQFNLMLETKVTVVEAKEDGIYVTMEGKNAPAEPQRYDAVLVAIGRVPNGKMLDAGKAGVDVDDRGFIHVDKQMRTNVPHIFAIGDIVGQPMLAHKGVHEGHVAAEVISGKKHYFDPKVIPSIAYTEPEVAWVGLTEKEAKEKGISYETATFPWAASGRAIASDCADGMTKLIFDKESNRIIGGAIVGTNGGELLGEIGLAIEMGCDAEDIALTIHAHPTLHESVGLAAEVFEGSITDLPNAKAKKKK

SEQ ID NO: 22364 - protein, 307 aa, Photorhabdus luminescens subsp. laumondii TTO1
MTISTLGNQQDDSLVSNAFGFLRFPLNFQPYSSDAEWVITGVPFDMATSGRAGSRHGPAAIRQVSTNLAWESRRWPWDFKLHNCLKVVDCGDVVFNFGDAQDMSDKLQAHAEKVLASGKRMLSFGGDHFITLPLLRAHAKHFGKMALVHFDAHADTYPNGSQFDHGTMFYHAPNEGLIDPHHSVQIGIRTEHGRDNGFTVLDADQVNDRSVDDLLAQIKETVGDMPVYLTFDIDCLDPAFAPGTGTPVIGGLTTDRALKLLRGLQPLNIVGMDVVEVAPAYDQSEITALAGATIALEMLYLQASKKR

SEQ ID NO: 22365 - protein, 494 aa, Photorhabdus luminescens subsp. laumondii TTO1
MKRLHDIEKEMLPVESYKMLIGGQWVDSVSKATTKSYNPATGELLAEYASGNAEDVDLAVSAAKKAFHAWSQTSAIERQSALLKIADLLEAEQKRFAILESLDTGKPLNESLYMDLPASIDQFRYFAGVIRSHTDEASVLDTNTLSLVIREPIGVVGQVIPWNFPLLMAAWKLAPALAAGNTIVINPATLTSITLLELGRILDKVLPAGVVNIVTGRGSVVGQAILDHEDVEKVAFTGSTKVGYTVAEAAAKKLIPATLELGGKSANIIFPDANMKKAVKYAAKAILLNQGQACESGSRLFLHKDIHDEFLKSLKTEFESIQVGDPLEKETQMGSQVSQEQMEKILEYVEIAKKEGATIFTGGKRITEKGYDEGFFIQPTIITDVTNDMRVAREEIFGPVLAVIPFSEEEDVIRMANDSDYGLAGAVWTQDIDRALRVAKAVRTGRMWINTYHELPAHAPFGGYKKSGIGRETHKMMLDAYTQVKNIYIKTSEE

SEQ ID NO: 22366 - protein, 219 aa, Photorhabdus luminescens subsp. laumondii TTO1
MKNKLISTQQAMEHFYDGMTIMAGGFIGVGTPPHLVTALLNSGVKNLTLIVNDTGRIDTGIGPLVVNNRVKKVITSHIGTNPETGRKMLAGEIEVELVPLGTLIERIRCGGAGLGGFLTPTGVGTIVENGKQKITLNGTDYLLELPLRADLALIQAHLADYHGNLTYQLSARNFNPVIALAADITLAEPDRLVEVGEITPDCVITPGALIDYIVYPGEN

SEQ ID NO: 22367 - protein, 214 aa, Photorhabdus luminescens subsp. laumondii TTO1
MRIILLGAPGAGKGTQAQFIVEKYGIPQISTGDMLRSAVKAGTELGLKAKALMDHGKLVTDELVIALVKERIKQDDCRNGFLLDGFPRTIPQADAMKEAGINVDYVLEFDVPDELIIERIIGRRIHAPSGRVYHIKFNPPVVENKDDVTGEELTVRKDDHEDIVRKRLVEYHQQTAPLVSYYQKEAEADYTKYFGIDGTRKVSEISEELSKILD

SEQ ID NO: 22368 - protein, 472 aa, Photorhabdus luminescens subsp. laumondii TTO1
MSQNVYQFIDLQRVDPPKKPLKIRKIEFVEIYEPFSTSQAQTQADRCLSCGNPYCEWKCPVHNYIPNWLKLANEGRIMEAADLSHQTNSLPEVCGRVCPQDRLCEGACTLNDEFGAVTIGNIERYINDKAIAMGWKPDMSHVQPTGKQVAIIGAGPAGLACADVLTRNGVQAVVFDRHPEIGGLLTFGIPAFKLEKEVMIRRREIFSEMGIEFRLNTEIGKDIALSELTEQFDAIFLGVGTYQSIRGGLANEDADGVYDALPFLTANTRHLMGYPALPSQPFINMQGKRVVVLGGGDTAMDCVRTAIRQKAASVTCAYRRDETNMPGSQREVKNSKEEGVEFLFNLQPVRIEINHSGQVCGINMVRTQLGQPDENGRRQAEIIAGSEHLLKADAVIMAFGFKPHTMNWLSAHQVTLDKQGRIVAPEYSDIPFQTSNPQIFAGGDAVRGSDLVVTAIAEGRKAAQGILDYLNI

SEQ ID NO: 22369 - protein, 267 aa, Photorhabdus luminescens subsp. laumondii TTO1
MNQQTANLIEVRGMYFSRGNRLIFADINLIVPRGKVTAIMGPSGIGKTTLLRLIGGQLRPERGEIWFDGDNIPALSRSHLYAARKKMSMLFQSGALFTDLSVFENVAFPLREHTNLPEEIIQTTVMMKLEAVGLRGAANLMPSELSGGMARRAALARAIALDPELIMFDEPFVGQDPITMGVLVKLIDELNKALGVTCVVVSHDVPEVLSIADYAYIIAEQQVIAEGTAQQLHSNPDRRVRQFLDGIADGPVPFRFPAGDYKTELLG

SEQ ID NO: 22370 - protein, 450 aa, Photorhabdus luminescens subsp. laumondii TTO1
MLSIFKPAPHRSRLSTEQVDPVYRRLRWQIFMGIFFGYAAYYLVRKNFALAMPYLVEQGFSKGELGFALSGISIAYGFSKFIMGSVSDRSNPRVFLPAGLILAALVMLFMGFVPWATSSITIMFVLLFLCGWFQGMGWPPCGRTMVHWWSQKERGGIVSIWNCSHNVGGGLPPLLFLLGMAWFNDWKAALYMPAFAAILVALIVFALIRDTPQSCGLPPIEEYKNDYPSDYTEKDENELTAKQIFMQYVLPNKLLWMVAMANVFIYLLRYGILDWSPTYLREAKHFALDKSSWAYFLYEYAGIPGTLLCGWMSDKIFKGNRGATGVFFMTLVTIATIVFWLNPPGNPTVDMACMLIIGFLIYGPVMLTGLHALELAPKKAAGTAAGFTGLFGYLGGSVAASAIIGYTVDFFGWDSGFMVMIGGSILSVILLLIVMITEKKHKQEIAHQYG

SEQ ID NO: 22371 - protein, 455 aa, Photorhabdus luminescens subsp. laumondii TTO1
MNKVNIHTTIPGPFSKIALAKQLEQESSAVSYPKRIQISLEKGNGCYVQDIDGNVFIDFLSGAGSLPLGHSHPELIAEVNAQVSKLCLGLDFPTPAKELFTEAHLSMLPESLRNKYKIHFCGPTGADAIEAAIKLAKIATGADEIISFRGGYHGCTHAAIAVTGNRSMKKNILGKMPGVHFFPYGSESQSSESWVLNSDHLDAGLYLESALNDANSGLGNIAAIILELIQGEGGVYSAQKSFVDSIIRVSKTYSIPVIIDEIQTGCGRTGTWYAFEQYAIEPDIFVTSKGTSGIGLPSSLMFYKKDFNNWTSGIHIGTFRGNQLAFASGTKAIEIIKRDNLLENVKQRSIQIKKHLAALKNNFNIIGEIRGKGLMLGVEILNASTGKACEITAKHIQKIALNKGLITELGGRNDTVLRILPPLNVSSDTIEEAIEILRNTFRAYMNEFQLLEEGV

SEQ ID NO: 22372 - protein, 497 aa, Photorhabdus luminescens subsp. laumondii TTO1
MSDINLLQPVMAFLQHNHGHYINGQPVSGQGSETFSVINPATDEIIATVNQGGKAEVNAAMQAAQAAFHGVWAQTSPMERGHCLNRLADLLLAHREELAQLETLCSGKTIQLSRMLEIDSSAQFLRYFAGWSSKISGETLNVSLPSFKGEQYTAFTRREPIGVVVGIIPWNFSIMIAIWKMAAALTCGCTIVLKPSEYTPLTMLRVAELAKQAGIPDGVINVINGSGSVLGPALIGHPLCAKVTFTGSVPTGIAVGKSAMEQGLTRATLELGGKNGAAFLADMSVEKIVDGILEAGYLNQGQICAAAERFYIPASHMDDVLKLLSERLAAMKIGSPLDDSTEMGPLANKAHYDKILSLFEQARQEGSEIVYGGHALAGPGFFVAPTVIRANSPEDSLMKEETFGPVGTFLSYNDEEELIGLMNSTPFGLAASLWTNDLSKAMRMIPRIEAGTVWVNMHTFLDPALPFGGTKSSGIGREFGSAFIEHYTELKSVMVRY

SEQ ID NO: 22373 - protein, 369 aa, Photorhabdus luminescens subsp. laumondii TTO1
MKSRAAVAFGPGRPLEVVEIDVAPPQAGEVLVKISHTGVCHTDAFTLSGDDPEGVFPVILGHEGAGVVVEVGEGVTSVKPGDHVIPLYTAECGECLFCKSGKTNLCVAVRTTQGKGVMPDGTTRFSYKGQPIYHYMGCSTFSEYTVVAEVSLAKINPEANHEEVCLLGCGVTTGIGAVHNTAKVQSGDSVAVFGLGGIGLAVIQGARQAKAGKIIAIDTNPAKFELARQFGATDCLNPNDYDKPIQQVIIEMTEWGVDHTFECIGNVNVMRAALESAHRGWGQSVIIGVAGAGQEISTRPFQLVTGRSWRGTAFGGVKGRSQLPKMVEEAMKGEIELKPFVTHTLPLERINEAFDLMHEGKSIRTVIHY

SEQ ID NO: 22374 - protein, 456 aa, Photorhabdus luminescens subsp. laumondii TTO1
MNIMQGNDMFGIQAPVKCKLDKYFKLTERGTTVRREILAGITTFLAMVYSVIVVPGMLGQAGFPHTAVFIATCLVAGFGSLLMGLWVNLPMAIGCAISLTAFTAFSLVLGQQITIPVALGAVFLMGCLFTVISVTGIRSWILRNIPMGIAHGAGIGIGLFLLLIASNGVGLVIKNPLEGLPVALGSFTSFPVMMTLLGLAVIFGLEKLKVPGGVLLVIVVISVIGLIFDPAVKYQGFFKIPSLGDDGLSLIFSMDIMGALQPIVLPSVLALVMTAVFDATGTIRAVAGQGNLLDKGGQIINGGKALTADSVSSIFAGAIGASPAAVYIESAAGTAAGGKTGLTATVVGILFLLILFFSPLSYLVPAYATAPALMYVGLLMLSNVRKLDFDDFVGAMSGMLCAVFIVLTCNIVTGIMLGFSSLVVGRICSGEWRKLNIGTVVITIALVAFYAGDWAI

SEQ ID NO: 22375 - protein, 212 aa, Photorhabdus luminescens subsp. laumondii TTO1
MITGIFMAKLSFDSIEAQASYGVGLQVGQQLLESGLQGLEPEALLAGLCDALENHSPAVPVDILHRALREMHERADGVRRERQQVMAEEGQKFLAENAQRDGISTTESGLQFSVLKQGDGAIPAHTDHVRVHYTGRLIDGTVFDSSVQRGEPAEFPVNGVIAGWIEALTLMPVGSKWELYIPYNLAYGERGAGASIPPYSTLIFEVELLDIL

SEQ ID NO: 22376 - protein, 342 aa, Photorhabdus luminescens subsp. laumondii TTO1
MNLSKNILQTIGNTPVVMLNGRYTKGINVFLKMENINPGGSIKDRIAVAMLERAEAQGELRPGMVVIEPSSGNTAIGLAMACAVKGYRFIAVLDRMVPAAKRDKIKAFGAEIIFLPEFEAGKDTVKYRIDLTKEIIKVYPNAFSPMQFENQVNPDEHYRSTGRELYEIFGNNLTACFATAGSCGTLTGISRYLKEKDPQVRIYGVEPVGSIIFGGEPGKYLVQGAGLAFIPSILDRTNIDITLKVADIDAFRVARKLARNEGILIGGTGGCAVSAALNRLDDFKPGDNIVVIIPDSGERYIDTIYNDAWLFENNFSELIEESKTEPQLEEIITNMGCVLNEF

SEQ ID NO: 22377 - protein, 463 aa, Photorhabdus luminescens subsp. laumondii TTO1
MDREFMADQQHSLQRGLEARHIELIALGGTIGVGLFMGSASTLKWAGPSVLLAYIIAGIFVFFIMRSMGEMLFLEPVTGSFASFGHKYLSPYWGCLTAWGYWFMWVAVGISEITAIGVYAEFWFPELPQWVSALIAVALVALANLAAVRLYGELEFWFAMIKVTTIIVMILIGLGLIFFGIGNQWQPIGLDNLTVHGGFFAGDWQGFLFALCIVVASYQGVELVGITAGEAKNPQVTLKKAINNILWRILIFYVGAIFIVVTLFPWTEVGAQGSPFVMTFTKVGITSAAAVINFVVLTAALSGCNSGMYSGGRMLYALAQNRQLPSSLTKLSKNGVPVIGIAITILCLIVGSSLNYLIPNPQAVFVYVYSASVLPGMVPWFVILMSQLRFRQYHQQALKQHSFKSILFPYVNYLTLAFLCCVLVGMAINPDTRFSLLVGGGFLLIVSLIYWLVKLFNGKKPKA

SEQ ID NO: 22378 - protein, 465 aa, Photorhabdus luminescens subsp. laumondii TTO1
MQHIHFDAIVIGSGPGGEGAAMGLVKQGKSVAVIERYNNVGGGCTHWGTIPSKALRHAVSRIIEFNQNPLYSDNSRVLRSSFAEILRRAEMVINQQTRMRQGFYERNGCRMFSGEATFIDDHRVSVRYADDNHDILSADKIIIATGSRPYCPPDVDFTHSRIYNSDSILKLDHEPRHVIIYGAGVIGCEYASIFRGLGVKVDLINTRNHLLAFLDQEMSDALSYHFWNSGIVIRHNEEYSKIEGVDDGVIVHLKSGKKVKADCLLYANGRTGNTDTLGLKNVGLEADSRGLLKVNKIYQTSNENIYAVGDVIGYPSLASAAYDQGRIAAQAMTKGNAEVHLIEDIPTGIYTIPEISSVGKTEQQLTAMKVPYEVGRAQFKHLARAQIAGMNVGSLKILFHRETKEILGIHCFGERAAEIIHIGQAIMEQKGESNTIEYFVNTTFNYPTMAEAYRVAALNGLNRLF

SEQ ID NO: 22379 - protein, 169 aa, Photorhabdus luminescens subsp. laumondii TTO1
MKYDTSELCDIYQEEVNVVEPMFSNFGGRTSFGGQIITVKCFEDNGLLYDLLEDNGHGRILLVDGGGSVRQALINAELAQLAVQNGWEGIVVYGAVRQVDQLAEFDLGIQAIAAIPAGCRDEGTGASDIRVNFGGVTFFSGDYLYADNTGIILSEEPLELDDNEEDEII

SEQ ID NO: 22380 - protein, 276 aa, Photorhabdus luminescens subsp. laumondii TTO1
MSQTTSTTLTGQCISEFLGTALLVFLGVGCVAAARIAGAQLGLWEISIIWGMSVALAVYLTAGVSGAHLNPAVTIALWLFARFDGKKVIPFIIAQMIGGFIAAALIYMMYYSVFLDYEQVHNIVRGTPESLFTAGVFSTYPMASLSISQAFMIEVIIAAILLCLILSLTDDGNGIPRGPLAPLLIGIVIAVIGGAFGPLTGFALNPARDFGPKLIAYLAGWGDIALTGGREIPYCLVTLTAPIIGGIVGAFGYRKLIGRNLPSDVHKTEDQKKKKA

SEQ ID NO: 22381 - protein, 255 aa, Photorhabdus luminescens subsp. laumondii TTO1
MRHPLVMGNWKLNGSTHMVNELITGLRQELSSVTGCDVAIAPPALYLSQAKQALAGSRIALGAQDVDVNLSGAFTGETSATMLKDIGAEYIIIGHSERRTYHQESDEFIAKKFAILKQQGLIPVLCIGETEQENEAGQTESVCARQIDAVLNTLGVAAFQGAVIAYEPVWAIGTGKSATPAQAQAVHKFIRDHIAQKDAAIAQQIIIQYGGSVNADNAAELFSQPDIDGALVGGASLKANAFAVIVKAAAAAKKA

SEQ ID NO: 22382 - protein, 432 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWALNYGEIAKIFRAGCIIRAQFLQKIRRSLTCCWLLTSSKLPMTTSRRCAMSSLMRYRTVSRFRPSPLRLPIMTATAPLFCLRT

SEQ ID NO: 22383 - protein, 177 aa, Arabidopsis thaliana
MGVFSNLRGPKIGLTHEELPVVANGSTSSSSSPSSFKRKVSTFLPICVALVVIIEIGFLCRLDNASLVDTLTHFFTKSSSDLKVGSGIEKCQEWLERVDSVTYSRDFTKDPIFISGSNKDFKSCSVDCVMGFTSDKKPDAAFGLSHQPGTLSIIRSMESAQYYQENNLAQARRWERL

SEQ ID NO: 22384 - protein, 506 aa, Medicago sativa
MGLVSRTTTTTTQEGLPVSVSVSTTVPKKKWSNLMPLFVALVVIAEIAFLGRLDMAKNAAMVADLFYRSRAVVEGDDFGLETVGGDKNLELERETCEEWLEREDAVTYSRNFNKEPVFVSGAEQEWKSCSVGCKFGFNGDRKPEAAFGLPQQAGTASVLRSMESAQYYAENNLAMARRRGYHIVMTTSLSSDVPVGYFSWAEYDIMAPIKPKTEKALAAAFISNCGARNFRLQALEALEKTNISIDSYGSCHRNRDGRVDKLETLTRYKFSLAFENSNEEDYVTEKFFQSLVAGTIPVVVGPPNIQDFAPSPDSFLYIKELEDVESVAKSMRYLAENPEAYNHSLRWKYEGPSDSFKALVDMAAVHSSCRLCIHLATKSREKEEKSPDFKKRPCKCTRGSETVYHIYVRERGTFEMESIYLRSSNLTLESFKTAVLTKFTSLNHVPVWKPERPEILKGGDKLKVYKIIPAGLTQRQALYTFQFNGDVDFRSHLESNPCAKFEVIFV

SEQ ID NO: 22385 - protein, 505 aa, Medicago sativa
MGLVSRTTTTTQEGLPVSVSVSTTVPKKKWSNLMPLFVALVVIAEIAFLGRLDMAKNAAMVADLFYRSRAVVEGDDFGLETVGGGKNLELEGETCEEWLEREDAVTYSRNFNKEPVFVSGAEQEWKSCSVGCKFGFNGDRKPEAAFGLPQQAGTASVLRSMESAQYYAENNLAMARRRGYHIVMTTSLSSDVPVGYFSWAEYDIMAPIKPKTEKALAAAFISNCGARNFRLQALEALEKTNISIDSYGSCHRNRDGRVDKLETLTRYKFSLAFENSNEEDYVTEKFFQSLVAGTIPVVVGPPNIQDFAPSPDSFLYIKELEDVESVAKSMRYLAENPEAYNHSLRWKYEGPSDSFKALVDMAAVHSSCRLCIHLATKSREKEEKSPDFKKRPCKCTRGSETVYHIYVRERGTFEMESIYLRSSNLTLESFKTAVLTKFTSLNHVPVWKPERPQILKGGDKLKVYKIIPAGLTQRQALYTFQFNGDVDFRSHLESNPCAKFEVIFV

SEQ ID NO: 22386 - protein, 468 aa, Cliftonia monophylla
KASVGFKAGVKDYKLTYYTPEYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYAKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDYIEKDRARGIYFSQDWVSLPGVLPVASGGIHVWHMPALTEIFGDDSVLQFGGGTLGHPWGNAPGAVANRVALEACVQARNEGRDLAREGNEIIRKASKWSPELAAACEVWKEIKFEFPAMDTL

SEQ ID NO: 22387 - protein, 416 aa, Arabidopsis thaliana
SGIEKCQEWLERVDSVTYSRDFTKDPIFISGSNKDFKSCSVDCVMGFTSDKKPDAAFGLSHQPGTLSIIRSMESAQYYQENNLAQARRKGYDIVMTTSLSSDVPVGYFSWAEYDIMAPVQPKTEKALAAAFISNCAARNFRLQALEALMKTNVKIDSYGGCHRNRDGSVEKVEALKHYKFSLAFENTNEEDYVTEKFFQSLVAGSVPVVVGAPNIEEFAPSPDSFLHIKQMDDVKAVAKKMKYLADNPDAYNQTLRWKHEGPSDSFKALIDMAAVHSSCRLCIFVATRIHEQEEKSPEFKRQPCKCTRGSETVYHLYVRERGRFDMESIFLKDGNLTLEALESAVLAKFMSLRYEPIWKKERPASLRGDGKLRVHGIYPIGLTQRQALYNFKFEGNSSLSTHIQRNPCPKFEVVFV

SEQ ID NO: 22388 - protein, 406 aa, Phaeosphaeria nodorum
MPSFTYLTAALALTSSVVASPVEKRDAFEVKQVAHGLHRKNGPAQIAKTLRKYGKAVPAHIQAAADNNAVVQADANTGSDPAVPSDQYDSSYLSPVTVGTSTVHLDFDTGSADLWVFSDLQAKSSLSGHDYYKTDASKRKSGYTWKISYGDGSGASGQVYTDKVTVGQVTATAQAVEAATSVSAQFSQDVDTDGLLGLAMSSINTVKPQQQTTWFDTVKSQLAKPLFAVTLKYHAAGTYDFGYIDSAKYTGAITYVNADASQGFWGFTASGYSVGTGATVSSSISGILDTGTTLMYVPAATAKAYYAKVSGAKLDSTQGGYVFPCSATLPNFSITVAGVKQTVPGKYINYAPITDGSSTCFGGMQPDTDIGQSIFGDIFLKSKYIVHDMSNGTPRLGFAQQAGVSS

SEQ ID NO: 22389 - protein, 3980 aa, Bacillus subtilis
MYTSQFQTLVDVIRERSNISDRGIRFIESDKNETVVSYRQLFAEAQGYLGYLQHLGIKPKQEIVFQIQENKSFVVAFWACILGGMIPVPVSIGEDDDHKLKVWRIWNILNHPFLIASEKVLDKIKKYAAEHDLQDFHHQLNEKSDIIQDQTYDYPASFYKPDADELAFIQFSSGSTGDPKGVMLTHHNLIHNTCAIGNALAVHSKDSFLSWMPLTHDMGLIACHLVPFITGINQNLMPTELFIRRPILWMKKAHEHKASILSSPNFGYNYFLKFLKNEPDWDLSHIKVIANGAEPILPELCDEFLKRCAPFNLKRSAILNVYGLAEASVGAAFSKLGEEFVPVYLHRDHLNLGERAVKVSKEDQNCASFVEVGQPIDYCQLRISDETNERVEDGIIGHIHIKGDNVTQGYYNNPESTEKALTSDGWVKTGDLGFISESGNLVVTGREKDIIFVNGKNIYPHDIERVAIEMEEVDLGRVAACGVYDQKTQSGEIVLFVVYKKSPEKFAPLVKEIKKHLYKRGGWSIKEVLPIRKLPKTTSGKVKRYELARQYEAGNFSTESAAINECLESSPETSGQTPIHEIETELLSIFSEVLDGKKVHLADSYFDMGANSLQLSQIAERIEQKFGRELAVSDLFTYPSITDLAAYLSESRAEIKQDAAAKPSHVTPKDIAIIGMSLNVPGASTKSDFWNLLEKGEHSIREYPESRLKDAADYLKSIQSEFNESQFVKGGYLDEIDRFDYSFFGLAPKAAQFMDPNQRLFLQSAWHAIEDAGYAGGSMNGSRVGVYAGYSKVGYDYERLLSANYPEELHQYIVGNLPSVLASRIAYFLNLKGPAVTVDTACSSSLAAVHMACKSLMSGDCEMALAGGIRTSLLPICIGLDMESSDGYTKTFSKDSDGTGTGEGAAAVLLKPLQDAVRDGDHIYGVIKGSALNQDGTTAGITAPNPAAQTEVIETAWKDAGIAPETLSFIEAHGTGTKLGDPVEFNGLCKAFEKYTAKKQFCAIGSVKSNIGHLFEAAGIVGLIKSVLMLNHKKNPPLAHFNEPNPLIHFHSSPFYVNQEVSEFTSGDEPLRGGVSSFGFSGTNAHVVLEEYISQSEYAPEDEHEPHLFVLSAHTEKSLYELAQQYRQYVSDDSQASLKSICYTASTGRAHLDHGIAMIVSGKQELSDKLTRLIQGDRNLPGVYIGYKNMKEMLPAHKEELNQQAAALIKQRLRTQDERITWLNRAAELFVQGAVIDWRALYSGETVQKTPLPLYPFERSRCWAEADQLRLNEGEKRGEAALNINQSKAHIESFLKTVISNASGIRGEELDLNAHFIGLGMDSIMLSQVKKAIADEFGVDIPMDRFFDTLTNLQSVIDYLADTVPSSFASAPPQENVPAQEKQVISEAQLESDRRDGHQEHTLEKIIASQNQLIQDALQAQLNSFNLLRNSGHHSDEKEYAKAQEKSIPSVKQGPPTVNAEQKAAQEAKPYVPFQPQNLNDQGHYTARQKQYLEDFIKKYAGKTKGSKQYTDNTRFAHANNRNLSSFRSYWKEIVYPIIAERSDGSKMWDIDGNEYIDITMGFGVNLFGHHPSFITQVIDDSTRSSLPPLGPMSDVAGEVADRIRTCTGVERVAFYNSGTEAVMVALRLARAATGRKKVVAFSGSYHGTFDGVLGVAGTKGGAASANPLAPGILQSFMDDLIILHYNNPDSLDVIRSLGDELAAVLVEPVQSRRPDLQPQAFLKELRAITQQSGTALIMDEIITGFRIGLGGAQEWFGIQADLVTYGKIIGGGQPLGVVAGKAEFMNAIDGGTWQYGDDSYPQDEAKRTFVAGTFNTHPLTMRMSLAVLRHLQTEGEHLYEQLNQKTAYLVDELNHCFEQAQVPIRMVRFGSLFRFVSSLDNDLFFYHLNYKGVYVWEGRNCFLSVAHTADDIENIIQAVKDTVEDLRRGGFIPEGPDSPDGGGRKKSGTRELSPEQKQLVMASHYGNEASAALNQSIMLKVKGELQYTSLKQAVRHIVDRHEALRTVIHPDDEVQQVQERMNIEIPVIDFTGLPHEHREPEIQKWLTEDAKRPFHFHEQKPLFRIHVLTSAHNEHLIVLTFHHIIADGWSIAVFVQELESNYAAIVQGKSISPKEADVSFRQYLDWQQAQIDSGQYEEGVRYWRRHFSEPIQQPILPSADSVRYPNGYEGDRCTVRLGRPLSEALRSLSIQMKNSVFVTMLGAFHLFLHRLTKQSGLVIGIPAAGQSHMKQHDLIGNCVNMIPVKNTSSSESTLSGYLGSMKESVNLAMRHQAVPMTLVARELPHDQVPDMRIIFNLDRPFRKLHFGKAEAEPVAYPVKCTLYDLFLNITDAHQEYVLDFDFNTNVISPEIMKKWGAGFTKLLQKMVEGDSIPLDAMMMFSDEEQQDLQALYGEHQKRVSSIASNTANFTEAYEAPVNETERQLARIWEELFGLERVGRSDRFLALGGNSLQATLMLSKVQKTFHQKVSIGQFFNHQTVKELARFIQNETKVVHLPMKTAEKKAYYPTSPAQQRVYFLHQLEPDQLAQNMFGHISITGKYDEQALISSLQQVMQRHEAFRTYFDIIDGDIVQKLENEVDFNVHVRTMSRDEFDAYSDRFVKPFRLDQAPLVRAELIKIENEQAELLMHHIISDGYSVNILTNELLALYHQKPLPDIEFEYKDFAEWQNQRLNDDAMKRQATYWLEQFQDEIPILDLPTDGSKAAERSSEGQRVTCSLQPDVIRSLQDLAQKAETTLYTVLLAAYNVLLHKYTGQEDIVVGTPASGRNHPDIERIIGIFIQTIGIRTKPHANRTFTDYLEEVKRQTLDAFENQDYPFDRLVEKLNVQRETTGKSLFNTMFVFQNIEFHEIRHNECTFKVKERNPGVSLYDLMLTIEDAGQQIEMHFDYKPGRFTKDTIEQITRHYTAILNSLAEQPEMTLSSVPMLSETERHQLLTECNGTKTPYPHKETVYRWFEMQAEQSPDHEAVIFGNERYTYRQLNERANRLARTLRTKGVQADQFIAIISPHRIELIVGILAVLKAGGAYVPIDPEYPEDRIQYMLRDSRAEVVLTQRSLLDQLPYDGDIVLLDEENSYHEDHSNLESDSDAHDLAYMIYTSGSTGNPKGVLIEHQGLANYIWWAKEVYVRGEKTNFPLYSSISFDLTVTSIFTPLVTGNTIIVFDGEDKSAVLSEIMRDSRIDMIKLTPAHLHVIKEMNIAGGTAIRKMIVGGENLSTRLAKSVSEQFKGRLDIFNEYGPTEAVVGCMIYHFDAERDKREFVPIGTPAANTDIYVADASRNLVPFGVIGEIYISGPGVARGYWNRPDLTAEKFVENPYVPGAKMYKSGDLAKRLKDGNLLYIGRVDEQVKIRGHRIELGEIEAAMHNAEAVQKAAVTVKEEEDGLKQLCAYYVSDKPIAAAQLREQLSSGLPDYMVPTYFVHLEHMPLTSNGKINRKALPAPEASLQQTAEYVPPGNETESKLTDLWKEVLGISHAGIKHNFFDLGGNSIRAAALAARIHKELDVNLSLKDIFKFPTIEQLADKALHMDKNRYVPIPAAKEMPYYPVSSAQRRMYLLSHTEGGELTYNMTGAMNVEGTIDPERLNAAFRKLIARHEALRTSFDLYEGEPAQRIHQNVDFTIERIQASEEEAEDRVLDFIKAFDLAKPPLMRAGLIEIEPARHVLVVDMHHIISDGVSVNILMKDLSRIYEGNEPDPLSIQYKDFAVWQQSDIQKRIIKSQEAYWLDQFHGDIPVLDMPADYERPAIRDYEGESFEFLIPEHLKQRLSQMEEDTGATLYMILLAAYTILLSKYSGQEDIIVGTPSAGRTHLDVEPVVGMFVNTLVIRNHPAGRKTFDAYLNEVKENMLNAYKNQDYPLEELIQHLHLPKDSSRNPLFDTMFVLQNPDHAELTFDSLQIKPYPFHHPVAKFDLTLSIQADRDNYHGLFEYTKKLFKKSRIEILSNDYLHILSAILEQPSILIEHIGLSGSNEEEENALDSIQLNF

SEQ ID NO: 22390 - protein, 174 aa, Lotus corniculatus var. japonicus
MSKIMSTDPLVVGRVVGDVLDSFTTSMKLTVSFNNKQVFNGHEFFPSTINTKPKVDIGGGDMRSFFTLIMTDPDVPGPSDPYLKEHLHWMVTDIPGTTDATFGKELVSYEIPKPNIGIHRFVFVLFKQKRRQCVSPPSSRDHFNTRSFAAQNDLALPVAAVYFNAQRETAARRR

SEQ ID NO: 22391 - protein, 296 aa, Candida albicans
DPYEIGLQLMENGAKLSEAALAFEAAIQRDENHVDAWLKLGEVQTQNEKEIAGISALEKCLELHPENSEALMNLAISYINEGYDNAAFATLERWISTKYPQIVEKARQENPTITDEDRFSLNKRVTELFLNAAQLSPNQASMDADVQMGLGVLFYANEEFDKTIDCFKAALSIRPDDAILWNRLGASLANSNRSEEAVDAYFKALQLKPTFVRARYNLGVSCINIGCYKEAAEHLLSGLSMHQVEGVDTVSTLNHNQSTSLTETLKRAFIAMERRDLLELVKPNMDLNQFRGEFSF

SEQ ID NO: 22392 - protein, 144 aa, Hordeum vulgare subsp. vulgare
MPTAGLAAGSNKVDVAIDLGNPLLNRTVDGFLKIGAVGACRVVAEDAFDCLHRGDISKRQLEETLKKMCKEGAYWGAVAGVYVGMEYGVERVRGDRDWKNALIGGIATGALVSAASNNKGNKIAQDAITGGAIATAVEFINYLT

SEQ ID NO: 22393 - protein, 320 aa, Saccharopolyspora erythraea
MKAVAIRTFGPPEGLAVIDLPAPTPAAGQVLIETEAIGVGGVDALIRSGALASYGFEEGHILGSEVAGTVTAVGDGVAASWVGRRVWAFTGVGGGYVESAIAPVEEVVPLPANISPADAVTLGNSGVVAHFGLAHAHFVPGESVLVRGAAGSIGITTVQLAARGGADAVAVTTSSAERGDRLRELGATHVLDRSGDGGEDAPAGYDVVIDIIAGADMPAFFDKLNPNGRMVAVGIVGGPPPAGFGMRMFEAFRKSMSFATFSADTVPEPGRRAVRTEQFAAAGRGELHTVVHELLPLEQAVLAHQKMDTGEVFGRIVLTP

SEQ ID NO: 22394 - protein, 501 aa, Staphylococcus sp. 1863A
VESALEKIGAKNIESSYRRGEAVFELPDDIEVESAIKAIDEANYQAGEIEEVSSLENVALINEDNYDLLIIGSGAAAFSSAIKAIEYGAKVGMIERGTVGGTCVNIGCVPSKTLLRAGEINHLSKDNPFIGLQTSAGEVDLASLITQKDKLVSELRNQKYMDLIDEYNFDLIKGEAKFVDASTVEVNGTKLSAKRFLIATGASPSLPQISGLEKMDYLTSTTLLELKKIPKRLTVIGSGYIGMELGQLFHHLGSEITLMQRSERLLKEYDPEISESVEKALIEQGINLVKGATFERVEQSGEIKRVYVTVNGSREVIESDQLLVATGRKPNTDSLNLSAAGVETGKNNEILINDFGQTSNEKIYAAGDVTLGPQFVYVAAYEGGIITDNAIGGLNKKIDLSVVPAVTFTNPTVATVGLTEEQAKEKGYDVKTSVLPLDAVPRAIVNRETTGVFKLVADAETLKVLGVHIVSENAGDVIYAASLAVKFGLTIEDLTETLAPY

SEQ ID NO: 22395 - protein, 119 aa, Schedonorus arundinaceus
GGVGHMGVKVAKSMGHHVTVISSSNKKRAEAMDDLGADAYLVSSDEAQMAAAMDSLDYIIDTVPVKHPLEPYLALLKMDGKLVLMGVIAEPLSFVSPMVMLGRKTITGSFIGSIEETQE

SEQ ID NO: 22396 - protein, 223 aa, Enterobacter cloacae
  misc_feature (25)..(25): Xaa can be any naturally occurring amino acid
IWYNNFFGAETEAILPYDQYMHRFXAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQGAILNIFTFDQWGVELGKQLANRILPELGDDNAINSHDSSTNGLINRY

SEQ ID NO: 22397 - protein, 223 aa, Enterobacter cloacae
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQGAILNIFTFDQWGVELGKQLANRILPELGDDNAINSHDSSTNGLINRY

SEQ ID NO: 22398 - protein, 223 aa, Escherichia coli
IWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDGKEISSHDSSTNGLINRY

SEQ ID NO: 22399 - protein, 183 aa, Escherichia coli
DRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDGKEISSHDSSTNGLINRY

SEQ ID NO: 22400 - protein, 223 aa, Escherichia coli
IWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRDQGKDPATLDYVVPFKVFEGNRPTNSILLREITPFSLGALIALYEHKIFTQGVILNIFTFDQWGVELGKQLANRILPELKDDKEISSHDSSTNGLINRY

SEQ ID NO: 22401 - protein, 223 aa, Klebsiella oxytoca
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGVIMNIFTFDQWGVELGKQLANRILPELKDGSEVSSHDSSTNGLINRY

SEQ ID NO: 22402 - protein, 198 aa, Klebsiella oxytoca
AYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGVIMNIFTFDQWGVELGKQLANRILPELKGGSEVSSHDSSTNGLINRY

SEQ ID NO: 22403 - protein, 223 aa, Klebsiella pneumoniae
IWYNNFFGAETEAILPYDQYMHRFAAYFQQGNMESNGKYVDRNGHAVDYQTGPIIWGEPGTNGQHAFYQLIHQGTKMVPCDFIAPAITHNPLSDHHQKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELKDGSEVSSHDSSTNGLINRY

SEQ ID NO: 22404 - protein, 223 aa, Klebsiella pneumoniae
IWYNNFFGAETEAILPYDQYMHRFAAYFQQGNMESNGKYVDRNGHAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELKDGSEVSSHDSSTNGLINRY

SEQ ID NO: 22405 - protein, 223 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLDHVVPFKVFEGNRPTNSILLREITPFSLGALIALYEHKIFTQGAILNIFTFDQWGVELGKQLANRILPELNDDKEITSHDCSTNGLINRY

SEQ ID NO: 22406 - protein, 223 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGAILNIFTFDQWGVELGKQLANRILPELNDDKEITSHDCSTNGLINRY

SEQ ID NO: 22407 - protein, 214 aa, Enterobacter cloacae
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQGAILNIFTFDQWGVELGKQLANRILPELGDDNAINSHDS

SEQ ID NO: 22408 - protein, 209 aa, Klebsiella oxytoca
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVEQEYRDQGKDPATLEHVVPFKVFEGNRPTNSILLREITPFSLGALIALYEHKIFTQGVIMNIFTFDQWGVELGKQLANRILPELKDGSEV

SEQ ID NO: 22409 - protein, 175 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSRDVVEQEYRDQGKDPATLDHVVPFKVFEGNRPTNSILLREITPFSLGALIALYEHKIFTQ

SEQ ID NO: 22410 - protein, 120 aa, Citrobacter freundii
IWYNNFFGAETEAILPYDQYMHRFAAYFQQGNMESNGKYVDRNGNAVDYQTGPIIWGEPGTNGQHAFYQLIHQGTKMVPCDFIAPAITHNPLSDHHPKLLSNFFAQTEALAFGKSREVVE

SEQ ID NO: 22411 - protein, 135 aa, Hafnia alvei
DRNGNPVTYQTGPIIWGEPGTNGQHAFYQLIHQGTKLVPCDFIAPAISHNALGDHHSKLLSNFFAQTEALAFGKSREEVEEEFAKAGKTAAEVAHIVPFKVFEGNRPTNSILLREITPYSLGLLIALYEHKIFTQ

SEQ ID NO: 22412 - protein, 101 aa, Serratia plymuthica
DRNGNPVDYQTGPIIWGEPGTNGQHAFYQLIHQGTKLVPCDFIAPAISHNPLGDHHAKLLSNFFAQTEALAFGKSLETVEAEFAAQGKTPEQVKHVAPFKV

SEQ ID NO: 22413 - protein, 354 aa, Vitis aestivalis
MRRGPLNPSNLKLTLPPDEDSLTKFLTQSGTFMDGDLLVNRDGVRIVSKSEAEVPPLIKPSDNQLSLADIDTIKVIGKGAGGTVQLVQHKWTGQFFALKVIQMNIQEAALKHIAQELKINQSSQCPYVVVCYKSFYDNGAFSIILEYMDGGSLLDFLKKVKSIPEPYLAAICNQVLKGLSYLHHERHIIHRDLKPSNLLINHRGEVKITDFGVSAILTSTSGQANTFVGTYNYMSPERISGGKYGSKSDIWSLGLVLLECATGQFPYSPPEQGEGWTSFYELMEAIVDQPPPCASTNQFSAEFCSFISACIQKDPNDRKSAHELMAHPFISMYRDLNVDLATYFTNAGSPLATF

SEQ ID NO: 22414 - protein, 376 aa, Vitis aestivalis
MGCFPCAGKSNKKGKKNQEKNSKDQIPSTSERLKVNSSVDGRKDASKDGGSDHIAAHTFTFRELAAATKNFRAECLLGEGGFGRVYKGRLESTNKIVAIKQLDRNGLQGNREFLVEVLMLSLLHHPNLVNLIGYCADGDQRLLVYEYMALGSLEDHLHDLPPDKKRLDWNTRMKIAAGAAKGLEYLHDKASPPVIYRDLKCSNILLGEGYHPKLSDFGLAKLGPVGDKTHVSTRVMGTYGYCAPEYAMTGQLTLKSDVYSFGVVLLEIITGRKAIDNSKAAGEHNLVAWARPLFKDRRKFSQMADPMLHGQYPLRGLYQALAVAAMCVQEQPNMRPLIADVVTALTYLASQKYDPETQPVQSSRMGSSTPRSRREL

SEQ ID NO: 22415 - protein, 118 aa, Lolium multiflorum
GVGHMGVKVAKSMGHHVTVISSSNKKRAEAMDDLGADAYLISSDEAQMAAAADSLDYIIDTVPVKHPLEPYLALLKMDGKLVLMGVIAEPLSFVSPMVMLGRKTITGSFIGSIEETEE

SEQ ID NO: 22416 - protein, 448 aa, Vigna radiata
VHHDMNAPMSHYFIYTGHNSYLTGNQLSSDCSDVPIIKALQRGVRVIELDLWPNSDKDDIDVVHGRTLTTPVSLLQCLKSIKEYAFVKSQYPLVITLEDHLTPDLQAKVAKMATQVFGELLYYPQTDSLVEFPSPESLKGRILISTKPPKEFLESSEKESADEVSSLRENANEQRTDNESAPEYTRLITIHAGKPKGEIQDELKAAGKVRRLSLSEQALEKASESYGADIVRFTHNNILRVYPKGTRLTSSNYKPHIGWTYGAQMVAFNMQGHGKSLWYMQGMFRSNGGCGYVKKPDFLIQKGPHDEVFDPKIALPVKKTLKVKVYLGKGWSLDFSPSDFDSYSPPDFYVKVCIVGVPADMIKKKTSVISNNWFPVWNEEFDFPLTVPELALLRIEVREEDKHQKDDFGGQTCLPVSELKSGFRSVPLYDEKGDKYKSVKLLMRFQFR

SEQ ID NO: 22417 - protein, 1202 aa, Vibrio vulnificus YJ016
MNKQPLKLSVVAKAIMPLMATSLLIGCNSSNDGETANPQPDTGKVARVYFKASETATRAAADSSAYDQASLYVWNNDTCGGYAETDEGHDDWGTGIKPTGVDDKFGAYWDLQVRSEATQCINFIPRVGNDKPLGDFDAKLDLTQTGKNNAVYTQQGVAAVYPELISTSDIPANTARVYMNTPDGDEGHFTLHVWNNDTCGAFDGNATTWPGMEPTGFSDVYGPYWDLPVKGAEGCINIIPNNKPDGYQTSDLKFEFDKTTAIGNVAFVFKGTNKVYYTALAQKPVAQVELAGASAIFADDSVILVNAKDATSVTLYYSESGELAFDSASKKVTGATKQITSSKAASTDWNKTKPHLSNDFIGFEMDFSGEGNALKDLLKGQLILVASDATGVIKATEVQPASALDALYAAAATKLSYGAVINPDSTTTFRLWAPTAQSVKLIPYNAEKQAQTAIAMTFDATSGAWVAANTALKHGDFYRYEVTVYHPATDKVETYQVTDPYSLSLSMNSEYSQVVDLANAELKPSGWDALAAPHNQANPAEFVLYEAHIRDFSALDDSTAEANRGKYKAFTQAGTAPVEHLKKLAQSGVTHLHLLPTFDIATINEDPTKVANINQPFAKLCELDASVKNDADFGNYCDSNETLSTVFETLAKKDSKESAVVQRLNSHVRNLDSFNWGYDPFHYTVPEGSYSSDAEGMVRIKEFREMVMSVKKEIGMNVVMDVVYNHTNESGVSSKSVLDRIVPWYYQRLNEFSGAVEQSTCCSNTAPENQMFAKLIDDSISTWVKEYKIDAFRWDLMGHHPLAQMQQTLAAAKAVDPNVYFYGEGWNFGEVGSDRMFKQATQLNLAGTGIGSFSDRLRDAVRGGGPFDSQDSLRSNQGFGNGIYVQVNDKNEQNAALKTTALHLADLTRLGMAGNLKAFPFTDSKGKAITGAELDYNGQPAGYAQDAWEIQNYVSKHDNQTLWDNNQYKIAYATTAAERTRMQAVGLSTAMLGQGVPFIHMGSELLRSKSMQRDSYDSGDWYNRVDFTKQDNNWNVGLPREDKDGSNWAIIDAVITGSSDRAMPSATDIDNMDKFFNELAALRASSGLFTLGKGSEIIKRVAFHNTGAEQTPGLIVMSIDNSGDNHDATIDATRDGVVIVVNASPTMVSDFAKFDATGYTLHSVQTNAGNDSLAKNQDKAAQVVNGKLSVPAWSVAVFEKLR

SEQ ID NO: 22418 - protein, 475 aa, Vibrio vulnificus YJ016
MNSLFRQQCYLLGEWRSAPQTMTITNPFNDEVIGTVPNMGEKETQEVIAGADKAFQQFKALTAQERANLLHRWHQLILEHSDELAHIMTLEQGKPLAEAKGEVLYAASFIEWFAEEARRAYGTLVPSHKANAKILVTKEPIGVVAAITPWNFPAAMITRKCGPAFAAGCPVILKPAPDTPFTALALAVLAEKAGFPAGVFNVITGDAVAIGGELTSNKRVRKLSFTGSTPVGKLLMRQSADNIKKLSLELGGNAPFIVFEDADLDAAVEGAMIAKFRNAGQTCVCANRLYVQRSVYTEFCEKLVEKVSALNVGNGFDQGVHLGPLINDAAVAKVVQHVEDAQSKGAHIECGQLPTAGSRLVQPLVLSGVTDEMLVAQEETFGPMAPLFVFDSEEEVLARANNTDFGLAAYFYTQSLSRAWRVSEALEAGIVGVNEGLISTTVAPFGGVKESGLGREGSFLGMDDYMESKYILMGL

SEQ ID NO: 22419 - protein, 449 aa, Vibrio vulnificus YJ016
MNKYQLPQDSQLRQADFLFGVATSSYQIEGGAQLGGRTPSIWDTFCNQPGAVDNMDNGDVACDHFHLWQQDIELIQGLGVDAYRLSMAWPRILPKDGQVNQQGLEFYERIIDECHARGLKVFVTLYHWDLPQYLEDKGGWLNRETAYKFAEYAEVVSGYFGNKIDSYATLNEPFCSAYLGYRWGIHAPGKKGEREGFLSAHHLMLAHGLAMPIMRKNAPQSMHGCVFNATPAYPYSEQDVAAAEYSDAEGFHWFIDPVLKGEYPQSVLEHQAHNMPMILDGDLDIIRGDLDFIGINFYTRCVVRFDANGELESMPQPDAEHTYIGWEIYPQALTDLLLRLKQRYPNLPPVYITENGAAGEDACINGEVNDEQRVRYFQSHLLALDEAIRAGVNVQGYFAWSLMDNFEWAYGYKQRFGIVHVDYATQKRTLKQSAIAYRNTLLARAEEKQ

SEQ ID NO: 22420 - protein, 365 aa, Vibrio vulnificus YJ016
MARVEFRDIKKSYDDVEVVKHFDFTVEDGEFVVFLGPSGCGKSTTLRMLAGLESITSGEIYVGDKLMNKIDAKDRDLAMVFQSYALYPHMTVYENIAFALKLKGMAKAQIDVEVRKAAKMLELEALLDRKPKELSGGQRQRVAMGRAMVRTPKVFLFDEPLSNLDAKLRGTMREEIKQLHRELKTTTIYVTHDQVEAMTLADRIVILKDGYVAQVGTPTEVFKRPANKFVAQFIGNPSMNMLEAKLVGEEGNWHIALGDVTIPLPERFHAHASKNLALHFGIRPTDIHLRAEQVAHDRVLPIEVAIKDKELLGASILLKTEVAGQPLMVETQAAEVDVRQLTLYLDLDAIHLFDALSEKSLASFG

SEQ ID NO: 22421 - protein, 383 aa, Vibrio vulnificus YJ016
MMSDPIIIIGSGFAAYQLVKSVRRLDAHIPIQIFTADDGAEYNKPDLSHVFSKRQTAADLVVKSGEAFATEHNVQLHAHTQVERVLTQQQQVVANGRCYPYSKLVFATGAQAFVPPMRGDGLAKVMTLNSLQEYQAAEQPLSRAQHVLVIGGGLIGVEIALDLATSGKQVTVVEPNARLLANLLPEFIALPLEQQLMKHGIQLALNSRVESVTVQGQTLAIALHDGREFAVDAVLCAAGLKANTAVAREAGLSVERGICVDLQLNTSDPHIYALGDCAQIEGRMLPYLQPIVLSANVLAKQLVGQEARLTLPPMMVKVKTPSYPIQLAGDFSPESHWQVQLSPEGIVAKAQSSLGDFTGFVVTGEYVTQAFPLLRELSQRANG

SEQ ID NO: 22422 - protein, 1399 aa, Vibrio vulnificus YJ016
MIQIVIDGKYRIVEAGQTVLQAAKVCGVEIPSLCGMNRSGEKIPCDLCVVEVESGGTRRACELEVYNGLTVNTQSEALSAHRKQALNRIMSDHYADCEAPCKTACPAGVDIQSYLYHIAQNDHQKAIEVIKRTLPMPLSIGRVCPAFCESECRRSLVDDAIAIRQLKRHAADADLAAQEAYTPEKKADKNKRIAIVGSGPGGLTAGYYLTNEGYQVDVFEAMPQAGGWLRYGIPEYRLPKSILDKEIALMCRNGMAIHTDKKLGRDISLSQLSQDYDAVCLAVGASKAVAMDYPGSDLDGCYLGVDYLKDFVTEQRFTTGKKVAVIGGGNTAIDCARTAVRTGADTTLIYRRTRDEMPAEDYEIEEAEHEGVKFHFLTNPAQNIADEHGRVCSVKLEKMALGAPDASGRRRPEATGEYFTEAFDTVIAAVSQQADLSFMQGEALTLPLTRWNTADANPETMHSGTGNIFSIGDFRRGPATAVEAVADGRIAAQAIDRFFDGDMENIPLKPFNSRKEQKLKQVDPLHFSHLQKVARTIMPELTSQQREQSFEEVELGFDNAEAMAEAARCLECGCQVNTSCDLRDYATEYGAEQHFHYSVNIKSHDEWQALRQNDPRHKYPIDHSSEFIVFDANRCISCGQCIQACREQSVQGVLSFMNLEKGRPVVRPDCRPNFGGQGVRMGDSRCVQCGACVQACPVGAMTDARDRSQGRETPLKKVDTICTYCGVGCKLTMHVDEAANRIRYVEGAHSPVNEGMLCVKGRYGFDFVASEERLTTPLIRKDGWLQPASWQEAIRLVADKFSTIKQDFGGRALAGFSSAKTTNEDNYAFQKFMRRELGTNNVDHCARLCHASTVTGLEASLGSGAMTNDIPSIKHSDVIFIIGSDTSAAHPVIASHIKQAVRHHGARLIVADPKRIGMADHAELYLAHRPGTDVMLINGVMQQIIKNGWYDMEYIEERVDGFDTMLQEVMSPAYALDKVELVTGVKADDIFAMARMIGTAKRTAVYYSMGITQHTTGHDNVRSIANLQLLCGNIGIEGGGINPLRGQSNVQGACDMGALPNNYPGYQKVYNPLVREKFVIEWDAPNLSAEPGLTLTEIIDGACRRDVRALYVMGENPVLSDPNQAHVIEGLEALDFLVVQDIFLTETAQYADVVLPSCSFAEKSGHFTNTERRVQRIYPAVNPPGEAKEDWRIIQEIANAMGSDWHYRSVVDITNEITRVTPQYAGLKWDNITREGVQWPSNKNNPAGTRIMHQTQFTRGKGQMEAIPFRYAAELPDEEYPLVLTTGRVLEQFHTGTMTRKTQGLNNLAGPRAMISVQDAEALGIGNGDMLKVSTRRGEIEIAAFVTKRMQAGVVFIPFHFVESPVNRLTTTATDPHAKIPEFKVAAVRVEKLHTALVE

SEQ ID NO: 22423 - protein, 343 aa, Vibrio vulnificus YJ016
MKIKALSKLKPEEGIWMTEVDKPVLGHNDLLIKIKKTAICGTDVHIYNWDEWSQKTIPVPMVVGHEYVGEVVGIGQEVRGFEIGDRVSGEGHITCGHCRNCRGGRTHLCRNTIGVGVNRTGCFSEYLVIPAFNAFKIPANISDDLASIFDPFGNAVHTALSFDLVGEDVLITGAGPIGIMAAAVAKHVGARHVVITDVNEYRLDLARKMGVTRAVNVAEQKLDDVMVELGMTEGFDVGLEMSGNPSAFNSMLKTMNHGGRIALLGIPPSDMGIDWNQVIFKGLVIKGIYGREMFETWYKMASLIQSGLDLTPIITHHFKVDDFQQGFDIMRSGMSGKVILDWE

SEQ ID NO: 22424 - protein, 416 aa, Vibrio vulnificus YJ016
MDIFKSINGHFTKLNPMYYQSNKQNKRQTGNTMEIARSLQQIQSSYIREILAAASDPSVISLAGGLPDEQTFPIELMKPTLEKLSEMPQVFQYGATAGYAPLLNFLKTYMSLPETHMAMACTGSQQGLDLIARAYINPGDTVVMEAPSYLGAMQVFGLVSANIATVSQTEAGPNLDELEACFKQHSPKMFYAVPDFHNPTGVCWSLETRKQVAKLCIEHKVAFIEDAPYRELRFQGEALPLVSDFCPQDSIVLRSFSKIASPGLRIGIVTGKVSYLEPLIKVKQGADLHSSVPMQALLLGLLEHEKFPEHMEKIRTLYQSRYQVLAEALQTQLPESCQLKSVDGGMFVWVTLPECDTFALAKSLLGNGVAVVPSPVFYPAEQKAQAALRLNFTNATPEQLKEAVTRLAEGLKLALV

SEQ ID NO: 22425 - protein, 459 aa, Vibrio vulnificus YJ016
MTQNIKPTHFRSEGDVNTTPARQAWNASMDDERTQALLKRDSEVFLHQAMSTPCLDTLEAAEGIYIQDATGKKYMDFHGNNVHQLGYGHPHVIKRVQEQIAKLPFSPRRFTNETAIECAEKLTQICGGELNRVLFAPGGTSAVGMALKLARHVTGNYKVVSLWDSFHGASLDAISVGGEACFRQGMGPLMAGVERIPPAVSYRGAFPIADGSDVHYADYLEYVIEKEGGVGAFIAEAVRNTDVQVPSKAYWKRIREICDKHNVMLIIDDIPNGMGRSGEWFTYQAYDIEPDMLCIGKGLGGGLVPIAAMVTKDKYNTAEQISMGHYTHEKSPIGCAAALATMEAIEQDGLLDKVKVDSQFMREKLLEMKAKYPVIGDVRGIGMLWGIELVTDHESKARAYDEAEAVLYQCLNNGVSFKVSQGNVIQLSPPLIITREQLTEALAIFEEAIAKVCKDFNYF

SEQ ID NO: 22426 - protein, 486 aa, Vibrio vulnificus YJ016
MEVTAHYIGGKPFVGDTGESFATLNPATGEVLAHIEQADERVLAHAIESAKLGFSVWSSMSAAERSRCLLKAAQLIRDHNDELAELEVRDTGKPIQEASVVDIATGADVIEYFAGLVNGLGGEQQSLGSNQFFYTRREPLGICAGIGAWNYPIQIAMWKAAPALAAGNAMIFKPSEETPLSALKLAELFTQAGVPDGVFNVVQGDYRVGQMLTAHPEIAKVSFTGESGTGKKVMADSAATLKPVTMELGGKSPLIIFDDADLDDAVSAAMVANFYTQGEVCTHGTRVYVQRAMYDAFVEQLKERTEKLIVGDPMNMETQIGSLISKSHLEKVLGAISSAKESGATLLTGGFQVTERGLEKGCFVAPTVFVDCRDEMPHVQNEIFGPVMSVLVFDDEDEVIARANNTQYGLAAGVFTQNLSKAHRVIHQLQAGICWINTWGNSPAEMPVGGYKLSGIGRENGQETLLHYTQTKSVFVELGAFDSPYA

SEQ ID NO: 22427 - protein, 507 aa, Vibrio vulnificus YJ016
MRIVVWSAFIRSRRMELKQRLSQQLKESRDAFLRNPYPTYQKRLENLNKLESLIKAHQAEIIYAIEQDFGTRSISETGLLELFTSIETIRDAKKQLKKWMKPSHRHTSVWFFPAKNRVVPQPLGVVGVIVPWNYPLMLTIGPLVAALAAGNRVMLKMSQNSPHLAQLLVELFEAQFNRDEVAIYADEAEMGPEFSKLKFDHLLFTGSTKTGRAVMQSAANNLVPVTLELGGKSPVILDEKFDVKIALERLLGGKLYNCGQTCIAPDYLFVPQSRLNEVVETTKAIMAKRFRTIQHQDYTSIIDANAFERLTHLLSDAKEKGAKLINCIPNSEPERGSRKLPFYLVTEVESDMAVMQEEIFGPILPIITYQHIDEVFHYIAQRPRPLALYLFSEDKWIQKKFTQETLSGGLCINDVMLHVAQHDLPFGGVGESGMGHYHGREGFNTFSKLKPVMTQSRFALTPLFYSPYSGFAKSILNVMINRKIGNYESAIQQKLTSLLRIIGRDVS

SEQ ID NO: 22428 - protein, 491 aa, Vibrio vulnificus YJ016
MKMCKTKIVATLGPASQTREKLTQLIQAGVNVVRLNFSHGSAEEHIARAEMVREIAQDLNVSVGVLVDLQGPKIRIACFEQGSIQLKAGDPFILDGTLDREAGTQERVGLDYPELIDDLQVGNILLLDDGRIQLEVTAVDTQTRLVNTIALNGGKLSNRKGINLLGGGLSAPALTDKDKQDILTAAELKADFLAVSFPRNADDIEYARSLALQAGCHAHIVAKVERAEVVASEEAMDGVIRASDVIMVARGDLGVEIGDARLPGVQKALIARAKYLGKPVITATQMMESMIENPLPTRAEVLDVANAVLDGTDAVMLSAESAAGLYPVEAVEAMVRIAQGVEHETSCAQGCWDKLHHLCNDAGKSFALSSMISATKVHKDLGVAIVTQHGETPLLMSRCQSQATIWAVSDKPELLRKLAILRGVTPVYLPTLDKRGDIAHQLVSLLGADAKQKQISSIMMTQLESVEGVGDMNVCRLLNLNETPITTAIAA

SEQ ID NO: 22429 - protein, 459 aa, Vibrio vulnificus YJ016
MLNFFKTRPDVPLSDSSNEGMLKRYKSYQWQVFLGLIFGYAVFYVVRMSLGVVKKPMLDAGIVTIEELGIMGSAFFFTYAFGKFLNGFLSDYANIGRFMSCSLLVSGVLSVVMGMNTVGFFFVLLWGLNGWFQSVGSAPSCVSLYQWFSPKQRGSRYSIWGGSRNIGEGITWILTATLVSYFGWRAGFIGAGIAAVVAALIMLKVLKDRPQTYGLPDPGTAFGEGTEIKKANDPKETRRAQMFILKQPVVWLIALSCAAMYISRYAMSSWAVLFLQETKGYSLIDAGFAMSMYPTAGLAGAILSGILSDKVFKGNRNIPNLLYGLANIAGMCLMFFGPDNRVIDAVALSMIGFSIGGLVVFLAGLIACDLMPKNAVGAVKGLIGLCSYIAASAQELISASLITITEVDGVKHYDFGNAQYFWLAAGVVSVLLALTVWNAKKVVDIDEEQDKKLQTRTAS

SEQ ID NO: 22430 - protein, 461 aa, Vibrio vulnificus YJ016
MNALHSETNNPKTLPEGLLKTITKLGFPVAIQSALVAILALADVLMVSDFGKEATAAVGIASKWHFIAIMIMAGLASANGTLVAQYWGKDDVRSAKAVSLIALSFGLKVLIPVTLLITLGSQFIMMLQTNDQTVIGLGSVYLWYAFPVLLLTHIVIVIESSMRSSGDTVTPLIIGSLTIVINIALNYWLIKGGFGIPAMGVAGAALATSISRAIQVLLMLALMKLKQHWLLTTEASSERPSLWLSYRRLALPVTLGAVLWGIGTMAYQIIFGHMGTTELAVFSMLGPFESLCYAIFFGLSVACSVLIGQSLGRNEFERAQAMAAYFIKVVFIVGLSVGAFMLLNREWILAGLNLNTEELRPLAAPAVIILCCGIWIRMLNMTIINGIIRAGGDNVFCLRMDFIAMWMTGIPLCAFAAFIAGMEFKVVYSLMLAEEVVKLALCYRRYTQKFWIKNLTVVTTC

SEQ ID NO: 22431 - protein, 356 aa, Vibrio vulnificus YJ016
MVGGRSPTGTTGEILVAHSAQSWSLKVLPIEHYKPAWNAARAESQPSVKNMENVMQNIGFIGLGNMGAPMAENLLKAGHQVKVFDLNQAACEKLAQQGASVCANLEELAQDVSCVITMLPAGEHVRSVYLGTHQGDKGLLALVAENSLLIDSSTIDPQSARLVGEEAAKRGLDFVDAPVSGGVAGAHAATLTFIVGGSDNAFARAETILKNMGKNIFHAGQAGDGQMGKICNNLMLGILMSGTCEALNLGIDNGLDPTVLSNIMLQSSGRNWALELYNPCPGVMENAPASRGYQPGFMSKLMLKDLGLGLDAAAKSQSSVPMGALARNLYAFHNAAGNEELDFSSLFEFYAKNNKE

SEQ ID NO: 22432 - protein, 475 aa, Vibrio vulnificus YJ016
MYDTMTREFTMLKFLEQVRKPTLDLPVEVRRKMWFKPFIQSYLVVFIGYLTMYLIRKNFNVAQNDMISTYGLSMTDLGLIGLGFSITYGIGKTVVSYYADGKNTKQFLPFMLILSGLAMLGFSFSMGGGSASLFLMVAFYALSGFFQSTGGPSSYSTITKWTPRNKRGSYLGLWNMSHNVGGAGAAGVALFGANYLFDGHVIGMFVFPSIIAIIVGFIGMRFGSDSPEAYGLGKVEELFDEAVSEEDTAAEENQMTKKEIFVEYVLKNKVIWLLCFANIFLYIVRIGIDQWSTVYAYQELGLSKEAAISGFTLFEVGALVGTLMWGYLSDLANGRRALVACVSLALIIVSLEFYQHATSEFMYLASLFVLGFLVFGPQLLIGVAAVGFVPKKAISVADGVKGTFAYLIGDSFAKLGLGMIADGTPIFGLTGWKGTFAALDTSAMICIVLLAFVAIAEEKKIRHNKKKLELAASQS

SEQ ID NO: 22433 - protein, 446 aa, Vibrio vulnificus YJ016
MFGLFQSPSYTQAPLDKSQVDERYRYWRLHIMIGMYIGYAGFYFTRKTFNYAAPAMIVDLGLDKGDLGLIGTLFYITYGLSKFISGTISDRSNPRYFMGVGLIASGIINIVFGFSSSLIALSILWVLNAWFQGWGWPSCSKLLTTWYSRSERGFLWAIWNTAHNVGGALIPLLVGYLTFHFSWREGFIVPGIIGVLLGLIVCWRLRDKPTTQGLPTVGQWRHDPLELAQEKHGQGLSYREILTHYVFNNKYIWLLAFSYVLVYIVRTAINDWGNLYLTEQHHYSLINANAALSMFEIGGFVGSLVAGWGSDKLFGGNRGPMNLLFAAGIFLSVAALWLMPLTNFAFQAAGLFSIGFFVFGPQMLIGMAAAECSHKDSAGAATGFVGLFAYMGAALSGYPLALILEEYSWTGFFVTISICAAVIGLLLLPFLQAQPSRKPLAPKLRL

SEQ ID NO: 22434 - protein, 157 aa, Vibrio vulnificus YJ016
MSKLILPLIILVLAVFMIYRTWNNHKAAEVNFEKGQAFLLENSKKEGVITTESGLQYQVLEKGHGDKHPSANSKVKVHYHGMLTDGTVFDSSVERGSPMSFNLNQVIKGWQEGLQYMVEGEKVRLFIPSTLGYGKGGSGPIPPASVLIFDVELLEIQ

SEQ ID NO: 22435 - protein, 367 aa, Vibrio vulnificus YJ016
MVTTHSAMTHTSYESRNYTMRIEQELKLGFKDVLFRPKRSTLKSRSQVNLTREFTFKHSGRQWSGVPVIAANMDSVGSFEMAKALSQHGVMTAIHKHYTVQDWADFVKDADSETLNKVMVSTGTSEADFQKTKDVMALSDELIFICIDIANGYSEHLVQYVQQVRAAFPDKVISAGNVVTGDMVEELILAGADIVKVGIGPGSVCTTRVKTGVGYPQLSAIIECADAAHGLGGRIIGDGGCACAGDVAKAFGGGADFVMLGGMLAGHEESGGEIVLKDGESYMKFYGMSSKSAMDKHSGGVAGYRAAEGKTVLLPYRGSVHGTIQDILGGVRSTCTYVGAAELRELTKRTTFIRVLEQENNVFGKEK

SEQ ID NO: 22436 - protein, 498 aa, Vibrio vulnificus YJ016
MTAMDLRKALYTAKQVREGEVGAAANAGVTLYELMERAGRATFAVILNYYPAVSRLCVVCGKGNNGGDGYVVARLARQQGLYVVLIQSSDAESLSGDAKQAQQAWRDAGGEISDTASLNAALSDCDLVVDALLGTGLAGAVRDEMAKLIDAVNLAGKPIVSVDIPSGLCADTGQALPDAIHADHTVTFIGTKQGLVTGKARAFCGAIHFADLGIGTEFSKLVPSFKTTIERDEITQWRLTRARCAHKGDHGRVVLLGGNRGMSGAISLAATACARSGAGLVAALTHPESALPLQIHCPEVMTLGYNEDKRELEKKLDWADVLVVGPGLGTDEWAKKRWNDIANFQGPMVLDADGLNWLARYPNHNDQRIITPHPGEAARLLGCSVNEVEADRFAAVSVLQSQYGGVVVLKGAGTLVYDGTQTFVCNAGNPGMATGGMGDVLSGVIGALLVQKLPLLRAASLGVLLHSCAADICATEKGEIGLLASDLLDKIRQLLNAD

SEQ ID NO: 22437 - protein, 247 aa, Vibrio vulnificus YJ016
MQISSMSIQVKSVNKSYGSNQILHNISFECAKGETLVLLGPSGAGKSSLLRVLNLLESADNGQLTIANQAFDFASSPSEADGLLLRRKVGMVFQQYNLWPHLTVIENLIEAPIRVLGVAKAEAIEQAREILATLQLADKADAWPLQLSGGQQQRVAIARALMMKPEVLLFDEPTAALDPEITNQVVKIISGLSDTGITQVVVTHEVDFAKKIASHVLYLEKGHIVEHGTKQAFSEPQTRAFAEYLKH

SEQ ID NO: 22438 - protein, 506 aa, Vibrio vulnificus YJ016
MIYAQPGSDNAVVNFKSHYDNYIGGEWVKPVSGEYFDNISPVNGQAYCKVARSSAADINLALDAAHSVRYQWAKTSVTERANILLKIADRIEAHLEELAVAETWENGKPVRETLAADLPLVVDHFRYFAGCIRAQEGSAAELDANTASYHFPEPIGVVGQIIPWNFPMLMAAWKLAPALAAGCCVVLKPAEQTPTSILVLMEKIGDLIPAGVVNVVNGFGAEAGQALATSNRIAKLAFTGSTEVGNHILKCAAESLIPSTVELGGKSPNIYFPDVFDHEDAYLDKCIEGTLLAFFNQGEVCTCPSRVLVHESIYDQFIAKVAERAKSIKQGNPLDTDTQVGAQASQEQFDKILSYLEIGRQEGAKVVFGGEIAKQEDDLATGYYIQPTLLQGHNKMRVFQEEIFGPVIAVTTFKDEAEALAIANDTEYGLGAGVWTRDQNLAYRMGRNIEAGRIWINCYHAYPAHAAFGGYKKSGIGRETHKMMLNHYQNTKNLLISYDVNPLGFF

SEQ ID NO: 22439 - protein, 328 aa, Vibrio vulnificus YJ016
MKIAILDDYQDQVRQLECFAALAPFEVTVFHHTETDEAILASALAEFDALVLIRERTAITASLLAKLPNLKLISQTGKISNHLDLHACNHANVAVAEGVGSPIAPSELCWGLIMAASREIVSYAQQLQQGEWQQNQTHRLGRTLHGQTIGIWGYGKIGQRIAGYAKAFGLQVMVWGSESSRRQAQEDGFLAADSKEAFFQQCDIVSLHLRLNTATHAIVKASDLAAMKPGSLFVNISRAELVEAGALCQEMQRRSDKFAAIDVYHHEPATMAQEPILTLPNVLCTPHIGYVEQNSYELYFRYAFDNIVAFAHGQAQNIVNPEVLSPME

SEQ ID NO: 22440 - protein, 240 aa, Vibrio vulnificus YJ016
MNNKQDCGEKMSNTPLVELTNICKFYSSGEAEVRALDGVDLTIHQGEFLSILGPSGSGKSTLMNMLGCLDKPTEGEYQLAGQNVASLSANELASIRNQKIGFVFQSFNLLEYATALDNVALPLVYSGIKAKERRQRAAKLLAQVGLGDRLDHKPNQLSGGQKQRVAIARALVNDPQIILADEPTGALDSKSGAEIEALFNQLHAEGRTLIIVTHDNALAERTKRIITIKDGKVISDRAPS

SEQ ID NO: 22441 - protein, 325 aa, Vibrio vulnificus YJ016
MKHIAIIGECMIELNGKPFGSMHQTFGGDTLNAAVYLSRGCEANNKPDEVKVSYVTALGNDPISTGMLTRWEDEGVSTDLVLRDETRTPGLYLIQLDDQGERTFLYWRNQSAARYLLQHPNFGMVKQALTQVDAVFLSGISLAILPEEDRISLLNLLVELKAQGVEIAFDSNFRPALWPQDDNQTVKNVYQAMYQLTDVAMVTFDDEQLIWGDATPEQTIERLTSLGVDKCIVKLGADGCLVQDSTNQGSSAALAPQAVPTQPVAQVVDTTSAGDSFNGGFLSAYLAGADLATSCQRGNALAGAVIQHRGAIIPKAFTQPALGVV

SEQ ID NO: 22442 - protein, 364 aa, Vibrio vulnificus YJ016
MSKLFEPTQLKHLDLQNRVVMAPMTRARTSQPGNIPNAMMATYYKQRASAGLIISEATQISDDSQGYSFTPGVYTDEQVAGWKSVTQAVKSQDAAMFCQLWHVGRVSHPVFQKGEQPIAPSALAPVETKVWIADEQGNGNMVDCVEPRAMTQDDIDRVVSDFSYAAKRAIEAGFDGVEIHGGNGYLIDQFLRTNSNHRTDQYGGSRENRIRFLLQVVDAVSQAIGADKVGVRLAPFITFKDMNCPDIVPTILEASKQLQARDIAYLHLSEADWEDAPEIPESFRIELREYFTNTIIVAGSYTQARADEVLKKGYADLVAFGRPFVSNPDLVARLKHQQPLAELDGATLFGGDERGYTDYTALHV

SEQ ID NO: 22443 - protein, 1043 aa, Vibrio vulnificus YJ016
MFTATDVLKPEFVAQPLDKLWALISPLYMVDESQWLEQLLPLATPSAEEKQAIANRTTQLIEAIRADKKSIQLIDALLLEYSLDTHEGILLMCLAEALMRIPDAATADALIKDKMSVADWKSHLKNSESVFVNASTWGLMLTGKVVGLGDDETQSASQALNRLVNKLSEPVIRKAMYQAMKIMGHQFVRGRTIEEAQKNGRPMRDKGFTYSFDMLGEAALTTADANKYFKDYLMAIEAVGRETYGNDTSPAPSVSIKLSALHPRYEVANEHRVMSELFDTLAQLLKRAVELDVAITIDAEEADRLELSLKLFEKLYRSETVKGWGKFGLVVQAYSKRALPVLVWLNALAKEQGDLIPLRLVKGAYWDSEVKWSQQRGYDNYPVYTRKEATDVAYLACARFLLSDDVRGNIFPQFASHNAQTVSSIATMATHSDYEFQRLHGMGDSLYNHVMEQYRQPVRIYAPVGSHKDLLPYLVRRLLENGANSSFVHRLVDARCPVAELTKHPVEALTSFETLNNTKIPLPAAIFPERKNSYGVNVDIESEAKPFEAQVESFLSKQWLAGPIINGASLAESMIKDGQAESVTAPYDRRIQVGQIAFANLDHVSQAIDIAQAAFADWNRTPLVEKARCLDNLADLMEANLAELVALCHQEAGKTLHDSIDEVREAVDFCRYYAKQAQNLQPFELEGFDGVKRIASREGLGVFVCISPWNFPLAIFLGQVTAALVAGNTVVAKPAEQTSLIAVRAVELMLQAGFPAGVVQLIPGRGADIGSALTSHPAIAGVAFTGSTATAQRINVTLAQREAKPVPFIAETGGQNAMIVDSTALPEQVVRDVIRSAFASAGQRCSALRVLFVQQDIADRVIGLIQGAMNELSVGVPHLHKTDVGPVIDARAKEKLLQHIEQMNQTQKPIAQLTLADDCQHGDFVAPTAFEISGIDVLKEEQFGPILHIVRFKASELTRVVEQINRTGFGLTMGIHSRNETTYRWIEKHARVGNCYINRDQVGAVVGVQPFGGQGLSGTGPKAGGPHYLYRFTQVQFNQTENA

SEQ ID NO: 22444 - protein, 245 aa, Vibrio vulnificus YJ016
MIKLDNIHKRFGDTEVLKGIDLTINQGEIIVIIGSSGTGKSTLLRCVNFLEQADQGKITIDDISVDSQQHTKAEVLALRRRTGFVFQNYALFAHMTARQNIAEGLITVRGWKKEDALKRAQQILDDIGLGEKGDSYPAALSGGQQQRVGIGRAMALQPELLLFDEPTSALDPEWVGEVLSLMKKLANQHQTMLVVTHEMQFAREVADRVIFMAEGKIVEQGSPQDIFGNPQDPRLQKFLRQVGME

SEQ ID NO: 22445 - protein, 451 aa, Vibrio vulnificus YJ016
MATHFDYICIGGGSGGIASANRAAMYGAKVALIEAKDLGGTCVNVGCVPKKVMWHGAQIAEAMSLYAPDYGFDVEVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLNALGTETHLFCRKESPLRSFDPMIIDTLVEVMAAEGPTLHTHSVPKEVVKEADGSLTLHLENGESQNVDQLIWAIGRHPATDAINLSATGVATNERGYIKVDEFQATNVAGIYCVGDIMEGGIELTPVAVKAGRQLSERLFNNKPNAKMDYDLVPTVVFSHPPIGTIGLSEPEAIAQYGKENVKVYTSGFTAMYTAVTQHRQPCKMKLVCAGEDEKVVGLHGIGFAVDEMIQGFGVAMKMGATKADFDSVVAIHPTGSEEFVTMR

SEQ ID NO: 22446 - protein, 469 aa, Vibrio vulnificus YJ016
MILPIIMAGGSGTRLWPLSRDNYPKQFLKLHGENTMLQETILRLNGLEHSPAMLICNEEHRFIAAEQVRQIGVAHSGIFLEPVGRNTAPAIALAAFKAVENNQDALLLVLAADHVIENQAAFQESVNNAKLLAEQGKLVTFGIVGNTPETAYGYIKRGKEVEHGFVVDSFVEKPDLQTAQEYIASGNYFWNSGMFLFKASRYLEELKAYRPDIYEACEKAVQVQNNDIDFVRVDKDAFEACPDESVDYAVMEHTQDAVVVPMNANWNDVGGFAALWEVSDQDENGNAFVGDVKSVDTKNTLVFAKDKLVTTVGVEDLVIVNTKDAVLVAHKDESQKVKEIVSQLKADERSEVTFHREVYRPWGKYDSVDNGERFQVKRITVKPGAKLSVQMHHHRAEHWIVVSGTAKVQIDDTEQFVTENESVYIPITAVHALENPGKVDLELIEVQSGSYLGEDDIVRFEDRYGRVKD

SEQ ID NO: 22447 - protein, 209 aa, Vibrio vulnificus YJ016
MTFMSDIKFETVEEKASYGIGLQMGQQLAGSGLDGLNVAAIAAGIATSLTGDMPAVEVDEINKALHELYTRAESARAEAAKAAAADGEVFLKDNALRPEVTVLESGLQYEIITEGNGEIPTSDKTVRVHYHGELVDGTVFDSSVSRGQPAQFPVTGVIKGWVEALQLMPVGSKWKLYIPHDLAYGERGAGASIPPFAALVFEVELLDIV

SEQ ID NO: 22448 - protein, 495 aa, Vibrio vulnificus YJ016
MGHVKALGYKHRLSNCNYIDRRVSSMKKTKIVCTIGPKTESVEKLTELVNSGMNVMRLNFSHGDYVEHGTRIANFRQVMENTGKQLAILLDTKGPEIRTIKLENGDDVDLVAGQEFTFTTDTSVVGNKDIVAVTYPGFAADLSAGNTILVDDGLIEMEVIATTATEVKCKVLNNGALGENKGVNLPGVSVNLPALSEKDKNDLKFGCEQGVDFVAASFIRKASDVKEIREVLAANGGANIQIISKIENQEGVDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVTIMAQIANRTDSVLKAELGSRLDSPRLRITEAVCKGAVDTAEKLAAPLIIVATEGGKSARSVRKYFPTANILALTTNKKTAAQLVLTKGVTPVVVDSIDNTDAFYVAGKELALESGLGSKGDIVVMVSGALVASGTTNTASVHVL

SEQ ID NO: 22449 - protein, 472 aa, Vibrio vulnificus YJ016
MNMSQNVYQFIDVQRVDPAKKPLQIRKIEFVEIYEPFTKQQATAQADRCLDCGNPYCEWKCPVHNYIPQWLKLANEGRILEAVELSHQTNSLPEVCGRVCPQDRLCEGSCTLNDDFGAVTIGNIEKYITDKAFEMGWKPDMSKVEWTDKKVAIIGAGPAGLAAADILVRNGVKPVVFDRYPEIGGLLTFGIPSFKLEKGVMENRRRIFSEMGVEFRMNVEVGKDVQMQELLEEYDAVFLGVGTYKYMRAGLENEDASGVYDALPFLISNTYKVMGLEYDQPFIDMAGKNVVVLGGGDTAMDCVRTSIRQGAANVVCAYRRDEENMPGSRREVKNAKEEGVNFMFNLQPLSIDVDTRGQVTGVKVVQTALGEPDEAGRRRPEPVAGSEHVLPADVVIMAFGFQPHQMSWLEPYGVELDQWGRIKAAAKQTYQFQTSNEKIFAGGDAVRGSDLVVTAIDEGRKAAEGILDYLEL

SEQ ID NO: 22450 - protein, 170 aa, Vibrio vulnificus YJ016
MWQKFSQGGYMKDITPDICDQHEDKVTLLNLPLQNFGQKAAFFGEIVTVRCYHDNSKVRDVLSENGKGKVLVVDGHGSCQKALLGDQLAILAIENDWEGVIVFGAVRDVAQMSQMELGIKALGTSPFKTEKRGAGEVNVTLTMHNQMVQPKDYIYADWNGILISKELLQF

SEQ ID NO: 22451 - protein, 171 aa, Vibrio vulnificus YJ016
MNHFELFGLPPQFSLDGSLLSSQFRELQKRFHPDNFATASERDRLLAVQKAAQINDAYQVLKNPISRAEYLLSQNGLEIRGEQQTMQDPMFLMEQMELREELEEIPHGSDAESALAAFDARVSKMYKQHLASIEQELNDAQWPQAADRVRKLKFIAKLKNEIELVEEKLFG

SEQ ID NO: 22452 - protein, 489 aa, Vibrio vulnificus YJ016
MQMLRIAKEALTFDDVLLVPAHSTVLPNTADLRTQLTKNITLNIPMISASMDTVTEARLAIALAQEGGIGFIHKNMSIEQQAAEVRKVKKFEAGVVTDPVTVSPDATIADVVALTDKHGFAGFPVVTESNELVGIITGRDVRFVTDLSKKVSSVMTPKENLAAVKEGATRAEVQEKMHEARVEKVLVVNDDFQLTGMITAKDFHKAERKPNACKDAQGRLRVGAAVGAGAGNEERVAALVEAGVDVLLIDSSHGHSEGVLQRIRDTRAAFPNLDIIGGNVATAAGAKALIEAGVSAVKVGIGPGSICTTRIVTGVGVPQITAIADAAEVANQYGVPVIADGGIRFSGDICKAIAAGASCVMVGSMFAGTEEAPGEVILYNGRSYKAYRGMGSLGAMSQGSSDRYFQSDNAADKLVPEGIEGRIAYKGRLKEIVHQQMGGLRSSMGLTGSATIEEMRTKAEFVRITGAGMQESHVHDVQITKEAPNYRLG

SEQ ID NO: 22453 - protein, 376 aa, Vibrio vulnificus YJ016
MTQDKFIKSRAAVAWGPKQPLSIEEVDVMLPRKGEVLVRIVATGVCHTDAFTLSGDDPEGVFPAILGHEGGGIVEMVGEGVTSVSVGDHVIPLYTAECGQCKFCLSGKTNLCQAVRETQGKGLMPDGTTRFYKDGKPIFHYMGCSTFSEYTVLPEISLAKVNKEAPLEEICLLGCGVTTGMGAVINTAKVKQGDTVAIFGLGGIGLSAIIGARMAGASRIIAVDINDRKFELAKQLGATDCINPKEHDQPIQEVIIEMTDGGVDFSFECIGNVNVMRQALECCHKGWGESVIIGVAGAGQEISTRPFQLVTGRVWRGSAFGGVKGRSQLPAIVEQYLAGEFGLQEFITHTMPLEGINDAFELMHSGESIRSVVHFE

SEQ ID NO: 22454 - protein, 209 aa, Vibrio vulnificus YJ016
MLERLFKLSEHGTNVRTEIIAGITTFLTMAYIIFVNPAILADAGMDRGAVFVATCLAAAIGCFIMGLLANYPIAQAPGMGLNAFFTYAVVLGMGYTWQVALAAVFVSGVLFILLSIFKIREWIINSIPLSLRTGISAGIGLFLAFIALKNAGIVVDNPATFVSLGDITSLAPASGGFWFLFDYCTCSPWCERGSNDCDLSCDGTWFGVW

SEQ ID NO: 22455 - protein, 280 aa, Vibrio vulnificus YJ016
MQALLLIILRRLFLLAISLLSHQRLAAFGFFLTIALVHRGVKGAVMIAILAVTALGLVFGDVQWAGVMSTPPSIAPTFMQLDFSAVFEVGMISVVFAFLFVDLFDTAGTLVGVATKANLIEKDGKLPRLNKALLADSTATSVGALLGTSNTTSYIESVSGVAAGGRTGLTAVVVGVLFLLALFFSPLAGMIPAYATAGALFYVAILMLSGLVSIDWRDLTEAAPVVVTCLLMPLTFSIAEGISLGFIAYAAIKLFSGKGRDVSLSVWIMSAIFIIKYLVA

SEQ ID NO: 22456 - protein, 322 aa, Vibrio vulnificus YJ016
MSKIYEDNSLTIGNTPLVRLNKVSNGKVLAKIEARNPSFSVKCRIGANMIWEAEKEGKLKPGVELVEPTSGNTGIALAFVAAARGYKLTLTMPESMSLERRKLLKALGANLELTEAAKGMKGAIAKAEEIVASNPEKYLLLQQFNNPANPEIHEKTTGPEIWEATDGAIDVFVAGVGTGGTITGTSRYIKGEKGKQILSVAVEPTESPVISQALAGEEIKPAPHKIQGIGAGFIPGNLDLSLIDRVEKVTSEEAIEMARRLMEEEGILAGISSGAAVVAANRLAELPEFEGKTIVTVLPSSGERYLSTALFAGIFTEKENQQ

SEQ ID NO: 22457 - protein, 214 aa, Vibrio vulnificus YJ016
MRIILLGAPGAGKGTQAQFIMEKYGIPQISTGDMLRAAIKAGTELGKQAKAVIDAGQLVSDEIILGLIKERIAQEDCAKGFLLDGFPRTIPQADGLKEMGVAVDYVIEFDVADDVIVERMAGRRAHLPSGRTYHVVYNPPKVEGKDDVTGEDLVVRDDDKEETVRARLGVYHSQTAPLIEYYGKEAAESNTKYLKFDGTKQVAQVSADIEKALA

SEQ ID NO: 22458 - protein, 440 aa, Vibrio vulnificus YJ016
MKVVVVGGSAAGMSFAAKYKRNQPSDEVIVLDKRDYISFGACGLPYFAGGMFDDTERMISRTPEQAIKSGLDVRIETEMVALDRIEKQITVRHQGEETILDYDMLVIATGARPIIPSFGEFNPEHVYTLTSMEDGLAVKQALKDSNKQRVCVIGGGFIGLEVFDAAHLLGKHVTIIEREQHVMSRQFSPEMIDVVEGAIRESGAELKTSCSVSAIRDAEQGGYLVETDNGSVAADVVIMSLGFKPNTEAFELPKAANGALLVDEFGATEDEHIYAVGDCAVVHHMALGKSVYVPLATTANKQARMMADKLAGKDTYMNGFLGSSCLKVLDYELACTGVSELLAKEHGLDVSVSTISDKNQTDYYPGQEDIKVKLVYHPETKVLLGGEIVGKKGAVGRINALAVAITAKMTTQQLGYMDFCYAPPFARTWDALNVAGNVAK

SEQ ID NO: 22459 - protein, 361 aa, Vibrio vulnificus YJ016
MCTDHNWINNAIRKIEADFQRSADTHLFKLDLPSLEGIDIYLKDESTHPTGSLKHRLARSLFLYAICNGWIGPETTVIESSSGSTAVSEAYFARLLGLPFIAVMPKCTARKKIEQIEFYGGKAHLVDRSDQIYAESHRLAKELNGHYMDQFTYAERATDWRGNNNIANSIFSQMTLEEHPEPSWIVMSPGTGGTSATIGRFIRYQKLDTKLCVVDPENSVFFDYFQNGDNTITGNTGSKIEGIGRPRVEPSFIAGVVDEMRKIPDAASVACTHWVSKLIGRKVGASTGTNLYGVLQLACEMKQRGERGSIVTLLCDSGDRYLDTYFNEEWVKTNIGDIQPYLEQLEIIERDGCVAPICCPA

SEQ ID NO: 22460 - protein, 268 aa, Vibrio vulnificus YJ016
MDRYQATFERLAAQKQGAFVPFVTVCDPNPELSLKIMDTLVQAGADALELGIPFSDPLADGPTIQGANIRALDSGATPDICFDLIGQIRAKYPDLPIGLLMYANLVYSRGIENFYQRCAQAGIDSVLIADVPTNESAEFVAAAEKFGVHPIFIAPPTASDETLKQVSQLGGGYTYLLSRAGVTGAETKANMPVGDMLAKLEQFNAPPALLGFGISEPEQVKQAIDAGAAGAISGSAVVKIIESHLNEPDAMLTALANFVSSMKSATQK

SEQ ID NO: 22461 - protein, 482 aa, Vibrio vulnificus YJ016
MTQPLRRTKIVTTLGPSTDKDNVLEEIIRAGANVVRMNFSHGSAEDHKTRAEKVRNIAARLGRQVAILGDLQGPKIRVSTFKEGKIFLSVGDLFTLDSDLPKGEGDQKSVGLDYKALPQDVGPEDILLLDDGRVQLQVLTVDGNKVNTRVIVGGPLSNNKGINKKGGGLSADALTEKDKQDILLAAEIKVDYLAISFPRNGADMDYARRLARDAGLEAKLVAKVERAETVRNDENIDDIIMASDVIMVARGDLGVEIGDPELIGVQKKLIKRAKELNRVVITATQMMESMIENPMPTRAEVMDVANAVLDGTDAVMLSGETAAGKYPVETVRSMAEVCIGAEKTWEPGSQNYRIDKSFVTAEETIAMSTIYAANHMEGVKAMVTLTESGRTALMTSRLNSTLPIFALSPNERTLNRCSLYRGVTPVFFDTKVETGFDVAMAALSTLRKKKLLDFGDLVIITQGDIMDVEGSTNCMRILPVFD

SEQ ID NO: 22462 - protein, 429 aa, Vibrio vulnificus YJ016
MDFIMDLAFDRQHIWHPYTSTLTPLTCYPVNSASGVYIKLEDGTTLIDGMSSWWSTIHGYNHPHLNQAAHRQIDQVSHVMFGGITHQPAINLCKKLLSLAPNNLEHVFLADSGSVAVEVSLKMALQYWHAKGDRRPKFLTLQHGYHGDTFAAMSVTDPDNSMHSLYKGFLPEHIFAKSPTGGFWDEWKPEDLTDFAQKIEQHHQELAAVILEPIVQGAGGMRIYHPEFLKGVRALCDQYGLLLIADEIATGFGRTGKLFACEHANIQPDILCVGKALTGGYMTLSATLTSKHVADTVCGGEAGCFMHGPTFMGNPLACAVATASLELIEQGQWQQQTKQIESLFSELLPKLDKYDLVKNTRWLGAIGVVETHRPVNMETIQALFVEQGVWIRPFGKLIYMMPPFIGEPAHIEQLVNAIETALQRAECFV

SEQ ID NO: 22463 - protein, 211 aa, Vibrio vulnificus YJ016
MSVKAAEVSSLAERINWEKVDGLVPAIVQDFQSSQVLMMGYMNQDALAKTGETGQVTFFSRTKERLWTKGETSGNVLQLVNMSLDCDNDTLLVKVNPIGPTCHTGTTTCWDGDPQEESQMVWLHQLEQLLAARKSADPDSSYTASLYARGTKRISQKVGEEGVEVALAATSGDKAELVCESADLIYHLLVLLQDQGLSMNDVINKLKERHK

SEQ ID NO: 22464 - protein, 432 aa, Vibrio vulnificus YJ016
MSGMFLLCNPCQAYTLHVLNRAFSHRQGINMSEGKQTKLVTAGRDKKWTNGVVNPPIQRASTVVFDTVADKHHATVNRANKTLFYGRRGTHTHFAFQEAMTQIEGGAGCALYPCGTAAISNAILSFVETGDHILMVDTCYEPTRDFCDKIMKKMGVETTYYDPMVGEGIRELIKPNTKVLFLESPGSITMEVQDVPTLARIAHEHGIIVMLDNTWGAGVNFSPFEHGVDISIQAATKYIVGHSDVMLGTAVASEPYWDQLREQSYLMGQCVSPDDAYLGLRGLRTIDVRLRQHEQASLKVAQWLATRPEVDHVRHPALESCPGHEFFNRDFTGGNGLFSFVLKTSYSRATTALLDGMKHFSMGYSWGGFESLILANEPKSFSSLRTVANPNFEGTLIRLHIGLENVEDLIADLEAGFERYNALILERETSLS

SEQ ID NO: 22465 - protein, 468 aa, Vibrio vulnificus YJ016
MNQFGMTIDGQTVQGEMPSSIVLNPANEQEVFTAPVASIAQLNKAVESAKAAYPLWSALSQAQRDGYINKIADVIEQNASELADIIVKEQGKPTQLAQMEVGGAVAWTRHSASIAIPVEVYEDSENKRIEGRRKSIGVVGSITPWNWPLMIAIWHIIPALRMGNTVVLKPSELTPINTLKLGQLLQDVLPVGVLNVVSGSGDVGRAMSEHRDINKLVFTGSTLTGQNIMQAAATNLKRLTLELGGNDAGIVLPGANLDAIAEGLFATAFINMGQTCAALKRLYVHESQHDELCQKLADIAEKQVVGEGSADGVTFGPVQNSQQLEKVIALVEEAKQQGATIYAGGARLDKPGYFFPPTIVGDAQSGMRVVEEEQFGPVLPVIKYSTVADAVAAANNVGVGLGGSVWGDVEQASELASKLECGSVWINGHAEVLPHAPFGGCKMSGFGVEFGLEGLLENSLLQVVNINK

SEQ ID NO: 22466 - protein, 506 aa, Vibrio vulnificus YJ016
MTQQLEQNLATAQKYLARFRDNTLGHFINGEWTLGSKGETFDNLTPTDNTSLGKVVKGTAEDVDAACEAAQQAFTAWAEMSGAERKKILHKLADKIEQRAEEIALVESMDCGQPLRFMRQAAIRGAANFRFFADKSPEAKNGLSLHQDTHTNYTIRTPIGPVGVITPWNTPFMLSTWKIAPALAAGCTVVHKPAEFSPLTAAILAECAKEAGLPDGVWNMVNGFGEVAGKTLTEHKAIKAVAFVGETVTGSMIQAQGAPTLKRVHFELGGKNPVIVFDDADFERALDAVVFMIYSLNGQRCTSSSRLLIQNGIKPKFIEALKQRVESLQVGHPLDPETEVGPLVHQSHYNKVMSYMTAAEEDGATIAVGGRKLPEKGAGNYLTPTLFTDADNTMRIAREEIFGPVLTCIGFDSEEEALEIANDTDYGLSGYIWTSNTGRAMRMATKVEAGMIWVNSENNRNLPSPFGGVKMSGIGRDGGDWSFDFYMETKNVCIAHDLHRVPTLGK

SEQ ID NO: 22467 - protein, 483 aa, Vibrio vulnificus YJ016
MNLNYPELFQQRCYIDGQWVAESGQTQAVTNPSTGKVIGEIPVFGEQQAKECITAAQAAFELWKKTTADYRADVLRRWYELMMVNIDDLAAILTLEQGKPFTEAKGEITYAASFVQWYSEEARRAYGEIIPSHRENGKIVVTKEPIGVVAAITPWNFPAAMITRKAAPAFAAGCSMVLKPAQETPFTALALAKLAEDAGLPKGLFNVITGDSRSIGGVFTSDKRVRKVSFTGSTNVGKILMNKSASTIKKLALELGGNAPFIVFEDADIDAAVEGAMIAKFRNAGQTCVCANRLFVHHAVYDEFAEKLANRVKQLKVGDGFADGVAIGPLINSSSVAKVQEHVDDAVAKGAKVLCGGLLNDEQLFVAPYVLTDMSDDMLVAEEETFGPVAPLFRFKDEAEVLERANDTESGLAGYFYTRSLGRAWRVADALEVGMVGINEGLISTAAAPFGGIKESGLGREGSRHGMDEYMEMKYMLMGGLDS

SEQ ID NO: 22468 - protein, 482 aa, Vibrio vulnificus YJ016
MKGDIGVIGLAVMGQNLILNMNDHGFKVVAHNRTAAKVDEFLEGPAKGTNIIGAYSLEELVEKLETPRKVMLMVRAGAVVDQFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPDLAFLGSDDYFKGILQNSLVAWRKVAAKSLEAGIPMPCTTSALTFLDGYTTARLPANLLQAQRDYFGAHTYERIDRERGEFFHTNWTGTGGNTASTTYDV

SEQ ID NO: 22469 - protein, 406 aa, Vibrio vulnificus YJ016
MSVTASQVHGAVQTLTQSSDTLFLLLGAIMVFLMHAGFAFLEVGTVRHKNQVNALVKILADFGISTLAYFFIGYWVAYGAHFFADAETLAQGNGYELVKFFFLLTFAAAIPAIVSGGIAERARFYPVLIATFFTVGIVYPLFEGIIWNGNFGVQAWFEATFGVGFHDFAGSVVVHGVGGWIALVAVIFLGMRRGRVRAGKHTNFAPSNIPFLALGAWILCVGWFGFNVMSAQTLNGISGLVAMNSLMAMAGGIVAALIAGKNDPGFIHNGPLAGLVAVCAGSDLMHPLGALVTGSVAGVLFVYLFTYLQNKTKIDDVLGVWPLHGVCGAWGGIAAGIFGQSSLGGLGGVSFTVQLLGTLLGISVALIGAGIVYGAINRFSGLRLSQEDEFNGADLAIHKISSVNAE

SEQ ID NO: 22470 - protein, 483 aa, Vibrio vulnificus YJ016
MAFADRKHPNVPRTLSIFIFFLNNGVNVHRYKKEASSLIKLATPVLIASVAQTGMGFVDTVMAGGVSATDMAAVSVAASIWLPSILFGIGLLMALVPVVAQLNGAGKREQVPFEIQQGAVMALLISIPIIGVLFQTQWILGYMNVDAVMATKTIGYIHAVMFAVPAFLLFQTLRSLTDGLSLTKPAMVIGFIGLLLNIPLNWMFVYGKLGAPALGGVGCGVATAIVYWIMFLLLLLYVTTSQRLRQVQLFTTFHPPQLNAQVKLFKLGFPVAAALFFEVTLFAVVALLVAPLGSTVVAAHQVAINFSSLVFMLPMSIGAATSIRVGHMLGEKSTEGARIASHVGILVGLSTAVFTALLTVILREQIALLYTDNRVVITLAMQLLIFAAIYQCTDAIQVIAAGALRGYKDMRAIFNRTFIAYWLLGLPTGYVLGLTDWIVEPMGAQGFWIGFIVGLSSAAAMLGVRLHWLHRQNDEIQLNYEAR

SEQ ID NO: 22471 - protein, 468 aa, Vibrio vulnificus YJ016
MNRYRQLAQSFRQQIESKTWRAGEKLPSVRMACKHHGVSAGTVLQAYQLLEAQGWVIAKPQSGYFVTSDLQRLTEPREPSVSALPSFSDELYDFLKDQSESQAVKLGSAFPDVHLFPLEALNRNLASAGRKMSANDLLNNLPPGNEALRRLIAQRYIQQGMDLTHHDIVMTSGAMEALNLSLQVVTKPGDTIVVESPCFYGALQAAQRLGLNVIEVDVDERDGLNLEQFEHVLANNEVKACWLMSNFQNPTGVTLSEQKKQAVVELVHRYQLYLIEDDVYSELYYSQDKPSSFKTYDREDRVLHCGSLSKSLCPGYRLGWVVTRRFNHAIQKLQLTSTLSGSAPIQQGVAYYLQNDGYDKHLRKLRSTLKQRQQWMMNELRRQLPDTVQFSSPTGGYFLWLKLPEPIQARLVYTRLKQQGVLSAYGGLFSQTKRFDHYLRINCSLPESDELVQAIRCLAVTINRLATD

SEQ ID NO: 22472 - protein, 342 aa, Vibrio vulnificus YJ016
MRENWPTKENTMIKIAFFSAKSYDEASFNKVNGNKEYEFHYHDFRLRLKTSKMAQGCDVVCAFVNDDLSAPVLEQLALGGTKLIAMRCAGFDKVDLQAAKELGLQVVRVPAYSPEAVAEHAVGMMMCLNRRLHKAYQRTRDANFSLEGLVGFNFYGKTVGVIGTGKIGLATMRILKGLGMEILCYDPYENPLAIEMGARYTTLQEIYQSADVISLHCPMSKENFHLLNEHSFEQMKDGVMIINTSRGELLDSAAAIEALKKGKIGALGLDVYDNEKDLFFQDKSNDVIVDDVFRRLSACHNVLFTGHQAFLTHEALNNIASVTLNNVDAFFAGNTSGNELVE

SEQ ID NO: 22473 - protein, 494 aa, Vibrio vulnificus YJ016
MNVLARQDRDVHRDQGVMSTHDATASELATWFSELQTAYQAEPSASYLVRKHRLLALKKQLSRYQDVLAEAMSQDFGGRSHTESIMADVLAPILDINHVLKHLKGWMKPSRRATEWLFKGNQLEVRYQPKGVVGIICPWNFPLYLSIGPMITALAAGNRCMIKMPPNCPQTTRQLRRMLAEIYPTNLVRIVEGTHPEAMDISHLPFDHLVFTGSPASGKIIMTNAAANLTPVTLELGGKSPVVVFDDYEIEKAAQRIAHGKGFNSGQICIAPDYAFVPEGKQEAFVDALKSAHQSMYGDIKANQDYTALVDDAQYQRFHSLLEDARSKGATITQCLEPGEGRKTPLYIATNLTPDMRICQEEIFGPLLPVHTFQAIEEVIDYINQRPRPLACYLFSHHPKQRETLLTQTHSGGVTINGWGWHVLNHSVPFGGVGNSGIGNYHGEEGFRELSHARTVLRMRDWFPIQLFAPPYGNWVQKLVVRVFAGKPDPTLKE

SEQ ID NO: 22474 - protein, 231 aa, Vibrio vulnificus YJ016
MNKYLAELFGTFWLVLGGCGSAVLAAAFPDVGIGLLGVSLAFGLTVLTMAFAIGHISGCHLNPAVTIGLWAGGRFEAKEIVPYILAQVIGGVIAGGVLYTIASGQMGFDATSSGFASNGYGEHSPGGYSLTSALVTEIVMAMMFLLVILGATDQRAPQGFAPIAIGLCLTLIHLISIPVTNTSVNPARSTGVALYVGDWATAQLWLFWVAPILGALLGAVAYKLISGSNKD

SEQ ID NO: 22475 - protein, 384 aa, Vibrio vulnificus YJ016
MDLGFATMKILVDENMPYAEMLFSQLGEVILKPGRSLTADDLVDIDALMIRSVTKVNAALISKASKLKFVGTATAGMDHVDQALLKEKGIYFTAAPGCNKVGVAEYVFSVMMVLAQQQGFSVFEQTVGIVGAGQVGSYLQQCLQGIGIKVLINDPFKQEEGDEREFTSLDRLLQEADVITLHTPITRDGKYPTHHLINKEILNSLRADQILINAARGPVVDNQALKHRLQQADGFTAALDVFEFEPEVDMELLPLLAFATPHVAGYGLEGKARGTTMIFNSYCEFIGNELRAHASDLLPTAPVPKVVLDRKWDEATLHTLTQMVYDVRRDDAQFRREIGAPGAFDLMRKEYWDRREYSAVTLVGSAQCRLKPLAKLGFQVEVSQ

SEQ ID NO: 22476 - protein, 181 aa, Vibrio vulnificus YJ016
MLKVICASLVLTSSLALAGPKVEFETSLGNFTVELNEEKAPISVENFVKYVKDGSYVGSQFHRVIPGFMAQGGGFDEKMNRLPSYAPIKNEASNGLKNVTGSIAMARTQDPNSATRQFFINLVDNEFLDYDLQPPGYAVFGQVTEGFDVIQQMASKPTKSQGYMRDIPVEPIVITKATLLP

SEQ ID NO: 22477 - protein, 459 aa, Vibrio vulnificus YJ016
MSKAKRAYVCNDCGADFPRWQGQCNACGSWNTITEVRLAASPSVARNERLSGYAGSATESKVQVLSEIDLQEVPRFSSGFKELDRVLGGGIVPGAAILIGGNPGAGKSTLLLQTMCQLSANMNALYVTGEESLQQVAMRASRLGLPKEHLKMLSETNVDKICQVAEQIQPKIMVIDSIQVMHVSDVQSSPGSVAQVRESATALTRYAKQNNVAVFIVGHVTKDGTLAGPKVLEHIIDCSVLLDGDADSRFRTLRSHKNRFGAVNELGVFAMTGQGLREVSNPSAIFLSRGEEETSGSSVMVIWEGTRPLLVEIQALVDYSQLANPRRVAVGLEQNRLSLLLAVLHKHGGLQMADQDVFVNVVGGVKVTETSADLALIMALLSSFRDRALPKDVVIFGEVGLAGEIRPVPSGQERLNEAFKHGFKKAIVPLANMPKGGIPGMQIHGVKKLADAISAFDEL

SEQ ID NO: 22478 - protein, 446 aa, Vibrio vulnificus YJ016
MSDKRRYFGTDGVRGKVGQYPITPDFVLKLGWAAGRVLAKQGTKKVIIGKDTRISGYMLESALEAGLAAAGLKATFTGPMPTPAVAYLTQTFRAEAGIVISASHNPYYDNGIKFFSSEGTKLPDDIELAIEAELDKEIECVESAELGKATRLNDAAGRYIEFCKSTFPSELSLAKLKIVVDCANGATYHIAPNVFTELGADVIAMGVTPNGTNINHEVGATDVRALQQRVVEEQADLGLAFDGDGDRIIMVDHLGNKVDGDQIAYIIARDALRRGELKGGVVGTLMTNLGMENGLKQLGIPFVRAAVGDRYVMEKLLEKGWKIGAENSGHVILLDKVTTGDAIVAALQVLASVVGSELSLNELSKGMTLYPQVLENVRFAGQGNPLEAEAVKKAVEEVEADLGSKGRVLLRKSGTEPLIRVMVEGEDGELVQNSALKIAQAVKDNC

SEQ ID NO: 22479 - protein, 464 aa, Vibrio vulnificus YJ016
MNRVINRSKIFLTAVERGTMPATWSEQSEEDKPMTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDLERFKRFFHLMIDHGVYLAPSAFEASFTSLAHGSKEIEATLEAADRCFAILAAESK

SEQ ID NO: 22480 - protein, 414 aa, Vibrio vulnificus YJ016
MERYIMELTTTVSELRYALDTFFFLISGALVMWMAAGFAMLEAGLVRSKNTTEILTKNFCLYAIACTTYLVVGYNIMYVDNSEGGWLPSIGALIGSQAEGADHSLESDFFFQVVFVATAMSVVSGAVAERMKLWSFLLFSAILTAFIYPVEGYWTWGGGFLSAAGFSDFAGSGIVHMAGASAALAGVLLLGARKGKYGKNGEVYPIPGSNMPLATLGTFILWFGWFGFNGGSQLMVSDFENATAVGQIFLNTNAAAAAGAITALFVCKTTWGKADLTMILNGALAGLVAITADPLSPSPLYSVAIGAVAGALVVFSIVGLDKLKIDDPVGAISVHGVCGFFGLMVVPISNGDASFLSQLFGAVVIFAWVFGASLAVWAVLKATIGIRVSEEEEMEGMDMHDCGVGAYPEFVTVK

SEQ ID NO: 22481 - protein, 176 aa, Vibrio vulnificus YJ016
MKHTVEVMISEQTVQERVRELGKQITAHYQGSEDLVLVGLLRGSFVFMADLARAIELTHQVDFMTASSYGNTMESSRDVRILKDLDDDIKGKDVLIVEDIIDTGNTLNKIKEILSLREPKSIEICTLLDKPSRREVPVPVKWIGFEIPDEFVVGVGIDYAQKYRHLPFIGKVVPQE

SEQ ID NO: 22482 - protein, 475 aa, Vibrio vulnificus YJ016
MSKEIKAQVVVLGAGPAGYSAAFRCADLGLDTVLIERYNTLGGVCLNVGCIPSKALLHVAKVIEEAKALAEHGIVFGEPQTDIDKIRLWKEKVINQLTGGLGGMAKMRKVNVVNGFGKFTGPNTIEVEGEDGKTVVNFDNAIVAAGSRPIKLPFIPHEDPRIWDSTDALELKEVPGKLLIMGGGIIGLEMGTVYHSLGSQIDVVEMFDQVIPAADKDIVKVYTKRISKKFNLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGINYEVATFPWAASGRAIASDCADGMTKLIFDKETHRVIGGAIVGTNGGELLGEIGLAIEMGCDAEDIALTIHAHPTLHESVGLAAEVFEGTITDLPNAKAKKKK

SEQ ID NO: 22483 - protein, 316 aa, Vibrio vulnificus YJ016
MENKQIVITEFGGPDVLAIRSSQMPEPKPGQVVIKVYFSGINPIDVKTRAGLGWAAAQNKDKLPWVPGYDISGKVVSCGENAERFVIGDTVAGFVGFPLEGGGYSQYLCVDEDALSLVPGSVTLEGAAVLPLAGQTAAQALNKAQVKEGERVLILAGAGGVGHLAVQIAVAAKAEVYTTCSERNLDYMATLGAHAINYQFAPASERLTDVDVLIDLVGGDVALDALKCLKDNARVVTVPTLSAEMICEKAKLLGFEATGMLVEPDPQQLDTLLYMVGVGLLKTEIQRIYPMHEVSDAHKQIETGHTRGKVLLDMQC

SEQ ID NO: 22484 - protein, 454 aa, Vibrio vulnificus YJ016
MQRLCCRPLNLTFIFEREETLMSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 22485 - protein, 409 aa, Vibrio vulnificus YJ016
MAKVSLEKEKIKILLLEGLHPSSVEVLQAAGYTNIEYHKGSLSDADLLEAVKDAHFIGIRSRTNLTEEVINAAQKLVAIGCFCIGTNQVDLNAAAKRGIPVFNAPFSNTRSVAELVLGQILLLLRGIPEKNALAHRGIWKKSADNSYEARGKRLGIIGYGHIGTQLGIIAENLGMRVYFYDIENKLSLGNATQIPTMSELLNKCDVISLHVPETPDTKNMMGAEEFARMKPGAIFINAARGTVVDIEALCHSLESGHIAGAAIDVFPVEPATNADPFESPLQKFDNVILTPHVGGSTQEAQENIGVEVAGKLAKYSDNGSTLSSVNFPEVSLPEHRSCSRLLHIHQNRPGILTQINTIFAEEGINIAGQYLQTSADIGYVVIDVETERSEEALVKLKEIEGTIRARILH

SEQ ID NO: 22486 - protein, 391 aa, Vibrio vulnificus YJ016
MRGHIMSVIKMTDLDLAGKRVFIRADLNVPVKDGKVTSDARIIASLPTIKLCLEAGAKVMVTSHLGRPTEGEYAEEFSLQPVVNYLNDALDCEVKLAKDYLDGLELNAGELVVLENVRFNKGEKKNDEELSKKYAALCDVFVMDAFGTAHRAQASTHGVGMFAEVACAGPLLAAELEALGKAMSNPERPLVAIVGGSKVSTKLTVLESLSKIADQLVVGGGIANTFIAAEGHNVGKSLYEADLVETAQKLMKECAIPVATDVACAKAFDENAEAEIKHVSEVQDDDMIFDLGPDSTAALAEIIANAKTILWNGPVGVFEFKNFEAGTKGISEAIAQSPAFSVAGGGDTLAAIDKFGIKADVSYISTGGGAFLEFVEGKVLPAVEMLEARAK

SEQ ID NO: 22487 - protein, 311 aa, Vibrio vulnificus YJ016
MVKSVMKPTKELLNEILHEVRPLIGRGKVANYIPALARVPAHKLAIAVYTNQGEVIKAGDADEAFSIQSISKALSLTLAMGLYQPDEIWRRVGKEPSGQAFNSLIQLEMEQGIPRNPFINAGAIVVADLLASRLSAPRQRLLEFVRQLSGETHICYDKVVAASEMMHSDRNAAIAYLMRSFGNFENEVIPVLNNYFHACALKMSCVDLAKTFSYLANKGVSVHTDQRVISPVQTKQLNALLATCGLYDGAGEFAYRVGMPGKSGVGGGIIAIVPGEMTIAVWSPELDPSGNSLAGTKALELLSERIGRSIF

SEQ ID NO: 22488 - protein, 320 aa, Vibrio vulnificus YJ016
MSLPVVVFLDRATIPAHITLPTLAFEHRWVEYDFTSPEQVIERLQAADIVITNKVLLDQAVLAQLPNLRMIAVAATGFNNVDVDFCAEKGIAVANVRGYATRSVPEHVIAMLFALRRNLFGYHQDIAAGVWQQDKQFCFFSHPIGDVAGSTLGIIGSGTLGQATAQLAQALGVKVLFAERKGQSDCRQGYHRFEEVLSQADAISLHCPLSAQTHHLIGAAELASMKSNAILLNTGRGGLVDEQALVEALKKGDIAAAGVDVFSAEPADESNPLLANMHLPNLLLTPHVAWGSDSAITQLCEILLENINAYWRGETLNRLV

SEQ ID NO: 22489 - protein, 388 aa, Vibrio vulnificus YJ016
MSHRKPATIAVRTGIESDTQYRAVVPPIYLSTNYGFSAFGEVPKYDYTRSGNPNRGLLEQVLFELESGKGAVVTNCGTSALNLWVSAFLSPDDLIVAPHDCYGGTYRLFNTRAKKGDFKVRFVDQSDSAALDAALALNPKLVLLETPSNPLVRVVDIAEVCEKAHKVGALVAVDNTFLTPVYQKPLELGADFVIHSTTKYINGHSDVIGGVVITKTEEHATELAWWGNCLGATGTPFDSYMTLRGIRTLGARMRVHEESSQQILSYLQTQELVGAIYHPSLPAHSGHEIAKKQQSGFGSMLSFEFVGSFEQLKVFVKALDLFSLAESLGGVESLVCHPASMTHRAMGEEALAEAGVTQQLLRLSVGLEDAQDLIADLKQAFQQAKESC

SEQ ID NO: 22490 - protein, 173 aa, Vibrio vulnificus YJ016
MEYNTSALCDIYMDQVDVVEPMFSNFGGRASFAGQITTVKCFEDNALIRETLEQDGVGRVLLVDGGGSLRRALLDGELAAIAEENEWEGIVVYGCVREVDELEDMNIGIQALASIPVSAAMQGVGEVDVPVNFGGVTFLPEDYLYADTTGIILSQEPLSADLEEDEEEPELLD

SEQ ID NO: 22491 - protein, 264 aa, Vibrio vulnificus YJ016
MESLMKSVLKVSLLAATVMLAVGCQKEEAKPAAAPQAEQVQAETGKAVHFKSEDDKAAYAIGVSFANYLSASLDKPSEIGINLNKDLVLKGIEHVFAGNPELNEEETRAALEALDKRVAETMQKKAAEKAEAAKKAGDEFRAEFEKQEGVVKTDTGLLYQVITPAEGEKPKDTDTVQVHYKGTLTDGTQFDSSYDRGEPATFPLNRVIPGWTEGVQLMPVGSKFKFVIPPELAYGAQDTPSIPANSTLVFEVELLKIENGDNAQ

SEQ ID NO: 22492 - protein, 403 aa, Vibrio vulnificus YJ016
MTVEMKVERGLFDEVMVPCYNPMEMIPVKGQGSRIWDQNGNEYIDFAGGIAVSCLGHCHPVMVNALTEQAGKLWHLSNVMTNEPALRLAKKLTEVSFAERVFFANSGAEANEAALKLARRYAADVYGPEKSEIIAFKQGFHGRTFFTVTVGGQAAYSDGFGPKPGDVTHLPYNDIEALQAHISDRTCAVMMEPLQGEGGIIPPTAEFIQAVRELCDKHNALLVFDEVQTGNGRTGEFYAYQGLGVTPDILSTAKSLGGGFPIGAMLTTAKLAEHLKVGTHGSTYGGNPLACAVAEAVVTEVSKPETLQGVKEREQWFREGLAKLNEKYQIFAEIRGKGLLLGAALNEQWQGRARDVLVAAGKEGLLVLVAGANVVRFTPSLVITKQEIEEGFAKLDKAIASLV

SEQ ID NO: 22493 - protein, 1188 aa, Pisum sativum
MKPLYSTNTLLLLLALFLLHLGPSHSSSSSSSSTSSSQLLYFKQSLPNPSLLHDWLPYKNPCSFTGITCNQTTVTSIDLTSIPLNTNLTVVATYLLTLDHLQVLTLKSSNITSSPISLSHTKCTSSLTTIDLSQNTISSSFSDLAFLSSCSGLKSLNLSNNQLDFDSPKWTLSSSLRLLDVSDNKISGPGFFPWILNHELEFLSLRGNKVTGETDFSGYTTLRYLDISSNNFTVSIPSFGDCSSLQHLDISANKYFGDITRTLSPCKNLLHLNLSGNQFTGPVPSLPSGSLQFLYLAENHFAGKIPARLADLCSTLVELDLSSNNLTGPVPREFGACTSVTSFDISSNKFAGELPMEVLTEMNSLKELTVAFNEFAGPLPESLSKLTGLESLDLSSNNFSGTIPRWLCGEESGNNLKGLYLQNNVFTGFIPPTLSNCSNLVALDLSFNYLTGTIPPSLGSLSKLRDLIMWLNQLHGEIPQELSNMESLENLILDFNELSGTIPSGLVNCTKLNWISLSNNRLTGEIPSWIGKLSNLAILKLSNNSFSGRIPPELGDCPSLIWLDLNTNFLTGPIPPELGKQSGKVVVNFISGKTYVYIKNDGSKECHGAGSLLEFAGINQEQLRRISTRNPCNFTRVYGGKLQPTFTLNGSMIFLDVSHNMLSGTIPKEIGEMTYLYVLHLSHNNLSGSIPQELGKMKNLNILDLSYNKLQDQIPQTLTRLSLLTEIDFSNNCLSGMIPESGQFDTFPVGKFLNNSGLCGVPLPPCGSDSGGGAGSQHRSHRRQASLAGSVAMGLLFSLFCVFGLIIIAIETRKRRKKKEAAIDGYIDNSHSGNANNSGWKLTSAREALSINLATFEKPLRKLTFADLLAATNGFHNDSLIGSGGFGDVYKAQLKDGSVVAIKKLIHVSGQGDREFTAEMETIGKIKHRNLVPLLGYCKVGEERLLVYEYMKYGSLEDVLHDPKKAGIKMNWSVRRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKRPTDSADFGDNNLVGWVKQHAKLKISDVFDKELMKEDPNLEIELLQHLKVACACLDDRPWRRPTMIQVMAKFKEIQAGSGMDSQSTIATEDEGFNAIEMVEMSIKEVPELIKH

SEQ ID NO: 22494 - protein, 150 aa, Vibrio parahaemolyticus
FQGISAKTDAGEPCCDWVGNDGAGHFVKMVHNGIEYGDMQLITEAYQFMKDGLGMSADEMQAVFAEWNNTELNSYLVEITADILGYKDEDGAPLVEKILDTAGQKGTGKWTGINALDLGIPLTLISESVFSRCLSALKDQRVEAEKLFGK

SEQ ID NO: 22495 - protein, 150 aa, Vibrio parahaemolyticus
FQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKEQRVEAEKLFGK

SEQ ID NO: 22496 - protein, 150 aa, Vibrio parahaemolyticus
FQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKDQRVEAEKLFGK

SEQ ID NO: 22497 - protein, 325 aa, Phalaenopsis cv. 'True Lady'
MESGSFPVINMELLQGSQRPAAMALLRDACENWGFFELLNHGISHELMNRVEAVNKEHYRRFREQRFKEFASKTLDSVENVDPDNLDWESTFFLRHLPTSNISQIPDLDDDCRATMKEFARELEKLAERLLDLLCEDLGLEKGYLKRVFCGGSDGLPTFGTKVSNYPPCPKPDLIKGLRAHTDAGGIILLFQDDKVSGLQLLKDGEWIDVPPLRYSIVVNIGDQLEVITNGKYKSVLHRVVAQTDGNRMSIASFYNPGSDAVIFPAPALVEKEAEEEEKKEIYPKFVFQDYMNLYIRKKFEAKEPRFEAMKSMEIVMSSQPIPTA

SEQ ID NO: 22498 - protein, 440 aa, Davidiella tassiana
MPISKIHSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSAAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYKQLAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKRLYAGDNFRTAINL

SEQ ID NO: 22499 - protein, 358 aa, Sinningia cardinalis
METVAPLAPATTVCVTGAAGYVGSWLVMKLLERGYIVHATVRDPGNIKKVKHLLELPGAKTNLTLWKADMTVNGSFDEAIQGCQGVFHVATPMDFQCKDPENDVIKPTIEGVLSIIRTCAKAKTVRRLVFTSTAGALNVAEQRKSVYDENNWSDLDFIYSKKMTGWMYFASKVLAEKAAWEAAKEYNIDLVSIIPTLVVGQFNTPTFPPSLITALAPITGNESHYWIIKQGQYVHLDDLCEAHIFLFEEPKAEGRYICSSHDATIYDLANMIRDKWPEYNIPTEFEGIDKDIPLVRFSSKKLVEMGFTFKYTFEDMYRGAIETCREKGMLPYSTQICSNGDQEIDLVPSKGIPMIKTK

SEQ ID NO: 22500 - protein, 367 aa, Sinningia cardinalis
MAPSPRVEILASSGNQSIPMEYVRSKEELKSMCTDIFLEEKSNEGPQVPIIDLKAISAEDEDTRKKCHEELKKAAMEWGVMHLINHGVSEEIISRVKIAGKEFFELPVEEKEKYANDQAAGNLHGYGSKLANNANGMLEWEDYFFHCIFPEEKRDFSIWPENPTDYIPSVSQYGKQLRGLATKILSVLSLGLGLEEDRLENEVGGMEELLLQHKINYYPKCPQPELALGVEAHTDISALTFILHNMVPGLQLFYQGKWVTAKCIPNSIIMHIGDTVEILSNGKYKSILHRGSVNKEKVRISWAVFCEPPMEKIVLKPLPETVSQDKPPLFPPCTFAEHVKHKLFRNGSEDAAVDKKSIGDECKEARG

SEQ ID NO: 22501 - protein, 379 aa, Oryza sativa (japonica cultivar-group)
MASSTSDIPEGREKLKRSGSLGSSDTAYVRADKIDLTSLDIQLEKQLTKTWGKANLKAHGPKEDWEIDLAKLEIRYVIAQGTYGTVYRGTYDGQDVAVKLLDWGEDGFATEAETAALRTSFKQEVAVWHKLSHPNVTKFVGASMGTTDLKIPTNNSNAGARTNLPARACCVVVEYLAGGTLKQYLIKNSRRKLAYKVVVQLALDLARGLSYLHSRKIVHRDVKTENMLLDTQRNLKIADFGVARVEAQNPKDMTGATGTLGYMAPEVLDGKPYNRKCDVYSFGICLWEIYCCDMPYPDLSFADVSSAVVHQNLRPDVPRCCPSAFANIMRKCWDANPDKRPDMDEVVQLLEALDTSKGGGMIPDGQSSGCLCFTKARGP

SEQ ID NO: 22502 - protein, 417 aa, Oryza sativa (japonica cultivar-group)
METYTTDEALEFMGFGKFQLLVLAYAGMGWVVESMEIMLLSFVGPLVREEWNISAENESLLSSVVFAGMLIGASGWGFVSDKYGRRICLLFSTLFASGMGFLSAFSPNYSCLLALRFLVGIGVGGAHVFTSWFLEFVPAQNRGTWMVIFSCFWTIGTILEASLAWVVISVLSWRWLLALTALPCSLLIPFFGTTPESPRYLCGQNRTSDAMLVLERIAITNQAALPPGVLIYHQEAKVDHSDLTSEKEDLLPVSEKECTFDNAMSFKYGGGIAALLRLLSRKLLRSTLLLWFAFFANSFAYYGLVLLTAQLSDANRSCTSGQTNVVPQKDVNLYKDTFITSLAEVPGLILSAVLVDWFGRKASMWFMLFTCCAFIGPLVLQQNELLTTVLLFGARAVAMGSFTVLCLYAPEVCINLL

SEQ ID NO: 22503 - protein, 480 aa, Oryza sativa (japonica cultivar-group)
METYTTDEALEFMGFGKFQLLVLAYAGMGWVVESMEIMLLSFVGPLVREEWNISAENESLLSSVVFAGMLIGASGWGFVSDKYGRRICLLFSTLFASGMGFLSAFSPNYSCLLALRFLVGIGVGGAHVFTSWFLEFVPAQNRGTWMVIFSCFWTIGTILEASLAWVVISVLSWRWLLALTALPCSLLIPFFGTTPESPRYLCGQNRTSDAMLVLERIAITNQAALPPGVLIYHQEAKVDHSDLTSEKEDLLPVSEKECTFDNAMSFKYGGGIAALLRLLSRKLLRSTLLLWFAFFANSFAYYGLVLLTAQLSDANRSCTSGQTNVVPQKDVNLYKDTFITSLAEVPGLILSAVLVDWFGRKASMWFMLFTCCAFIGPLVLQQNELLTTVLLFGARAVAMGSFTVLCLYAPEVYPTSARSTGVGIATAIGRIGGVVCPLVAVGMLRSCHQMEAILVFELVLFLAGVACFLFPIETKGRGMD

SEQ ID NO: 22504 - protein, 505 aa, Oryza sativa (japonica cultivar-group)
MTERCDDLIVETREMFVDILNPFAKMKLIDALQRLGVSYHFKEEIDNSLESLVSVKFANDDFHAISLQFRLLRQQRRYMPCDAFKEFIDKQGNLNGTLCSDTRALLALYEAAHLGTPNEEILREAQVETTNQLKRIVDCIEKPLSNKVRHALETPSFRRMKRLEARLYIPLYEEDKEECNEMILELAKLDFYLLQRLHREEVKEICEWYHGLESPRELFYARHRPAEAYFWALGVYYEPEYAKPRKLLAKFIATITPYDDTFDNYGLWKELQPFADVMQRWDEKGAEQLGRCYKEYAQFMFGTMNEIEGALPKGTPRKNVNVIKDIITEVCKGYVTEIDWRDSKYIPPLKEHLQITLVTCFYWAINCTAFVVFQEGVTEEVMIWMSGFPQIVKDSCIVSRLMDDIVAHAFETERNNVATAVTCYMKEYDSTKEEAIKALWNDVENAWKDMNEEYLKLTSIPSSLLIQVINLARMMETMYKKIDGYTDSAILKEWISLLLVQPITL

SEQ ID NO: 22505 - protein, 318 aa, Hevea brasiliensis
MEFPVINLGKLNGEERAATMAKIKDACENWGFFELLNHGIEPEFMDTVERMTKGHYRKCMEQRFKEMVASKGLEGVQTEIKDMDWESTFFLRHLPESNIAQVPDLDDEYRKVMKDFAAKLEKLAEELLDLLCENLGLEKGYLKKAFYGSRGPNFGTKVSNYPPCPKPDLIKGLRAHTDAGGIILLFQDDKVSGLQLLKDGQWIDVPPMRHSIVINLGDQLEVITNGKYKSVEHRVVAQTDGTRMSIASFYNPGNDAVIYPAPALVEKEAEEKKQVYPKFVFEDYMKLYAGLKFQPKEPRFEAMKAVESNVNLGPIATA

SEQ ID NO: 22506 - protein, 129 aa, Nicotiana tabacum
TSLPLPSLWEILLQLGTYFIVEDYFNYWIHRFLHCKWGYENIHKVHHEYTAPIGFAAPYAHWLEILILGIPSAIGPAIAPGHMVTFWLWIALRQIGAIETHSGYDLPWTITKYIPFMSGPDYHDYHHYV

SEQ ID NO: 22507 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQTLADLSSQD

SEQ ID NO: 22508 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANKILGNQVKKAVEGLSDDQLKEVVIAYEPIWAIGTGKSSTSEDANEMCAHVRQTLADLSSQE

SEQ ID NO: 22509 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANKIVGNQVKKAVEGLSDDQLKEVVIAYEPIWAIGTGKSSTSEDANEMCAHVRQTLADLSSQE

SEQ ID NO: 22510 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQALADLSSQE

SEQ ID NO: 22511 - protein, 141 aa, Staphylococcus epidermidis
IGAQNAYFEESGAYTGETSPVALSELGVKYVVIGHSERRDYFHETDEEVNKKAHAIFNHGMTPIICVGESDEEREAGKANEIVGNQVKKAVEGLSDDQLKEVVIAYEPIWAIGTGKSSTSEDANEMCAHVRQTLADLSSQE

SEQ ID NO: 22512 - protein, 481 aa, Borrelia hermsii
MKNLSLFTDFYELSMMNAYFTKNINPKAKFEMFFRKTPFKNGYIILAGIHTLINILKNLHFRKEEIEYLESLEYFDQKIFRILKDHFLNIKISSIEEGRIVFPHEPILIIEGNLIELLLIEGLVLNITINFESLIATKTARIKEAGATNLAEFGLRRAQGINGALSASKAAYIGGADFTSNVLAGYKYNIPVTGTMAHSWVMSFKSEEEAFWEYAKIYPNNVSLLIDTYDTLNSGLKNAIKVFKTLKRKGHKNFSVRIDSGDLEYLSKEVRKILNENGLFEVKIIISNELDEDIIMYLNSIHAPIDCWGVGTNLVTAKGEPNLSGVYKMISIQQNGKFIPKMKISNNVDKATLPSQKGVVRIYSNAQMIFDLIFLKEEKEKIKEMLNLKKKFTIFHPMQDNIFKEIKTYESFEFLIHTVFENSKICQNSKSSLAHIRKRVQSDLKKIDHTYKRLINPHIYKVSIKNLKKLKEQLTKENKIR

SEQ ID NO: 22513 - protein, 347 aa, Camellia sinensis
MAMAMATTTTTTKPMIGAKAACVVGGTGFVAATLVKMLLERGYSVNTTVRDPDNKKNISHLVALEGMGNLKIFRADLTDEQSFDAPIAGCDLVFDVATPVNFASEDPENDMIKLAIQGVLNVLKACAKAGTVKRVILTSSAASVTINQLDGTGLVMDESHWSDVEFLTSVKPPTWGHPVSKTLAEKAAWKFAEENNLNLITVVPTLTAGPSLTSEVPNSIELAMSLITGNEFLIDGLKGMRILSGSISITHVEDVCGAHIFVAEKESASGRYICCGVNSSVPELARFLNKRYPQYNVPTDFGDLPSKAKLIISSEKLIKEGFSFKYGIEEIFAHSVAYLKTKGLLQN

SEQ ID NO: 22514 - protein, 499 aa, Mycoplasma hominis
MKKIILTIIDGLGLRKERQGNAYLQAKHPCFDYLFSMCPNSVLQASGQYVGLPEGQIGNSEVGHLNIGAGRVVYTGLSLINKAIENNTFKDNEILNDVIDKTIKNNTTLHVMGLLSNGGVHSLDLHLFEILKLAHSKGLKNVSVHVFGDGRDVKPQSIKNSLETLKDLCQKFGYKISSISGRFYAMDRDSIFSRNQEAYDAILGQSKNVIENIDDYIESQYKKGIFDEFFEPAQLKDGVFVKNGDSIIFFNFRPDRARQLSHMFIGSNLYTYKPKNQVQIDNFVSLMKYEGINSKIAFKEMEVVNPLGKVLESNDIKQLRLAETQKYAHVTFFFDGGVDIEYKNENRILVDSLKVDSFADYPHMSAKEITDSLLNNIEKNDFIIMNYANPDMVGHTGNLNATIEAIEFLDSQFQRILEYVSLNHENVTWFITADHGNAEITEDENNKPATKHTTSPVMFICTDKNVNLGNGSLCDVAPTILDYLKINKPKEMTGKSLLK

SEQ ID NO: 22515 - protein, 198 aa, Oryza eichingeri
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 22516 - protein, 198 aa, Oryza eichingeri
GQTPVFPRIFGHEAGGIVESVGEGVTDLAPGDHVLPVFTGECKECPHCKSAESNMCDLLRINTDRGVMIGDGKSRFSVNGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 22517 - protein, 198 aa, Oryza eichingeri
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAADGARIAGASRIIGIDLNANRFEEARKFGCTEFVNPKDHDKPVQQ

SEQ ID NO: 22518 - protein, 198 aa, Oryza alta
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKISPAAPLDKVCVLSCGISTGLGGTINVAKPPKGSTVAIFGLGAVGLAAAEGARIAGASRIIGIDLNANRFEEARKFGCTEFVNPKDHDKPVQQ

SEQ ID NO: 22519 - protein, 195 aa, Oryza latifolia
GQTPVFPRIFGHEAGGIVESVGEGVTDLAPGDHVLPVFTGECKECPHCKSAESNMCDLLRINTDRGVMIGDGKSRFSINGKPIYHFVGTSTFSKYTVMHVGCVAKINPAAPLDKVCVLSCGISTGLGATINVAKPPKGSTVAIFGLGAVGLAAAEGARIAGASRIIGIDLNANRFEEARNFGCTEFVNPKDHDKP

SEQ ID NO: 22520 - protein, 198 aa, Oryza latifolia
GQTPMFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 22521 - protein, 195 aa, Oryza officinalis
GQTPVFPRILGHEAGGIVESVGEGVSDLAPGDHVLPVFTGECKECAHCKSEESNMCNLLRINVDRGVMIGDGQSRFTIKGKPIFHFVGTSTFSEYTVIHVGCLAKINPEAPLDKVCILSCGISTGLGATVNVAKPKKGQTVAIFGLGAVGLAAMEGARLSGASRIIGVDLNPAKFEQAKKFGCTDFVNPKDHSKP

SEQ ID NO: 22522 - protein, 195 aa, Oryza eichingeri
GQTPVFPRILGHEAGGIVESVGEGVSDLAPGDHVLPVFTGECKECAHCKSEESNMCDLLRINVDRGVMIGDGQSRFTIKGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKP

SEQ ID NO: 22523 - protein, 195 aa, Oryza alta
GQTPVFPRILGHEAGGIVESVGEGVTELAPGDHVLPVFTGECKECAHCKSEESNMCDLLRINVDRGVMIGDGQSRFTIKGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKP

SEQ ID NO: 22524 - protein, 195 aa, Oryza alta
GQTPVFPRILGHEAGGIVESVGEGVIELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKP

SEQ ID NO: 22525 - protein, 195 aa, Oryza latifolia
GQTPVFPRILGHEAGGVVESVGEGVTELAPGDHVLPVFTGECKECAHCKSEESNMCDLLRINVDRGVMIGDGQPRFTIKGKPIFHFVGTSTFSEYTVIHVGCLAKINPEAPLDKVCILSRGISTGLGATLNVAKPKKGQTVAIFGLGAVGLAAMEGARLSGASRIIGVDLNPAKFEQAKKFGCTDFVNPKDHSKP

SEQ ID NO: 22526 - protein, 195 aa, Oryza latifolia
GQTPVFPRILGHEAGGIVESVGEGVIELAPGDHVLPVFTGECKECAHCKSEESNMCDLLRINVDRGVMIGDGQSRFTINGKPIFHFVGTSTFSEYTVIHVGCLARINPEAPLDKVCILSCGISTGIGATLNVAKPKKGQTVAIFGLGAVGLAAMEGARLSGASRIIGVDLNPAKFEQAKKFGCTDFVNPKDHSKP

SEQ ID NO: 22527 - protein, 162 aa, Moraxella catarrhalis
MYAEDTKNIVEIKDIIAREILDSRGNPTIEADVILANGIRGRAAAPSGASTGSREALELRDGDTSRYLGKGVKKAVANANSQIRTVLLDKDVTQQTQIDNILIELDGTENKGNMGANAMLAVSLAVAKAAAIAQSLPLHQYIANLRGQTSLTMPVPMMNILN

SEQ ID NO: 22528 - protein, 188 aa, Arabidopsis thaliana
MGVFSNLRGPRAGATHDEFPATNGSPSSSSSPSSSIKRKLSNLLPLCVALVVIAEIGFLGRLDKVALVDTLTDFFTQSPSLSQSPPARSDRKKIGLFTDRSCEEWLMREDSVTYSRDFTKDPIFISGGEEDFQWCSVDCTFGDSSGKTPDAAFGLGQKPGTLSIIRSMESAQYCPENDLAQARRWERL

SEQ ID NO: 22529 - protein, 505 aa, Hordeum vulgare subsp. vulgare
MAGNMLANYVQVYVMLPLDVVSVDNKFEKGDEIRAHVKKLTEAGVDGVMIYFWWGLVEGIGPKAYHWTPYNHVFYLVHDARLQLQAIMSFHQCGGNVGDLFNIPIPQWVRDVGATDPDIFYTNRRGTRNIDYLTLGVDDQPLFHGRTAVQMYHDYMASFRENMKKFLDAGTIVDIEVGLGPAGEMRYPSYPQSQGWVFPGIGEFICYDKYLEADFKAAAAKAGHPEWELPDDAGEYNDTPEKTQFFKENGTYLTEKGKFFLSWYSNKLIKHGDKILDEANKVFLGCRVHLAIKISGIHWWYRVPNHAAELTAGYYNLDDRDGYRTIARMLTRHHASMNFTCAEMRDSEQSEEAKSAPEELVQQVLSAGWREGLHVACENALSRYDATAYNTILRNARPKGINENGPPEHKLFGFTYLRLSNELLKGQNYATFQTFVEKMHANLAHNPSVDPVAPLEKSKPEMPIELILKAAQPKLEPFPFDKNTDLPVKNHTDVVDEALLAPVAV

SEQ ID NO: 22530 - protein, 154 aa, Acidaminococcus fermentans
IPLINIVDVPGFLPGTDQEYGGIIRHGAKMLYAYCEATVPKITLVTRKAYGGAYLAMCAQDLGADHVIAWPTAEIAVMGPQGAAKIIFRKDPDVEQKTQEYITNFATPYYAAKHGMVEMVIEPKTTRPILIKALRMLKSKQEDRPTKKHGNIPL

SEQ ID NO: 22531 - protein, 148 aa, Oryza sativa
  misc_feature (139)..(139): Xaa can be any naturally occurring amino acid
  misc_feature (144)..(145): Xaa can be any naturally occurring amino acid
LSILAFKNKDNLGGDKLVTVEDIVRQHWGTYGRHYYTRYDYENVDAGAAKELMANLVSMQSSLSDVNKLIKEIRSDVSDVVAADEFEYKDPVDGSVSKHQGVRYLFGDGSRLVFRLSGTGSVGATIRVYIEQYDKDSSXTGRDXXGCP

SEQ ID NO: 22532 - protein, 300 aa, Chlamydomonas reinhardtii
MSLEVQSKYDRGYQDEGQGLVELGTAHDAVPKTTAQPKYGDDDDLLPVVLERYLEKAGVMQKLRPYLDPSGQVKNEFARCLMAEFFGTLLFQMFGGSAPAKDTTAPAANGFALVAVIYAFANISGAHINPAVTFALICTGHMKWWKGLLYMIAQILGAIFGALIYAALIPALHLGAGAGSPGCFSPTAGVKNGDVFGWEVMMTFLLVMTVYAAAVAKPGHGNTAPLAIGLSLYAAAISGGPYTGASLNPARTIGPAVVFTCNVGVSFLYIFAEFFGAACAAGLSIFLYGRAPDSVRRPAI

SEQ ID NO: 22533 - protein, 383 aa, Cryptococcus neoformans var. grubii
MSTEGQVITCKAAIAWEAGKPLSIETVEVAPPKDGEVRIKILYTGLCHTDAYTLSGNDPEGAFPVILGHEGGGIVESVGKGVDEVKVGDHVVPLYTAECRECKFCKSGKTNLCGRVRATQGKGVMPDGTSRFKCKGQDILHFMGCSTFSQYTVVSKFSVVAINPKAPLKTSCLLGCGITTGYGSATKSPGIEGSNVAIFGVGCVGLSVLQGAKAKGCKRIFAIDTNPKKKEWAEKFGATDFVNPKDLPEGKTIVDYLIEETDGGLDFTFDATGNVGVMRNALEACHKGWGVCNIIGVAPAGAEISTRPFQLVTGRVWKGTAFGGVKGRTELPGIVEDYLAGKLWVNEFVTHNETLEGINKGFDDMHAGDCIRCVVDMGFNEAP

SEQ ID NO: 22534 - protein, 348 aa, Kluyveromyces wickerhamii
MSIPKTQKAVVFYKHGGALEYKEIPVPTPKANEILINVKYSGVCHTDLHAWQGDWPLDTKLPLVGGHEGAGVVVALGANVKGWKIGDFAGIKWLNGSCMACEYCELSNEPNCPEADLSGYTHDGSFQEYATADAVQAARIPAGTDLAAVAPILCAGVTVYKALKSAHLKAGDWVAISGACGGLGSLAIQYANAMGYRVIGIDAGEEKAALFKELGGEYFVDFIKSKDVIKEINDVTKGGAHGVINVSVSENAIEDSTKYVRSNGTVVLVGLPKGAQAKSDVFSQVVKSISIVGSYVGNRADTREALDFFSRGLVHAPIKIVGLSELASIYDKMSKSQVVGRYVVDTSK

SEQ ID NO: 22535 - protein, 371 aa, Kluyveromyces wickerhamii
MLRLTQTKTISPLRAAIGSIRTMASVPETQKGVIFYENGGKLEYKDIPVPVPKPNEILINVKYSGVCHTDLHAWKGDWPLATKLPLVGGHEGAGVVVGMGSNVKGWKIGDLAGIKWLNGSCMSCELCEQGFESNCAHADLSGYTHDGSFQQYATADAVQAAQIPKGTDLAEVSPILCAGVTVYKALKSANLKAGDWVAISGAAGGLGSLAVQYAKAMGYRVLGIDGGADKGKLVKELGGEVFIDFTKSKDMVADIQEATNGGPHGVINVSVSEGAINASTQYVRPTGTVVLVGLPAGAVIKSEVFSHVVKSINIKGSYVGNRADTREAIDFFVNGKVKSPIHVVGLSELPSVYELMEQGKILGRYVVDTSK

SEQ ID NO: 22536 - protein, 374 aa, Kluyveromyces wickerhamii
MFRLARAQSSIANKSVARHFLRLNSTYAIPETQKGVIFYENGGELHYKDLPVPVPKPNEILINVKYSGVCHTDLHAWKGDWPLAVKLPLVGGHEGAGIVVAKGENVTNFEIGDLAGIKWLNGSCMSCELCEQGYESNCLKADLSGYTHDGSFQQYATADAVQAAQIPKGTDLAEIAPILCAGVTVYKALKTADLKPGQWVAISGAAGGLGSLAVQYAKAMGLRVLGIDGGDGKEELFKKCGGEVFIDFRKSKNMVADIQEATNGGPHGVINVSVSEAAISMSTEYVRPTGTVVLVGLPANAYVKSEVFSHVVKSISIKGSYVGNRADTREAIDFFTRGLVKSPIKVIGLSELPEAYELMEQGKILGRFVVDTYK

SEQ ID NO: 22537 - protein, 348 aa, Saccharomyces bayanus
MSIPKTQKGVIFYESHGKLEYKDIPVPTPKANELLINVKYSGVCHTDLHAWHGDWPLPVKLPLVGGHEGAGVVVAMGENVKGWNIGDYAGIKWLNGSCMACEYCELGNESNCPHADLSGYTHDGSFQQYATADSVQAAHIPKGTDLAECAPVLCAGITVYKALKSANLSAGQWVAISGAAGGLGSLAVQYAKAMGYRVVGIDGGEGKEELFRSIGGEVFIDFTTEKDIVGAVIKATDGGAHGIINVSVSEAAIEASTRYCRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 22538 - protein, 348 aa, Saccharomyces bayanus
MSIPKTQKGVIFYESNGKLEHKDIPVPTPKPNELLINVKYSGVCHTDLHAWHGDWPLATKLPLVGGHEGAGVVVAMGENVRGWKVGDLAGIKWLNSSCMACEYCELGNESNCPHADLSGYTHDGSFQQYATADAVQAVHIPEGTDLAEVAPILCAGITVYKALKSANLRAGHWVAISGAAGGLGSLAVQYAKAMGYRVVGIDGGPGKEELFTSLGGEVFIDFTKEKDIVGAVIKATDGGAHGIVNVSVSEAAIEASTRYCRANGTVVLVGLPAGAKCTSDVFNHVVKSISIVGSYVGNRADTREALDFFARGLVKSPIKVVGLSHLPEIYEKMEKGQIAGRYVVDTYK

SEQ ID NO: 22539 - protein, 375 aa, Saccharomyces bayanus
MLRTSTLFTRRVQPSLFARNILRLQSTIAIPQTQKGVIFYENNGKLHYKDIPVPEPKPNEILINVKYSGVCHTDLHAWHGDWPLPVKLPLVGGHEGAGVVVKLGSNVKGWKVGDLAGIKWLNGSCMTCEFCESGHESNCPDADLSGYTHDGSFQQFATADAIQAAKIQQGTDLAEVAPILCAGVTVYKALKEANLKAGDWVAISGAAGGLGSLAVQYATAMGYRVLGIDAGAEKEKLFKQLGGEVFIDFTKTKDMVSDIQEATKGGPQGVINVSVSEAAISLSTEYVRPTGTVVLVGLPANAYVKSEVFSHVIKSINIKGSYVGNRADTREALDFFSRGLIKSPIKIVGLSELPMVYDLMEKGKILGRYVVDTSK

SEQ ID NO: 22540 - protein, 351 aa, Saccharomyces bayanus
MSSQAIPESQKAIVFYETNGKLEYKDIAVPEPKANEILVHVKYSGVCHSDLHAWRGDWPFQLKFPLIGGHEGAGVVVKLGSNVKGWKVGDLAGIKWLNGTCMSCEYCEVGNESQCPHLDGTGFTHDGTFQEYATADAVQAAHLPENVDLAEVAPILCAGVTVYKALKRANLIPGQWVTISGACGGLGSLAIQYATAMGYRVIGIDEGETKKQLFEGLGGEVFIDFTKEKDIVGAVIKATDGGSHGVINVSVSEAAIEASTRYCRPNGTVVLVGMPAHAYCKSDVFNQVVKSISIVGSCVGNRADTREALDFFARGLIKSPIHLASLSDVPEIFEKMEKGEIVGRYVIDTSK

SEQ ID NO: 22541 - protein, 351 aa, Saccharomyces kluyveri
MSAPQIPETQKAVIFYENGGELQYKDIPVPKPKSNEILINIKYSGVCHTDLHAWKGDWPLPTKLPLVGGHEGAGIVVGMGENVKGWKIGDYAGIKWLNGSCMSCEYCELSNESNCPDADLSGYTHDGSFQQYATADAVQAARIAPGTDLAEVAPVLCAGITVYKALKSANLRAGEWVAISGACGGLGSLAIQYAKAMGYRVLGIDGGDEKAALFKELGGEVFIDFTKTKDVVKAVVDATNGGAHGVINVSVSEAAIEASTVYCRANGTVVLVGLPGGAKCKSDVFNQVVKSISIVGSYVGNRADTREALDFFSRGLVKSPIMIVGLSELPSIYEKMEKGAIVGRYVVDTSK

SEQ ID NO: 22542 - protein, 351 aa, Saccharomyces kluyveri
MSASQIPETQKAVIFYENGGELQYKDIPVPKPKSNEILINVKYSGVCHTDLHAWKGDWPLPTKLPLVGGHEGAGVVVAIGENVKGWKIGDYAGIKWLNGSCMACEYCELSNESNCPEADLSGYTHDGSFQQYATADAVQAARIPAGTDLAEVAPVLCAGITVYKALKSANLRAGEWVAISGACGGLGSLAIQYAKAMGYRVLGIDGGDEKAALFNELGGEVFIDFTKTKDVTKAVIDATNGGAHGVINVSVSEAAIEASTVYCRANGTVVLVGLPGGAKCKSDVFNQVVKSTTIVGSYVGNRADTREALDFFARGLVKSPIKVVGLSELPSIYEKMQKGAIVGRYVVDTSK

SEQ ID NO: 22543 - protein, 373 aa, Saccharomyces kluyveri
MLRLSTRASLTARPFFQGSFRTMATASIPEKQKGIIFYENGGELKYEDIPVPKPKPNELLINVKYSGVCHTDLHAWKGDWPLPTKLPLVGGHEGAGVVVAMGENVKGWKIGDLAGIKWLNGSCLSCEYCEKSNESNCPHADLSGYTHDGSFQQYATADYVQAARIPEGTDLAEVSPILCAGVTVYKALKSANLKAGDWVAISGAAGGLGSLAVQYAKAMGYRVLGIDGGAEKGELVKKLGGEVFIDFTKHKNLVEAVQEATNGGPHGVINVSVSEAAMTASTQFVRPTGTVVLVGLPAGAVIKSEVFSHVVKSINIKGSYVGNRADTREAVDFFVRGMVKSPIHVVGLSELPKVYELMEKGKILGRYVVDTAK

SEQ ID NO: 22544 - protein, 377 aa, Saccharomyces kluyveri
MFRLARLQNTATSARSLASSFIRFNSTVAPAIPTTQKGVIFYESGGKLEYKDIPVPKPKPNEILINVKYSGVCHTDLHAWKGDWPLPTKLPLVGGHEGAGVVVAKGENVMNFEIGDLAGIKWLNGSCMACELCEQGHESNCLHADLSGYTHDGSFQQYATADAVQAAQIPKGTDLAEVAPILCAGVTVYKALKTADLRPGQWVAISGAAGGLGSLAVQYAKAMGLRILGIDGGPGKEELFKSLGGEVFIDFTKTKDIVSAIQEATKGGPHGVINVSVSEAAISTSTQYVRPTGTVVLVGLPANAYVKSEVFSHVVKSINIKGSYVGNRADTREALDFFTRGLVKSPIKIVGLSELPEVYGLMEKGKILGRYVVDTAK

SEQ ID NO: 22545 - protein, 348 aa, Saccharomyces pastorianus
MSIPKTQKGVIFYESHGKLEYKDIPVPKPKANELLINVKYSGVCHTDLHAWHGDWPLPTKLPLVGGHEGAGVVVAMGENVKGWNIGDFAGIKWLNGSCMACEYCELGNESNCPHADLSGYTHDGSFQQYATADAVQAAHVAPGTDLAEVAPVLCAGITVYKALKSANLMAGHWVAISGAAGGLGSLAVQYAKAMGYRVIGIDGGEGKEELFRSIGGEVFVDFTKEKDIVGAVLKATNGGAHGVINVSVSEAAIEASTRYVRANGTTVLVGMPANAKCCSDVFNQVVKSISIVGSYVGNRADTREALDFFSRGLVKSPIKVVGLSTLPEIYEKMEKGQIVGRYVVDTSK

SEQ ID NO: 22546 - protein, 348 aa, Saccharomyces pastorianus
MSIPETQKAIIFYESNGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQEYATADAVQAAHIPQGTDLAEVAPVLCAGITVYKALKSANLRAGHWVAISGAAGGLGSLAVQYAKAMGYRVLGIDGGPGKEELFTSLGGEVFIDFTKEKDIVSAVVKATNGGAHGIINVSVSEAAIEASTRYCRANGTVVLVGLPAGAKCSSDVFNHVVKSISIVGSYVGNRADTREALDFFARGLVKSPIKVVGLSSLPEIYEKMEKGQIAGRYVVDTSK

SEQ ID NO: 22547 - protein, 375 aa, Saccharomyces pastorianus
MLRTSTLLTRRVHPSLFSRNILRLQSTAAIPKTQKGVIFYENNGKLHYKDIPVPQPKPNEILINVKYSGVCHTDLHAWHGDWPLAVKLPLVGGHEGAGVVVKLGSNVKGWKVGDLAGIKWLNGSCMTCEFCESGHESNCPEADLSGYTHDGSFQQFATADAIQAAKIQPGTDLAEVAPILCAGVTVYKALKEANLKAGDWVAISGAAGGLGSLAVQYATAMGYRVLGIDAGEEKEKLFKRLGGEVFIDFTKTKDMVSDIQEATKGGPHGVINVSVSEAAISLSTEYVRPTGTVVLVGLPANSYVKSEVFSHVVKSINIKGSYVGNRADTREALDFFTRGLIKSPIKIVGLSELPKVYDLMEQGKILGRYVVDTNK

SEQ ID NO: 22548 - protein, 482 aa, Escherichia coli
MSDVPLIAVVMAGGTGSRLWPLSREHYPKQFLQLSGESSLLQSTLLRLSTLSCETPLVITNEQHRFVVAEQLRQIDQLRDNIILEPCGRNTAPAIALSAFTALKRNEQQDPILLILAADHIISKADVFCDAIQKSKTVAEQGNIVTFGIIPEYAETGYGYIKKGDPFKILPNITHDKFYHVQQFIEKPNHSTAEEYVSTGEYLWNSGMFMFKASVYLEELKKHRPDIYEICEQTASLSYNDLDFIRLPKHIFQDCPSESIDFAVMEKTKNCIVRPVDIGWSDVGSWHSLWDISDKTQDGDVCKGDILTYNTKNNYIYSESALVAAVGVEDIVIVQTKDAILVSKKTEVQDVKKIVEMLKEQERSEYISHREEFRPWGKFDAIDQGERYKVKKIVVKPGEGVSLRMHHHRSEHWIVLSGTAKVTLNDKTVLLAANESIYIPLGATYSLENPGIIPLNLIEVSSGDYLGEDDIVRQKERYRIDD

SEQ ID NO: 22549 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 22550 - protein, 511 aa, Manihot esculenta
MSVAILTSLPPQWLSILAVFLLPILTLLLFRGKDDNQKKGLKLPPGPRQLPLIGNLHQLGGQPYVDFWKMAKKYGPVMYLQLGRCPTVVLSSTETSKELMKDRDVECCSRPLSVGPGQLSYNFLDVAFSPYSDYWREMRKLFIFELLSMRRVQTFWYAREEQMDKMIEILDGAYPNPVNLTEKVFNMMDGIIGTIAFGRTTYAQQEFRDGFVKVLAATMDMLDNFHAENFFPVVGRFIDSLTGALAKRQRTFTDVDRYFEKVIEQHLDPNRPKPETEDIVDVLIGLMKDESTSFKITKDHVKAILMNVFVGGIDTSAVTITWAFSELLKNPKLMKKAQEEVRRAVGPNKRRVEGKEVEKIKYIDCIVKETFRKHPPVPLLVPHFSMKHCKIGGYDILPGTTIYVNAWAMGKDPTIWENPEEYNPDRFMNSEVDFRGSDFELVPFGAGRRICPGLAMGTTAVKYILSNLLYGWDYEMPRGKKFEDFPLIEEGGLTVHNKQDIMVIPKKHKWD

SEQ ID NO: 22551 - protein, 287 aa, Streptomyces peucetius
MTASTPHHGTPRGGLSGRTVLVTGATSGIGRAAALAVARQGARVVLVGRDPERLRTVTNEVARTAGPAPDAFRADFAELRQVRDLGERLRDRYPRIDVMASNAGGMFWSRTTTQDGFEATIQVNHLAGFLLARLLRERLAGGRLILTSSDAYTQGRIDPDDLNGDRHRYSAGQAYGTSKQANIMTAAEAARRWPDVLAVSYHPGEVRTRIGRGTVASSYFRFNPFLRSAAKGADTLVWLASAPAEELTTGGYYSDRRLSPVSGPTADAGLAAKLWEAGAAAVGDTAH

SEQ ID NO: 22552 - protein, 195 aa, Brassica juncea
MGEAVKDGREEVIQAWYMDDSQEDQRLPHHKDPKEFISLDKLAELGVLSWRLDADHYETDEELKKIRESRGYSYMDFCEVCPEKLPNYEEKVKSFFEEHLHTDEEIRYCVAGSGYFDVRDRNEAWIRVWVKKGGMIVLPAGIYHRFTVDSENYIKAMRLFVGEPVWTPYNRPHDHLPARKEYVDNFVKKAINASA

SEQ ID NO: 22553 - protein, 318 aa, Cucumis sativus
  misc_feature (125)..(125): Xaa can be any naturally occurring amino acid
MDFPVINMNNLNGESRVSFLNQINDVCENWGFFELVNHGIPHELMDKVEKMTKEHYRKCMEQRFKEMVASKGLDSVETEINDTDWESTFFLRHLPVSNMSEIGDLDEEYKKVMKEFAAELEKLAXEILNLLCENLGLEKGYLKKVFYGSKGPNFGTKVSNYPPCPKPELIKGLRAHTDAGGLILLFQDDKVSGLQLLKDGKWVDVPPMHHSIVINLGDQLEVITNGKYKSVMHRVIAQEDGNRMSIASFYNPGNDAVIYPAPALVEGEQEKTKLYPKFVFDDYMKLYMGLKFQAKEPRFEAMKAMESTNINMGPIATV

SEQ ID NO: 22554 - protein, 255 aa, Euglena gracilis
MPRKFFVGGNWKCNGTRESISKIIEEFNKGPSVADADVEVVIGCPFVYADYTREKLRQDWALSVQNCWIGKGGAFTGEISAEMIKDAGIPWVILGHSERRHLPELKESDETVAIKVAYALANGLKVMACIGELLEEREGGQTQAVNERQLKAIAAKLKEEDWKNVVIAYEPVWAIGTGKVATPEQAQEVHEQVRAWVASNVSPSVAAEVRILYGGSVTAKNSAELAGKPDVDGFLVGGASLKPEFLDIVAAYKHK

SEQ ID NO: 22555 - protein, 261 aa, Lactobacillus plantarum
MVKVIVAGYKGRMGSTAAQMVIDNPDFELVGVYDARSGEQNLGEDDRFKGQDVPAFHDLDQIKTDATVWIDFTIPTAVYENAKFALNHGISPVIGTTGMTDEQVAELQKLAKDKQVGGLIAPNFGISAVLLMQFAQQAAKYFPDVEIIEMHHDDKIDSPSGTAISTAKKIAEVRQPKEQGNPDATETLPGARGAEYEGMRIHAVRLPGLVAHEEVMFGGPGEGLTIRQDSFDRISFMTGVKVAVEKVNQYHELFVGLEHLL

SEQ ID NO: 22556 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSQGGFIFREHGSTPGYYDGRYWTMWKLPMFGCTDASQVIKEVEEVKKEYPDAYVRIIGFDNIRQVQCVSFIAFKPPGCEESG

SEQ ID NO: 22557 - protein, 379 aa, Eutreptia viridis
IGHVDHGKTTLTAAISMTLASINNSKAKRYEDIDSSPEEKARGITINTTHVEYETENRHYAHVDCPGHADYVKNMITGAAQMDGAILVVSGADGPMPQTKEHILLAKQVGVPNIVVFLNKEDQVDDEELLELVELEIRETLNNYEFPGDEIPIIAGSALLSVQALTENPKIKKGENKWVDKILLLMENVDNYIPTPTRDTDKDFLMAIEDVFSITGRGTVATGRVERGIVKVGETVELVGLKDTRSTIVTGLEMFQKSLDEALAGDNIGILLRGVQKTDIERGMVLVKPKTINPHTKFDSQVYILTKEEGGRHTPFFEGYRPQFYVRTTDVTGKIESFRADDDSPAQMVMPGDRIKMEVELIQPIAIEKGMRFAIREGG

SEQ ID NO: 22558 - protein, 329 aa, Schizosaccharomyces pombe
MSNLLVQVSKTGPSSVLQVITKEIPKPAPNGLVIKNAYAGLNYIDTYLRTGLYTAPLPYIPGKEAAGVVAAVGDKVEADFKVGDRVVYLTPFGAYAQYTNVPTTLVSKVSEKIPLKIASAALLQGLTAYTLIEEAYPVKTGDTVVVHAAAGGVGLLLCQMLRARNVHVIATASTAAKRRIAIKNGAEIACSYEDLTKVVADYTNGKGVDAAYDSVGIDTLSSSLDALRNGGTMVSFGNASGAIDAIPLKFLSARCLKFVRPSLFGYITGHAVFEGYVSRLWKEILDNNLNIAIHHIFKLSEAKEAHDAIESRATTGKLLLLCNEDLADA

SEQ ID NO: 22559 - protein, 470 aa, Alonsoa unilabiata
SVGFKAGVKEYKLTYYTPDYETKDTDILAAFRVTPQPGVPPEEAGAAVAAESSTGTWTTVWTDGLTSLDRYKGRCYHIEPVPGEADQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAIFARELGVPMVMHDYLTGGFTANTSLSHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLATEGNAIIREACKWSPELAAACEVWKEIKFEFKAVDTLDKEG

SEQ ID NO: 22560 - protein, 219 aa, Capsicum annuum
MADQYEHNKPSVEETTTGANVESTDRGLFDFLGKKEEEKPTHAHEEQAISSEFGEKVKVGEEEHKEEEKKKEEKKLHRSSSSSSSSSDEEEEVVGEDGQKIKKKKKKGLKDKMKDKISGDHKEEDKKTEDTSVPVEKYEETEEKKGFLDKIKDKLPGGGQKKTEEAAAPPSPPPPPAVAEHEAEGKEKKGFLDKIKEKLPGYHSKTEEEKEKEKEAASH

SEQ ID NO: 22561 - protein, 259 aa, Vitis vinifera
WVEEHRQNRLSANDNGAEQDFIHAMLSVIDDGQFSGHDPDTIIKGTCSNLILAGNDTTSITLTWALSLLLNNRHALKKAQAELEIHVGKHRQVDGSDIKNLVYLQAIVKETLRLYPPGPLSLPHEAMEDCTVAGFHIQAGTRLLVNLWKLHRDPRVWLDPLEFQPERFLTKHAGLDVRGKNYELLPFGSGRRVCPGISFALELTHLTLARLLHGFELGAVADSPVDMTESPGLTAPKATPLEVTIVPRLPFELYSYEAA

SEQ ID NO: 22562 - protein, 357 aa, Trichoderma atroviride
MAEFVRAQIFGTTFEITSRYSDLQPVGMGAFGLVCSARDQLTNQNVAVKKLMKPFSTPVLAKRTYRELKLFKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTAYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALAHDYLAPYHDPTDEPVAEEKFDWSFNDADLPVDTWKIMMYSEILDYHNVEGVPQMEDQQFPPQ

SEQ ID NO: 22563 - protein, 475 aa, Acanthorrhynchium papillatum
MSPQTETRASVGFKAGVKDYRLNYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFVAEAIYKSQGETGEIKGHYLNATAGTSEEMLKRAQFARELGMPIIMHDYLTGGFTANTTLAHYARDNGLLLHIHRAMHAVIDRQKIHGMHFRVLAKALRLSGGDHIHAGTVVGKLEGERQVTLGFVDLPRDDYIEKDRSRGIYFTQDWVSLPGILPVASGGIHVWHMPALTEIFGDDSVLQFGGGTLGHPWGNAPGAVANRVAVEACVQARNEGRDLAREGNEIIREAAKWSPELAAACEVWKEIKFEFETIDTV

SEQ ID NO: 22564 - protein, 383 aa, uncultured marine proteobacterium ANT8C10
MILNKDHIAIADTVRSFIEKEINPYTDEWEKEGIFPAHELFKKMGNLGLLGISREERFGGMGLDYSYETVFSEELGLISSGGVAMAIGVQTNMATPSLSLHGSDELRRDFLMPAISGDMVCSIAVSEPSAGSDVSAIKTTAKKDGDDYIINGTKMWITNSTQADFICLLANTGEGNPHSNKSLIIVPMNLPGISLSERFNKLGMRSSDTAQIFFDDVRVPQRYLIGEEGKGFRYQMEQFQEERIYGAAGALKMLGQVIQDTIEYTSQRQAFGKSILDNQVVHFRLAELQTEVEALRSLVYDAVEGYINGQDVTMKASMAKLKAGRLGREVTDSCLQYWGGMGYMWDTPVSRAFRDGRLTSIGGGADEIMLGIICKHMGTLPKR

SEQ ID NO: 22565 - protein, 309 aa, uncultured marine proteobacterium ANT8C10
MLGLPMTGKITKNIKKNKSMNKIGFIGLGVMGYPMAGHLSKEFSNICIFNRSQEKVTKWLNQYSGTAFDTPEELSSQCNVIALCVGRDEDVREMMSGEKGILNSVNPGTIIIDHTTTSATLSKEMNELALQKDVIFLDAPISGGQAGAESGQLSVMVGGDKASYESVKPILDNYSKFTKYMGPSGSGQLTKMVNQICIAGLVQALSEGVNFSEKVGLNTSDVMEVITKGAAQSWQMENRWETMLKDEYDHGFAVDWMRKDLDIVSEQAGQVGANIEITEMVNKFYKDIQDLDGGRWDTSSLLKRIKDST

SEQ ID NO: 22566 - protein, 383 aa, uncultured marine proteobacterium ANT32C12
MILNKDHIAIADTVRSFIEKEINPYTDEWEKEGIFPAHELFKKMGNLGLLGISREERFGGMGLDYSYETVFSEELGLISSGGVAMAIGVQTNMATPSLSLHGSDELRRDFLMPAISGDMVCSIAVSEPSAGSDVSAIKTTAKKDGDDYVINGTKMWITNSTQADFICLLANTGEGNPHSNKSLIIVPMNLPGISLSERFNKLGMRSSDTAQIFFDDVRVPQRYLIGEEGKGFRYQMEQFQEERIYGAAGALKMLGQVIQDTIEYTSQRQAFGKSILDNQVVHFRLAELQTEVEALRSLVYDAVEGYINGQDVTMKASMAKLKAGRLGREVTDSCLQYWGGMGYMWDTPVSRAFRDGRLTSIGGGADEIMLGIICKHMGTLPKR

SEQ ID NO: 22567 - protein, 309 aa, uncultured marine proteobacterium ANT32C12
MLELPMTGKITKNIKKNKSMNKIGFIGLGVMGYPMAGHLSKEFSNICIFNRSQEKVTKWLNQYSGTAFDTPEELSSQCNVIALCVGRDEDVREMMSGKKGILNSVNPGTIIIDHTTTSATLSKEMNELALQKDVIFLDAPISGGQAGAESGQLSVMVGGDKASYESVKPILDNYSKFTKYMGPSGSGQLTKMVNQICIAGLVQALAEGVNFSEKVGLNTSDVMEVITKGAAQSWQMENRWETMLKDEYDHGFAVDWMRKDLDIVSEQAGQVGANIEITEMVNKFYKDIQDLDGGRWDTSSLLKRIKDST

SEQ ID NO: 22568 - protein, 351 aa, uncultured marine gamma proteobacterium EB000-45B06
MKSYQVFENAQPIKEVELDTPIPEGDEVLIKTIACGVCHTDIHIHDGFFDIGNGKKMTSRMVQPLAMGHEVFGEVVSFGENVKNIEVGKKFVVYPWIGCGECEPCKADNEHECGPLTAENIGVAVDGGYGEYVLVKHSKYLFDAGNTPDDLAGSYACRGLTAYSSLKKANLKPNENKLVIISAGGLGLLALKIAKAAFNVSPIVVDIDDSKLEIAKAAGASEVINSSHEGAKKRIMDLTEGGATTVIDYVGAEASIQFGYDLFGFNKNGLYILVGMLGGKFEVQLPLMTFSSRVLQGSYLGSIQEMKELMDLVRAGKIEPVPVEARHVSMANDTIADLKAGNIPGLVCLKH

SEQ ID NO: 22569 - protein, 359 aa, uncultured marine gamma proteobacterium EB000-45B06
MLFEPYKLKNTILRNRVAMAPMTRNQSPGGIPTNEVVEYYKRRAKAEVGLIITEGVEVSHEASSAYPNVPRLDSEEAREGWKKVVEGIKENNGHVIAQLWHCGGFRKLGMGPNPEIPGHTASGLVRPGKRVAHAMSSFDIEETVEAYASDAKICEELGFDGVEIHGAHGYLIDNFFWTGTNDRDDNFGGSIKSRSFLATSITKAIRDNVSNDFIVGLRFSQWKQQDYAAKLAQSPDDLLEVLSGPCNAGLDYLHSSMRRFWESEFEGSDENLAYWTKKLMNIPTMSVGSVGLDGDFTDMMASAKTASIDKAVQDINDEKYDMVAVGRALLSDHEWVIKMKEGRLEDINPYTKDSLIEMY

SEQ ID NO: 22570 - protein, 303 aa, Nostoc sp. PCC 7119
TQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGPRGMEEGIDAALSAAAAKEGVTWSDYQKDLKKAGRWHVETY

SEQ ID NO: 22571 - protein, 353 aa, Sulfolobus solfataricus
MVRIIVKNVSKVFKKGKVVALDNVNINIENGERFGILGPSGAGKTTFMRIIAGLDVPSTGELYFDDRLVASNGKLIVPPEDRKIGMVFQTWALYPNLTAFENIAFPLTNMKMSKEEIRKRVEEVAKILDIHHVLNHFPRELSGAQQQRVALARALVKDPSLLLLDEPFSNLDARMRDSARALVKEVQSRLGVTLLVVSHDPADIFAIADRVGVLVKGKLVQVGKPEDLYDNPVSIQVASLIGEINELEGKVTNEGVVIGSLRFPVSVSSDRAIIGIRPEDVKLSKDVIKDDSWILVGKGKVKVIGYQGGLFRITITPLDSEEEIFTYSDHPIHSGEEVLVYVRKDKIKVFEKN

SEQ ID NO: 22572 - protein, 318 aa, Actinobacillus pleuropneumoniae
  misc_feature (216)..(216): Xaa can be any naturally occurring amino acid
MAKAPKTAYVCNDCGAEYSRWVGQCKECKSWNTVSEIRLISSKEATKSDRFSGYAGETSGKVQTLSEISLQEVPRFSSGFNELDRVLGGGVVPGSAILIGGHPGAGKSTLLLQVMCGLSKDLPTLYVTGEESLQQVAMRANRLGLPTDNLKMLSETSVEHICNIADQEKPKIMVIDSIQVMHLADIQSSPGSVSQVRECASFLTRYAKTRQVAIIXVGHVTKDGTLAGPKVLEHCIDASILLEGESDSRFRTLRSQKNRFGAVNELGVFAMTEQGLREVKNPSAIFLSRSDEQTPGSSVMVLWEGTRPLLVEIQALVD

SEQ ID NO: 22573 - protein, 479 aa, Taxus brevifolia
MSPQTETKASVGFKAGVKDYRLTYYTPQYQTKDTDILAAFRVTPQPGVPPEEAGAAVAAESSTGTWTTVWTDGLTSLDRYKGRCYHIEPVPGEEDQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTTLAHYCRDNGLLLHIHRAMHAVIDRQKNHGIHFRVLAKALRMSGGDHIHAGTVVGKLEGEREVTLGFVDLLRDDFIEKDRSRGIYFTQDWVSMPGGLPVASGGIHVWHMPALTEILGDDSVLQFGGGTLGHPWGNAPGAVANRVALEACVQARNEGRDLAREGNEVIREATKWSPELAAACEVWKEIKFEFKAVDTLDPEK

SEQ ID NO: 22574 - protein, 475 aa, Thuja plicata
MSPQTETKASVGFKAGVKDYRLTYYTPEYQTKDTDILAAFRVTPQPGVPPEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFCFCAEALYKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGEREVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDRL

SEQ ID NO: 22575 - protein, 146 aa, Malus x domestica
ATEEATVVVVTETVENPPPEPATTETAAEKPPAKTGKAKEPKAKKAPAPRKPRSAPAHPPYEEMVKDAIVTLKERTGSSQYAITKFIEDKQKQLPPNFKKLLLFHLKKLVSSNKIVKVKNSFKLPPVRSSVPKPASPVKKKKPAAA

SEQ ID NO: 22576 - protein, 351 aa, Streptomyces clavuligerus
MSTAVSPRYAQPATFMRLRHRPDPIGHDVVVVGAPYDGGTSYRPGARFAPRAIRHESSLIHGVGIDRGPGVFDRIDVVDGGDIDLSPFSMDLAMDTATVALTRLLERNDAFLMLGGDHSLSLAALRAVHARHGRVAVLHLDAHSDTNPPVYGGTYHHGTPFRWAIEEGLVDPERLVQVGIRGHNPRPDSLDYARGHGVSIVTAADFTRRSPRGIAEQIRRTVGGLPLYVSVDIDVVDPAYAPGTGTPAPGGLSSREVLTLLDVVGQLRPVGFDVVEVSPAYDPSGITSLLAAEIGAELLYQYARATTSPASAPVDSPLPPGAAADDAENAENAVDAVDAESAVDFAGQRWG

SEQ ID NO: 22577 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAKNRAALPLNHLVAKLKEYNAAPPLQGFGISAPDQVKASIDAGASGANSGSAIVKIIEQHINEPEKML

SEQ ID NO: 22578 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVAHVPIEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 22579 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPVGLLMYANLVFNKGIDEFYAQCEKVGVDSVLVADVPVEESAPFRQAALRHNVAPIFICPPNADDDLLRQIASYGRGYTYLLSRAGVTGAENRAALPLNYLVAKLKEYNAAPPLQGFGISAPDQVKAAIDAGAAGAISGSAIVKIIEQHINEPEKML

SEQ ID NO: 22580 - protein, 212 aa, Escherichia coli
  misc_feature (19)..(19): Xaa can be any naturally occurring amino acid
  misc_feature (71)..(71): Xaa can be any naturally occurring amino acid
  misc_feature (90)..(90): Xaa can be any naturally occurring amino acid
  misc_feature (105)..(105): Xaa can be any naturally occurring amino acid
  misc_feature (205)..(205): Xaa can be any naturally occurring amino acid
LKERKEGAFVPFVTLGDPXIEQSLKIIDTLMEAGAAPLELGIPFSDPLADGPTIQNATMRAFAGGVTPAQXFEMLALIRQKHPTIPIGLXMYANLVFNKGIDEFXAQCEKVGVDSVLVADVPIEESAPFRQAGLRHNVAPIFICPPNADDDLLRQIASYRRGYTYLLSRAAVTGAENRAALPLNYLVTKLKEYNAAPSLQGFGIXAPDQVKE

SEQ ID NO: 22581 - protein, 242 aa, Escherichia coli
LKERKEGAFVPFVTLGDPGIEQSLKIIDALIEAGADALELGIPFSDPLADGPTIQNATLRAFAAGVTPAQCFEMLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVTKLKEYNAAPPLQGFGISAPDQVKAAIDAGAAGAISGSAIVKIIEQHINEPEKML

SEQ ID NO: 22582 - protein, 242 aa, Escherichia coli
LKERKEGAFVPFVTLGDPGIEQSLKIIDTLIEAGADALELGIPFSDPLADGPTIQNATLRAFAAGVTPAQCFEVLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIGKIIEQHINEPEKML

SEQ ID NO: 22583 - protein, 242 aa, Escherichia coli
FKERKEGAFVPFVTLGDPGIEQSLKIIDTLIEAGADALELGIPFSDPLADGPTIQNATLRAFAAGVTPAQCFEVLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPSLQGFGISAPDQVKAAIDAGAAGAISGSAIVKIIEQHINEPEKML

SEQ ID NO: 22584 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPVGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 22585 - protein, 242 aa, Escherichia coli
LKERKEGAFVPFVTLGDPGIEQSLKIIDALIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQGGLRHNVAPIFICPPNADDDLLGQIASYGRGYTYLLSRAGVTGAENRAALPLNHLVTKLKEYNAAPPLQGFGISAPDQVKAAIDAGAAGAISGSAIVKIIEQHINEPEKML

SEQ ID NO: 22586 - protein, 242 aa, Escherichia coli
LKERKEVAFVPFVTLGDPGIEQSLKIIDALIEAGADALELGIPFSDPLADGPTIQNATLRAFAAGVTPAQCFEMLALIRQKHPTIPIGLLMYANLGFNKGIDEFYAQCEKVGVDSVLVADVPVEESAPFRQAGLRHNVAPIFICPPNADDDLLRQIASYGRGYTYLLSRAGVTGAENRAALPLNHLVTKLKEYNAAPPLQGFGISAPDQVKAAIDAGAAGRISGSAIVKIIEQHINEPEKML

SEQ ID NO: 22587 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAKNRAALPLNHLVAKLKEYNAAPPLQGFGIFAPDQVKAAIDAGAAGAISGSAIVKIIEQHINEPEKML

SEQ ID NO: 22588 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFSKGIDEFYAQCEKVGVDSVLVADVPVEESAPFRQAALRHNVAPIFICPPNADDDLLRQIASYGRGYTYLLSRAGVTGAENRAALPLNHLVTKLKEYNAAPPLQGFGISAPDQVKAAIDAGAAGAISGSAIVKIIEQHINEPEKML

SEQ ID NO: 22589 - protein, 231 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKII

SEQ ID NO: 22590 - protein, 242 aa, Escherichia coli
LRERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 22591 - protein, 242 aa, Escherichia coli
LNARKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAAFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 22592 - protein, 242 aa, Escherichia coli
LKKRKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 22593 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLDHLVAKLKEYNAAPPLQGFGISAPDQVKAAIDAGAAGAISGSAIVKIIEQHINEPEKML

SEQ ID NO: 22594 - protein, 214 aa, Escherichia coli
DPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKI

SEQ ID NO: 22595 - protein, 242 aa, Escherichia coli
RTERIEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 22596 - protein, 242 aa, Escherichia coli
SEERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 22597 - protein, 240 aa, Escherichia coli
ERKEGAFIPFVTLGDPGIEQSLKIIDTLIEAGADALELGIPFSDPLADGPTIQNATLRAFAAGVTPAQCFEVLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 22598 - protein, 242 aa, Escherichia coli
  misc_feature (217)..(217): Xaa can be any naturally occurring amino acid
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAXAAGAISGSAIVKIIEQHINEPEKML

SEQ ID NO: 22599 - protein, 242 aa, Escherichia coli
LKESKEGAFVPFVTLGDPGIEQSLKIIDTLIEAGADALELGIPFSDPLADGPAIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIGKIIEQHINEPEKML

SEQ ID NO: 22600 - protein, 242 aa, Escherichia coli
LKERKEGAFVPFVTLGDPGIEQSLKIIDTLIEAGADALELGIPFSDPLADGPAIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIGKIIEQHINEPEKML

SEQ ID NO: 22601 - protein, 242 aa, Escherichia coli
  misc_feature (6)..(6): Xaa can be any naturally occurring amino acid
LKESKXGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIGKIIEQHINEPEKML

SEQ ID NO: 22602 - protein, 242 aa, Escherichia coli
  misc_feature (176)..(176): Xaa can be any naturally occurring amino acid
  misc_feature (200)..(200): Xaa can be any naturally occurring amino acid
LKERKEGAFVPFVTLGDPGIEQSLKIIDTLIEAGADALELGIPFSDPLADGPTIQNATLRAFAAGVTPAQCFEVLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAXNRAALPLNHLVAKLKEYNAAPSLXGFGISAPDQVKAAIDAGAAGAISGSAIVKIIEQHINEPEKML

SEQ ID NO: 22603 - protein, 242 aa, Escherichia coli
LKERKEGAFVPFVTLGDPGIEQSLKIIDTLIEAGADTLELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAGLPLNYLVAKLKEYNAAPPLQGFGISAPDQVKAAIDAGAAGAISGSAIVKIIEQHINEPKKML

SEQ ID NO: 22604 - protein, 242 aa, Escherichia coli
LKERKEGAFVPFVTLGDPGIEQSLKIIDTLIEAGADALELGIPFSDPLADGPTIQNATLRAFAAGVPPAQCFEMLALIRQKHPTIPIGLLMYANLVFNKGIDEFYAQCEKVGVDSVLVADVPVEESAPFRQAGLRYNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPKKML

SEQ ID NO: 22605 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAKNRAALPLNHLVAKLKEYNAAPSLQGFGIFAPDQVKAAIDAGAAGAISGSAIVKIIEQHINEPEKML

SEQ ID NO: 22606 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPSLQGFGISAPDQVKAAIDAGAAGAISGSAIVKIIEQHINEPEKML

SEQ ID NO: 22607 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFHQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKML

SEQ ID NO: 22608 - protein, 242 aa, Escherichia coli
LKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIGKIIEQHINEPEKML

SEQ ID NO: 22609 - protein, 433 aa, uncultured bacterium
MVACGAEPFAPGAVFNIHHMKDSGMQQLSLDKDKIRFLLLEGVHQNALDVLHKNGYTNIEYLKTALDESTLLEKVRDVHFLGIRSRTQVTPKVLEAANKLVGIGCFCIGTNQVALQHAMRKGVPVFNAPYSNTRSVAELVLGQLILLLRGIPQKNALVHRGGWSKSAEGSWEARGKTLGIVGYGNIGSQLSVLAESLGMHVVYYDTVTKLPLGNARQLGSLNELLGLADVVTLHVPEIPSTQNMMRAEHFAKMKPGAIFINAARGTCVDIDDLAAALQSQHIGGAAIDVFPVEPKANDEEFQSPLRAFDNVILTPHIGGSTLEAQANIGLEVAEKFVRYSDCGTTLSAVNFPEVSIPLGAGKHRLLHIHENVPGILSNINRVFAENGINIAAQSLMTNDAIGYLVIDVDAEYSEVALQKIQSIPGTIRSRVLY

SEQ ID NO: 22610 - protein, 431 aa, uncultured bacterium
MTNNPDWKFETRSVHAGYSPDPTTKAVAVPIYQTVAYAFDSAQHGADLFDLKVPGNIYSRIMNPTNDVLEQRIAALEGGIGALAVASGQAAVTYAIQTIAEAGDNIVSSTALYGGTYNLLAHTLPQFGITTRFADHRDPGSFEPLIDERTKAIFVESLGNPSGNITDIAKVAEIAHRHGIPLIVDNTVPTPYLSRPIEHGADIVVHSLTKYLGGHGTSLGGAIVDSGKFPWAQHKARFKRLNEPDASYHGVVYTEALGPAAYIGRARVVPLRNTGAALSPFNSFLILQGIETLALRLDRISDNALRIAQHLKRHPRVKWVNYAGLEDHPDHALVNQYLSGKASGLLTFGVDGGREAGARFLDGLKLFTRLVNIGDVRSLATHPASTTHRQLSPEELAKAGVTEDTVRLSIGIEHIDDLLADLDQALANTAA

SEQ ID NO: 22611 - protein, 448 aa, Sphingomonas paucimobilis
MLTYDYDLFVIGAGSGGVRAARVSAAYGARVAVAEEHRVGGTCVIRGCVPKKLLVYGSHFAEDLQDARRFGWKVPDCEFDWSALRDNVLAEVSRLEGLYTETLGNNKVEIIRERATVAGPHEVLLGSGQTITAGKILIATGAWPIVPHFPGAEHGITSNEVFHLDTFPKRVVIAGAGYIANEFAGIFHQFGAHVTLVNRTDVILRGYDEQIRDRLLQISMTKGIEFKFHVAFEKVDKQPDGSLLVHMTGHEPIPADMLLFATGRRPHTENLGLETADVALDAKGAIKVDDDNRSSCASIYAVGDVTNRVQLTPVAIREGQAFADTVFGNNPRRVDYGCIPSAVFSHPPMAGVGMTEAEARNKLGEVKVYTSDFRAMKNVLADRHERALYKLVVHPETDVVVGIHMIGPDAPEILQAAAIAVKARLTKAQFDDTVALHPSMAEELVLMR

SEQ ID NO: 22612 - protein, 1200 aa, Sphingomonas paucimobilis
MTNPPPFTDFAPVIRPQSPLRQAITAAYRRDEAECMAPLLEAAALPDAMRRGVRDMARRLVTTLRANGKGSGVEALVQEYSLSSQEGVALMCLAEALLRIPDDATRDALIRDKIADGDWGGHLGGGRSLFVNAATWGLVVTGKLVGSVDDRGLGAALTRLVARLGEPVIRRGVDLAMRMMGEQFVTGETIGEALKRARAQEAKGFQYSYDMLGEAAATAADAARYLEDYRQAIHAIGRASAGRGVYAGPGISIKLSALHPRYSRAQAERVMGELLPRVKELALLARGYDIGLNIDAEEADRLELSLDLLESLALDPELAGWNGLGFVVQAYGKRCPFVIDWIVDLAGRAGRRIMVRLVKGAYWDAEIKRAQVDGLADFPVYTRKVHTDVAYIACARKLLAARDRVFPQFATHNAQTLATVHHLAGHDFTLGDYEYQCLHGMGEPLYEQVVGKGDLDRPCRIYAPVGTHETLLAYLVRRLLENGANSSFVHRIADPAVPVEEMIADPVEQVRAMPHPGARHADIALPSGLYPDRRNSDGIDLSDENALAMLTRALAESAQIGWTARPEGGEGAARPVLNPADRRDVVGTVFEASTDFARAAVARADGSGWARAPVTERAAILERAADAMQARMPILLGLIVREAGKSLPNAIAEVREAIDFLRYYAAQARSTFGPAQEPLGPVVCISPWNFPLAIFTGQVAAALVAGNAVLAKPAEETPLIAAEAVRLLHEAGVPGDALQLVPGAGEIGAALVAAPQTAGVLFTGSTEVARLIQRQLASRLSASGRPIPLVAETGGQNAMIVDSSALAEQVVADVIASAFDSAGQRCSALRILCLQEDVADRTLAMLKGALRELRIGRTDRLAVDIGPVITDEAQEGIGRHIEAMRALRCAVEQQPLPEESAHGSFVPPTIIEIDDIAQLRREVFGPVLHVIRFPRAGLDALVDAINATGYGLTFGLHTRLDDTVAQVTGRVKAGNLYVNRNVIGAIVGVQPFGGRGLSGTGPKAGGPLYLGRLVRVPPAFAGRAGSFPSALADFADWLAAEGEAEASAMARRCGDASALGVEMALPGPVGERNLYALHPRGWIGMRPATRQGLLGQMAAVLATGNRGVLQDMALPRGLPPHIAAHFASRPEGPLGAVLVEGDAGRIGAAVRDVAGLPGPVVSVHAAGADGMYPLHWLLEEVSTSINTTAAGGNASLMMIG

SEQ ID NO: 22613 - protein, 232 aa, Corynebacterium efficiens
MAQGDTNITVVGNLVADPELRFTPSGAAVANFRIASTPRTFNRTTNQWEDGEGLFLTCNVWREAAENVAESLTKGMRVIVQGRLRQRSYETREGEKRTIFEVEVDDVGPSLKYAKAEVTRIPRGGGQGGFGGNQGGGFGGQGGNQGGNPGGGQGGFGQNTGGFGGQQGNQGGFGGGQGGNPGGNQGQSGNNFNQGGFGGGGNQAAAPDNDPWNSAPPAGSGGFGGADDEPPF

SEQ ID NO: 22614 - protein, 137 aa, Gossypium barbadense
MAEEHRCQAPQLCANNCGFFGSPTTQNLCSECYRGLQLKEQQSSSAKQAFNHTLVPSSSSLPSSSSARSSFSASLPAKEEPSAGTKETKVVEEEEVQVTPNRCLSCKKRVGLTGFKCRCGMVFCGIHRYPGTTCLCF

SEQ ID NO: 22615 - protein, 337 aa, Klebsiella pneumoniae
MHSYRLESFGSLQGLKLIEEQQPVPGRNQVLIKVRACSLNYRDLAILYGTGTLTPKAGLIPLSDGAGEVVATGDSVGLFKKGDRVVGTFFPHWFGGARDAAAGRGTYGTQADGWLTSYKVVDEESLVSVPDYLSWEQAATLPCAAVTAWNSLQQSRSVLPGETVLTQGTGGVSLFAVQFAKIMGARVIALTSNDVKAQLLSALGADHVINYRHYPEWSVKVRELTQGRGVDRIVEIGGPGTLNQSLLSAAPGGEIALLGFVAQGSASVDFMTLFKSGATVRPFSVGSREDFVAMNRALVKSQLQPVIDRVFEFEHAVEAWRYFESQQHTGKVVITMN

SEQ ID NO: 22616 - protein, 135 aa, Klebsiella pneumoniae
MPMFLLLEKAHAGAVFQLEDILPSIPWDSHGLIAAIAQQYDTGEVLMLAWMNQQALDETLLTGRACYWSRSRSCLWRKGETSGCVQQVHDIRLDCDGDAVLLLVDQKGGACHTGRRSCFYNAIKGDELTVLNDPG

SEQ ID NO: 22617 - protein, 185 aa, Vitis amurensis
GEGGFGNVYKGFIKGGSTTVAVKRLNPSSKQGAREFETEIRMLSKLRHIHLVSLIGYCDEEGEMILVYDYMARGTLRDHLYKTKKPPLPWKQRLQVCIGAARGLHYLHTGAKHTIIHRDVKSTNILLDEKWVAKVSDFGLSRVGPTSMTQTHVSTAVKGSFGYVDPEYFRLRQLTEKSDVYSFGV

SEQ ID NO: 22618 - protein, 185 aa, Vitis amurensis
GEGGFGNVYKGYINGGTTLVAIKRLNPESQQGAHEFMTEIEMLSQLRHIHLVSLIGYCNHKREMILVYEYMANGNLRDHLYNTDNPPLPWTQRLQICIGAARGLHYLHAGVKKTIIHRDVKTTNILLDHKWVAKVSDFGLSKMSPTSVANAHISTVVKGSFGYLDPEYFRFQRLNEKSDVYSFGV

SEQ ID NO: 22619 - protein, 182 aa, Vitis riparia
GEGGLGNVYKGYIDGGDTIVAIKRLKSKSKQGAHEFLTEIEMLSKLRHRHLVPLIGYCEEEGEMILVYDYMHHGTLRNHLYGADNDPLPWKQRLEICIGAARGLDYLHAGAQHPIIHRDIKSTNILLDNKWVAKVSDFGLSKMRPSDDPVTTVVKGTFGYMDPEYYKWMKLTQKSDVYSFGV

SEQ ID NO: 22620 - protein, 182 aa, Vitis riparia
GEGGFGNVYKGYIDGGETIVAIKRLKSKSKQGAHEFLTEIEMLSKLRHRHLVPLIGYCEEEGEMILVYDYMHHGTLRNHLYGADNDPLPWKQRLETCIGAARGLDYLHAGAQHPIIHRDIKSTNILLDYKWVAKVSDFGLSKMRPSDDPVTTVVKGTFGYMDPEYYKWMKLTQKSDVYSFGV

SEQ ID NO: 22621 - protein, 247 aa, Pasteurella trehalosi
IAITATGTNNIDTVAAKELGIAVKNVTGYSSVTVPEHVLGMIFALKHSLIGYHRDQVTSDRWATCGQFCYTDYPITDIRGSTLGVFGKGNLGSEIGRLATLLGMNVLYAEHKGATTIREGYTPFEDVLKQADIVTLHCPLTETTQNLINAETLALMKPTAYLINTGRGPLVDESALLNALENGEIAGAALDVLVKEPPEKDNPLIQAAKRLPNLLITPHVAWASDSAVTTLVNKVAQNIEEFVVVGK

SEQ ID NO: 22622 - protein, 163 aa, Actinidia deliciosa
TMGGACGYGNLYSQGYGTNTAALSTALFNNGLSCGACFEIRCVSDPKWCLPGSIMVTATNFCPPNNALPNNAGGWCNPPQHHFDLAQPIFQQIAQYRAGIVPVSYRRVPCLKKGGIRFTINGHSYFNLVLITNVGGAGDVHAVSIKGSRTGWQPMSRNWGQNW

SEQ ID NO: 22623 - protein, 469 aa, Enterobacter gergoviae
MSAEHVLTMLNEHEVKFVDLRFTDTKGKEQHVTIPSHQVNAEFFEEGKMFDGSSIGGWKGINESDMVLMPDASTAVIDPFYEEPTLIIRCDILEPGTLQGYDRDPRSIAKRAEEYLRATGIADTVLFGPETEFFLFDDIRFGASISGSHVAIDDIEGAWNSSTKYEGGNKGHRPGVKGGYFPVPPVDSSQDIRSTMCMIMEEMGLVVEAHHHEVATAGQNEVATRFNTMTKKADEIQIYKYVVHNVAHRFGKTATFMPKPMFGDNGSGMHCHMSLAKNGTNLFSGDKYAGLSEQALFYIGGVIKHAKAINALANPTTNSYKRLVPGYEAPVMLAYSARNRSASIRIPVVTSPKARRIEVRFPDPAANPYLCFAALLMAGLDGIKNKIHPGEAMDKNLYDLPPEEAKEIPQVAGSLEEALQALDADREFLTAGGVFTNDAIDAYIALRLEENDRVRMTPHPVEFELYYSV

SEQ ID NO: 22624 - protein, 397 aa, Trifolium pratense
MASASASLFKSSLVLDKSEWVKGQTLRQPMSVVRCSPAAPSSLTIRAGAYTDELVKTAKTIASPGRGILAMDESNATCGKRLASIGLENTEVNRQAWRTLLVTVPSLGEYISGAILFEETLYQSTVDGRKIVDVLVEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHNIDRTFEVAQKVWAEVFYYLAENNVQFEGILLKPSMVTPGAESKDRASPATVADYTLKLLQRRIPPAVPGIMFLSGGQSEVEATLNLNEMNKSPNPWHVSFSYARALQNTALKTWGGRIENVKAAQEALLHRAKSNSLAQLGKYAGDGESEEAKKELFVKGYVY

SEQ ID NO: 22625 - protein, 474 aa, Nicotiana tabacum
IFLPGYIYFPMDDVNLSTKLSRNIPSPSPAFASPMDTVTETSMAVAMAALGGIGIVHYNNISLNKHPSSVLPNLIKSLSPPNLIFASPSDSSIPPMNSLTPLRHRVRGTNNPNCLGHVSKSDWKNLSNKEARISAFMNTSPVTLPSSYNFNDVSGYMASKKLDFVALVNEEEGNGEVVNLVTSADMEKIKGLPKLGLPSLGEDRKFLLGAAVETRESDKERLEHLLKEGINAVVIDSSQGNSLYQINMIKHVKHTYPHLDVIGGNVVTNYQAENLIKQGVDGLRVGMGSGSICTTQEVCAVGRGQATAVYMVSSIAEQHGIPVIADGGISNPGHIVKALSLGASTVMMGSFLAGSNEAPGTYEYKNGLRVKKYRGMGSLEAMTKGSDARYLGDTAKLKIAQGVVGSVADKGSILKFIPYTMQAVKQGFQDLGASSLQSAHHLLRSGKLRLEVRTGAAQVEGGVHGLVGHEKRYF

SEQ ID NO: 22626 - protein, 466 aa, Euonymus alatus
SVGFKAGVKDYKLTYYTPDYQTKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHAGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 22627 - protein, 344 aa, Magnaporthe grisea 70-15
MDIVLEITDTFLWDYMYAFVAPATAPPYDYPNLSNGTAVAHNGWEYKPTTALFSLEPSQAAYQSALPRDNIYRQGISLFLIYWIFGVLVYYIFATASYLFIFDKKQMEHPKFLKNQIKLEMIQANKAFPIMALYTVPMILLEIRGYSKLYDSADEAPAWWYNYIQFPLFLVFTDFCIYWIHRWLHAPIFYKRLHKPHHKWIMPTPFASHAFHPLDGYAQSFPYHLFPFIFPLQKVAYIGLFVFINIWTILIHDGEYVANNPIINGAACHAVHHFAFNYNYGQYTTLWDRLGGSYREPDADLFDLKAKMSKEQWNKQAKEMENLVQQIEGEDDRVYGEISDKKTR

SEQ ID NO: 22628 - protein, 231 aa, Magnaporthe grisea 70-15
MARKFFVGGNFKIFTSSEVVISPPHVYLSHTRSLAKKEIEVAAQNVFDKADGAYTGETSVSQLKDLGINWVILGHSERRTILGESDEVVASKTKYAIDNGLKVIWCCGESLEERESDKTVEVVTRQLEALKAKVGTSGWENIVIAYEPIWAIGTGKVATPEQAQDAHAAIRGYLKSKVSDKVAEETRILYGGSVNEKNCGELSQKPDIDGFLVGGASLKPAFVDICTCKSA

SEQ ID NO: 22629 - protein, 1000 aa, Magnaporthe grisea 70-15
MASIGGEDSVATSNGVEGHSPTQNGVKSSPEATIKGSTDPATEADADIDKLSSNHAQNSDAFSSNKLITTEPTITTTDETEMKAEEQDDKSKSEAEDSKVPAANGTSAKSGDDDVKDESKSAKEEDEVKPAAQSATNENPKPDESIEDAEESKDAEMSEAPPSALDAKTEASGAASPKSDTKPASPKATKESEESSATKTNEVNGAEDKVDSESKPTSTDSSLNPPSMSNLAIDASQDASVAENQDTSMAEAPSQTNKVAREREDDTSEEPAAKRAKTESRSTELDAETTTTKKVSDTKPKTDSPKSSAVATDDKSETEAAEVDAAPFAPEPMDVDPEGWEESAQKLVPKPIRALPGSIMHPTSYDKPISEFANREIRRALGSVKKTKAGGNFKDSVAKLWPVLAESYNSKVKKPMDIGLMERNLRTGVYKTIGEFKADLDLLVLNSYYFNGAMHDVTKSAISLLESVLYKLVDTPLDELNKPSSSQSKSASSTRHAEPRAATQPKPKPAPAPAKPPPPPAPIEKVVQSPIHAAPAARRDSKDDDRPKRPIHPPKKELGYDGKGSKKKKLSPDLKYCDDILKDLAKPKSHGIAWIFAKPVDETRDGAPGYYSIIKKPMDLGTMTVKLQEGKYRSAADFKADFDLMLNNCFTFNPAGTDVHALARNLEAYFQDKWAGIDAYVAKHASRAPARRTSASSPSAGIKDESEDEGPASEPEPEVPAAHLDQIRELKKKIDAVDASITKHKEQYTEEVANSADPSDTSKLDILMSIIQMLNKDLGDKKKKLAELEASTPASKPKPAAKAKKAAAAGNALPNKKAAGGNKKASGAGGKKSSKRVMSTIEKEAIANGINELDGTYLEQAVAVIKKDTNQEENGDGELELEIEQLSIDALNKLYDLMCSGIKGFRSNVESMVRSAQATAPPPAQAPPAIAGRGQKPKKNKPMGKGEQERKLEHLEKLKAQYTANKGRQGSGSQEPPGANELASQEPADEEDSDVSSEEE

SEQ ID NO: 22630 - protein, 509 aa, Magnaporthe grisea 70-15
MSLSTIIAQVALALIASVWIWRSITLYYRRRKLKLLHGCMPVTKIPDWDPIFGLGFTYTLIKSDINNHRLINNTVERLQTYGYTHMANVMRHRMFFTCEPENLKAIMHGQFDHFDNELRSVPAGHFMGMGIFLADGEKWQRSRALVRPNFARDQVADLGSLERHFQILLSIIPKDGSAVDLAPLFFAFTMDSITDFLFGESVKALQAHASGAHASSSPWSQKGIEQFAEAWEYAQNDMLFRFILGPARYVYQDKKANQCVKMIHAHVDRYVEQAVRFRNEELARGGDEKEPKSEGRYIFLQALAKQTQDRKVLRDELMNLLMAGRDTTAALLSNLFHTFARRPDVWAKLKNEVMFLEGRLPTYEDIRNMKYVRWCINEFGILGKQASFDTTLPRGGGPNGRSPIFLPKGSIVLYSMLAQHRRKDLFGEDALEFRPERWETLRPGWNYVPFNGGPRICVGQQYALTEASYLVVRFVQTFATVESRDPEPWSIGKRLLTCPMNGTIVSLSR

SEQ ID NO: 22631 - protein, 406 aa, Magnaporthe grisea 70-15
MSFSGMLNRLHGQPESYDKKSKYRFGKTLGAGTYGIVREAEGQTGKVAIKIILKKNVKGNERMVYDELEMLQRLQHPHIVRFVDWFESRDKYYIVTELATGGELFDRICEQGKFTEKDASQTIKQVLGAVDYLHSKNVVHRDLKPENLLYLSKAPDSDLVLADFGIAKMLDSRDEVLTTMAGSFGYAAPEVMMKKGHGKPVDMWSMGVITYTLLCGYSPFRSEGLQDLIEECSNAQVTFHDRYWRDVSEDAKNFIRSLLQANPDDRATSGQALRHPWLSGENATDHNLLPEIKSFMAKARLRRGIEMVKLANRIQTLKLQEEDPDNTDMPDDAVEAADDSQGNAGSSGGSGLFKPGEKKTMSKAVKGAIFREVVLAKVREMKTQEETLKVAEEVEKEARRKSFTGS

SEQ ID NO: 22632 - protein, 449 aa, Magnaporthe grisea 70-15
MTSSVASGLPLSTSTNPQAKPPTDATTTAASIPNLKDRLPKLEPRRRRPAPSNPVPVPETPNLPPPTGTSPETQFRVPTRRILSKKDHDLFVAAPAYKLILAFVFGLSDAVVDKPISAIKDSDLSPAVQTINALLDEASELVKQSPPDEQGGSRFGNKRFRDFLDNVKERAPSWHKKLGIKDEGDAIAEAVTYLGQSFGNRMRIDYGSGHELNFLMWLLCLYQLGVVTKSDFAALVLRVFVKYLQVMRLVQSTYYLEPAGSHGVWGLDDYQFLPFLFGASQLLHHPFITPLAIHQQLTIEEFGHDYLYLDQVNFVNSTKTVQGLRWHSPMLDDISAAKSWSKVEGGMRRMFVAEVLNKLPVMQHFLFGSLIPAAEGMTEQDLAGLQPEDEETEGGQVEVFNDEGGVRHMHQQNGWGECCGIKVPSSVAAAAEMRKRGIGGDSLRRIPFD

SEQ ID NO: 22633 - protein, 337 aa, Magnaporthe grisea 70-15
MSPSTESNPVPPYPLHPSVASRINPEYAAFYNAHIADKQQVHLQPIAASRSSGVLIPGAGPLLPVGSTQDYTIPRTASSGPDVRVRVFTPPGARPASGWPGCVYFHGGGWVLGTIDTENVVCSNLCARGGAVVVTVDYRLAPEDPFPAAVDDCWEAVRWVVARGPELLGLDLGRLATGGSSAGGNLAAVMCQRAAVVADHPPFRLQLLSVPVADNTATAETTPSWRENEHTPALPAPKMLWYRRHYLPRESDWAHPEASPLLWDGDWSRLPRAVIVCGELDVLRDEGVAFGDRLNKAGVRADVHVLEGQPHPFLAMDGVLEDGRRAITYFCEALKEL

SEQ ID NO: 22634 - protein, 395 aa, Magnaporthe grisea 70-15
MVHASLLALGWAALASAHDTQKQVPLAGPLESVWYNTLPGDGGTQADSVFSGITTFGRLPYAPCLKDSSVNYDIAFIGAPFDTGTSYRPGARFGPSGIRQGSRRLNLYGGYNVPLAVNPFNSWARVLDCGDIPVTSYDNTWALRQIEEGHHQILSRAPATNANKAGPALRSKTLPRVITLGGDHTITLPLLRSINRAYGPVSVIHFDSHLDTWKPKVFGGSPSEVASINHGTYFYHASMEGLLHNDTNIHAGIRTTLSGPSDYANDGYCGFEIVEAREIDTIGTTGIIKRIVERVGTKNPVYLSIDIDTLDPAFAPATGTPETGGWSTRELRTILRGLEDLNLIAADIVEVAPAYDTNAEHTTMAAADVLYEVMSMMVKKGPLSNMIEEEAIGDL

SEQ ID NO: 22635 - protein, 501 aa, Magnaporthe grisea 70-15
MPPSISSRSATAHEEEAIETTALLPRQQQQQQHRSRAEYAAWLREIWFLTKACVPVILAYMLQNSLQTISVLIVGRLSPEALSAAAFAYMFAMATAWLIALGGTSALDTLASSSFTRSRDKTSLGLLLQRGFLVLTALYAVVVVVWWFAEDVFRALGQPEEICVMSARFLRLLAPGGLGYVWFECMKKFLQAQAIYRPGTYALMLTSPLNALLNYLLIYKLDMGLDGAPIATGISYWLSFFFLVGYAVFVQGSECWGGFDLRRAATNVGPFARLAALGVVHVGTEWWAFEIVALAAGRLGTLPLAAQSVIMTADQIINTIPFGLGVAESARLGNLLGAGDVRGARRSAHSAAILSVVFGTTLLVVLMAARHRVGALFNDDEQVIALVAEVVPYVALFQIADGLNGSCGGALRGMGRQWVGALVNCVSYYGGALPGGIYLAFNGWGLAGLWMGQCVALSLVGVLEWVIVGMSDWPEEVRRAIDRLRDDEDGNKSVVEEEVVE

SEQ ID NO: 22636 - protein, 278 aa, Magnaporthe grisea 70-15
MDETTPQHHKGAMLGHADGQAGPHRQTLRHHLVAALGEFVGTFLFLFFGYASHSMIATAERPTPEGLRDGYSAQATVFIALAYAMAILVTVWAMYRISGGLFNPAITLGLGLAGQLPWIRIAVLFPTQLVASICAGAVIEAMLPGPISRVNTKLAPDVSVTQGVFLEMFFTAYLLFVVLMVAAEKSKDTYIAPVAIGLAAFVALIPGAYYTGASLNPARSFGCAVAGLQFPENHWIYWVGPFLGSALGAGFYRLLKFLNYEEANPGQDSDYPLYNQRV

SEQ ID NO: 22637 - protein, 1083 aa, Magnaporthe grisea 70-15
MATSDDQTVPIPEPQGLPLLGNIGAIDNEFPLGSLLSMASKYGEIWRMRFPGRSLVFVSTQALVNEVCDEKRFYKSINPTLKEVRGGTHDGLFTAYPDEENWGIAHRILMPAFGPLSIRSMYDEMHDIASQLALKWARYGSNSPIMVTDDFTRLTLDTLALCSMGFRFNSYYSTEMHPFIDAMADFLVECGTRGRRPPLPSIFYRTQDQKFDSDIEILRKTAREVLEARKAGEGADRRDLLHAMLSGVDSKTGKKMTDESIMDNLITFLIAGHETTSGLLSFVFYELMKHPEFYEKAQREVDEVCGKGPITVEHMSKLPYLNAVLRETLRVHATIPNITVAAREDDVLGGKYKVSKDEVIVLLLAKSQVDPRVWGKDADEFVPERMLDENFERITKEFPNSWKPFGNGMRACIGRPFAWQEALLVMAMLLQNFNFVLAPNYQYALKQTLTLKPKDLYMRAILRDGLNPTTLERRLQGLSQGDSASTKQASGAGAGAAPADATGVPLTVLYGSNSGTCEALARRIATDAPSHGFYAATVDCMDSAKGKLPTDQAVVIITASYEGQPPDNAGHFVAWLEGSDKAAKPCKDVSYAVFGCGHKDWAQTFHRVPRLVDDSLQELGASRLVEPGLSDVSTGAVFSDFESWEDDKLWPALAARYQVNSEAAAAENGAEASVKVHVSNPRINTLRQDVKEARVIEAKVLTSRPESTSEGGRQFKRHLEIELPEGMEYSAGDYLAVLPVNPIDTVLRTLHRFGLARDAHVTIEMASSQSTALPTNTSVPAFELLSSYVELSQPATKRDAASDEETKSQLGKLSGDDFADEVGAKRVSVLDLLERFPAIDLPIGSFLSMMPPMRVRQYSISSSPLVNPSRVTLSFSVLDAPSLSGQGRHIGVASNYLSSLNAGDSLHVSVRPSHAAFSLPSDQERTPLICAAAGTGLAPFRGFAQERAAMISAGRKLAPALLYFGCRDPDFDDLYRDEFDEWEKLGAVEVRRTYSRKPEASDGCKHVQDRIVADADRLLGLWMEGAKLYVCGSRGVSQSVMDAMTRIKMDKDRELHGKETTVEEARQYFDDLRNVRYATDVFD

SEQ ID NO: 22638 - protein, 311 aa, Magnaporthe grisea 70-15
MASQKFDPDSDIPSLSGKVILVTGGNIGLGQESILQLAKHDPKRIYLAARSEEKARKAMEAIEQKIGAAKSSVITFLPLDLGSFDSVRKAADTVKSQTDELHILLNNAGIMMTPAAKTKDGYEEQFGVNHMGHALLTRLLLPLLEKTAKSGADVRIVNLSSSGEMLAATDCFKDMSRYKTTMEDVQTVKRYGAAKLANVYHAQMLAQKYPSIKAVSLHPGVVKTNLMSRMKESWPILGPIVSSIISNVFCTSVADGVRNQLWAAVSNDVVSGEFYHPVGLLGKGSPATKKVKEAENLWEWTEKELDAYLNK

SEQ ID NO: 22639 - protein, 481 aa, Magnaporthe grisea 70-15
MASITLESLPDVLANDTKVKLAGIDVDGILRGKLVSKKKFLSIAKDGFGFCSVIFGWDMHDQTYFRELEISNAGNGYRDLVAIPDLASFRRVPWENDIPFFLVSFHDPDTMEPICACPRGLLRTQLDKIKSEGYGAMAGAEYEFYQFRTPSSDPAASSAPSTAAYLRENPPHSLPALTEGMFGYSLTRPVHNQDYFYDIFDTCEKFNCNIEGWHTESGPGVFEAALEFGEITGMADRASLFKYAVKSVATKYGITPCFMAKPKQGLPGNSGHMHISLVDNSGKNLFARETPDENAPWPDVAQLSDIGRHFLAGLLEGLPDVMPIVAPTINSYKRLVENFWAPVTVSWGLEHRAASIRLIAPPTSKPGATRFEVRVPGADTNPSLVLAAILALGWRGVQKKLEIPCPPLGKGEQVGGESDTGIRLAKSLREATDRFMRKESVAREAFGDAFVDHYGGTREHEIRQWDEAVTDWEMKRYIETV

SEQ ID NO: 22640 - protein, 420 aa, Magnaporthe grisea 70-15
MTLKTLSAKAATALDQELMSTCAFSLDQLMELAGLSVSQAVFKVHPPTRGRRILVACGPGNNGGDGLVAARHLRHYGYQPSVYYPKRGKNELYQRLTKQLEDLEVPFVDDFGVALSASDHVVDAIFGFSFSGEVREPFPAVIRALAETKVPVTAVDAPSSWDIEHGPPESGHVGSNFNPAVLVSLTAPKPLAKHFKGRHFIGGRYVFFSYIIFVFAQGILLLSIQDKGITWSSPNAGLSRRRSRKNTTSTCPNMTGSTRSPKLQRAAPAPKNSDVVAQRVLSEVSSSFEILPPARWEPLAAALFLVTVRSWFCRLLVPIPRSSYDCTTSRTTVWADGAWTFSIVHFDEDLMVMCLQIDDGSVALGKYHGLQEQYLRMDPPAAHPNSPSVRPAAGDAVDDDCGGDRSYLRAGFGSGRFSRV

SEQ ID NO: 22641 - protein, 365 aa, Magnaporthe grisea 70-15
MGKRKTEESNGVEVTSKKRRRDEAEVDNVEIADAAKAEKKRLKKDKKDKKKAEVAVNNEEGADDEEQQKKDKKQKKEKKAKKAEEEEEQVAPVADVAESEKKEKKDKNDKKSKKYSKAKSEDGATDGQGDEEKPKTKRKREAEETSAVADAPAAVDEKSEKKKKKKKSKDGKRSEKSSEESAGDKNGIAAGTTTSNCDGAADAGTQEGDDEEQQAAGKNARFIVFVGNLPFTATKQHIEAHFASLKPTSVRLLTDRNDPKKSRGIAFVEFDNYSHMKTCLAKMHHSEFEDGVSAPRKINVELTAGGGGKTPYRNEKIRAKNDKLREERARRMKAELEAKHKEDEQDGIHPSRRAQMHRSQHADAQ

SEQ ID NO: 22642 - protein, 199 aa, Magnaporthe grisea 70-15
MAAPGVQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIDHHAPNVPIILVGTKLDLREDPSTLESLRSKRMEPVSYDQALICAKEIRAHKYLECSALTQRNLKSVFDEAIRAVLNPRPQPAKVKKSKCTIL

SEQ ID NO: 22643 - protein, 1208 aa, Magnaporthe grisea 70-15
MEVRPQARVPPRPVLEEASMRTNYSISQNSATPPNYQHGGLKTENIRPAQPQKTRRDIPVSSSHVPLNPRLYEIREEAQSTPQSKRESQASTASYKSSSSNTFRKPKTHVGPWQLGKTLGKGSSARVRLARHTSTHQYVAVKIVAKSTCKMTQAGSLAKLDEIDSAAPEKVEGMRRMPIALEREVAILKLIEHPNIVKLYDIWENSNEIYLILEYVERGDLFDFISKHGPMPEEEAIFVFRQIMSALEYCHSYGICHRDLKPENILLKSNGQVKIADFGMAALHQGPRTPLWTFCGSPHYAAPELLREKAYRGEKSDIWSMGVILFAMMAARLPFDDEDMNLMFAKARKAIYHMPSFFSDEAKDLIHRLLQVDPRKRLSMRQMWQHPVVWKYGYLDELGGEGIPEVPNPRTRQEIKPLDLCDIDPQILRPIQSMWHTLSEDELVKKLISDDYRERQLENYDPSLTHSPSDYHHIRPPLWLTKVSTRQFMTNKANGQGRSISKFTVISNVTETGTGANLGTVRSYDPYKSPAVKQPQATHARIVIHRDSTDTDRNAASLGSTSHRRPRANSTGSWKRPARRSQLGSRILTPRSTASSVQSSRKFHARSRTSSRQKRAMDFSTARRKAAAAKLSNQQTLLGTDGSKTVTGWNIQCSSDPDIPGDTADSSNARLRSKDRLHEELRHFSSSIAKDCDEAFNSSLLSVSQFDGDRSRQGSPFSLSLGTPVSATPVTPVVTPTIPRPSARPWDSRPLPPTPPSSSHEKESAVNFGENPSILARRGQPPTQGYNLRSGPVAMTPTPSDRRVVSAPVHGGQYGGCATGKLPSIEEATPNTIQDEVNRSRIVSLPAKPVATAPTSNEARGLEFLSNAEQTIRIVHSPSAQRESGITRRPHPIQANAKPSKMVGTSTGPVKQASIDLYHADDSIISHRNAQLAQTSSHGSASTFAMRKKTSSWFKRLSRESKGSKGSLCDELDDTKSIDVPHGLTSGPIKNERDNSSINMSHRPPEKTSNKKKSFFLPFWRHKSEPRMSLAEPDFEESPSPETNAAVKSHKTSGNNLLNFGDAESAERMIKPQQNWLARLFRVKPVTRVICLSISRRRARQEVAILLRDWRKYGIRDVEVDKKRNVVFARLSSKNHLNIKEVALACEIITVIEHGKRNHLSIVRFTQEKGAASSFQRVVDTMRDVLGNRNLLVTDKSKAKMMIKTLNS

SEQ ID NO: 22644 - protein, 401 aa, Magnaporthe grisea 70-15
MSTNDIKLPEPFASIPRETFLFGPSPIQHLERISEALGGKVNVYAKRDDCNSGLAYGGNKTRKLEYLAAEAKAQGADTLVSIGGVQSNHTRQVAAVSTKLGLKAVLVQEHWVPDWSDPVYGKVGNIQLSRLMGADVKLDPSGFGIEHKNSLAAAVAELQSQGRRPYAIPAGASDHPLGGLGFARWAFEVEEQERQMGVFFDTVIVCAVTGSTMAGMVAGFKLAQKKCGSKPRRVIGIDASATVPQTKEQVLRIAQVTGRKIGLEDGVDNVTTEDVELDDRYHAGIYGVPDQQTKDAIRFGASTEAFITDPVYEGKSLAGMMDMIRKGEIKPGSNVLYAHLGGQLALNAYSDIFIVHRRQSSLGNPMANPWPKHAMHLAEYSPANTWWWSKATMCGCKKHTL

SEQ ID NO: 22645 - protein, 338 aa, Magnaporthe grisea 70-15
MCICIWQDLRVGNKYRIGRKIGSGSFGDIYLGTNIISGEEIAIKLESVKAKHPQLEYEARVYKSLAGGVGIPFVRWFGTECDYNAMVLDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGSLPWQGLKAATKKQKYDRIMEKKMTTPTEVLCRGFPNEFAIYLNYTRSLRFDDKPDYSYLRKIFRDLFVREGFQYDYVFDWTDPSQQAQPGTVAQSSRPRNKNLIAGEDTPNTRGAVGGSDRM

SEQ ID NO: 22646 - protein, 467 aa, Magnaporthe grisea 70-15
MKNTALLVATAAASVAAVGIAEIPREQVSTSSQPSTSDPGFVSFPIYHRSVSKPILKRNTDVTIYNISSVSYLIQLSIGTPGQQVKVAIDTGSDELWVNPNCTAVKSQDQRAECIADGQYNPGQSSTSQVSTTSNNIPYGKGDVNITYYKDSISMSNSSISLTNVIFGVATSSKDLNEGIMGLGYGDGVNLRYNNMVDSLFLQNVTKSRAFSVALGSAEASNSGVISFGGVDTKKFSGKLGQMPILGPQGKEEIRRYWVPMDSIAMSKNGGNKTYSGGNIPIVIDSGSTLSYLPSSVVTAMAMDANALWNSEGGVYFVKCDKMPADASFDFSFNNGSFRISVPWRNFFWNTGGNTCVLGAVPIKSGSVTALLGDSFMRSVYTVFDQTSNMVFMAPYANCGSNEQMIPASPSGAAANFTGECSPGQGLPDPTPQKNAAGKASGEPSKFEFWACAAVLVVGHLVFGMLL

SEQ ID NO: 22647 - protein, 262 aa, Magnaporthe grisea 70-15
MTRPSDPLDKRTCSVGKVMPHTGVKIVQPGDRTKIVPIGEKGEIATSGYLIMQGYWGDENRTKEDRLWAADDDDGLGAAVEPLGIGKTVPESEEQARRNGRVWMFSGDEGVMDKDGYVAVTGRIKDLIIRGGENIHPLEIENCLFQHPLVAEASVVGVSDERYGEVVGAFVVPHKGVKVVEDRHEAPPKGGAAGEEERAGQVKRLTEKVLTKNDLRDWVKTRLSGHLSPRYVFWVDDYPKTASGKIQKYKLRETATRLVSEA

SEQ ID NO: 22648 - protein, 407 aa, Magnaporthe grisea 70-15
MPSLKQTLTWAVAAAALAIATPVDTKVGTLSLNQEPNPKFEGKSGLHAMVKVFRKYGKPLPETLAAALANATASVTRRDGSAVTTPEAQDTEYLTPVQIGTPPVTLNLDFDTGSSDLWVFSSDLSASLRSGHSFYTPSKSSTSSKQSGQTWSIKYGDGSGASGNVYSDVVSIGGVKFASQAVETASKISTQFTQDTDNDGLVGLAFSSINTVSPKKQKTFFDNVKNSLTKPIIGVNLKAGAPGSYDFGFANTNSYTGSIAYVPVDSSQGFWSFTASGYSIGSSSSRTQLTGIADTGTTLLLLPPSVVNAYYKQVRGAVNDNSAGGFVFDCNANLPTFSFNVGSNTITIPGSIMNFAPVGDGSNNCFGGLQVDTGIGLSIFGDIALKAAYVVFDNSPSPRLGWANKNL

SEQ ID NO: 22649 - protein, 502 aa, Magnaporthe grisea 70-15
MRLLGALLIAPAAVSATISFELMRSTTDSPHPHLGKRSTFVESIANNVTGGGYYLDVKIGTPGQDARMILDTGSSDAWVVSTRADLCGNARLQRQYGDSCGATYNESKSSTYSLKERNGFQIRYLDGSAARGDYIKDDFTIGKTTIKGLQMGVASTTVRGTGILGVGFSSHVTAKEKYPNIIDELVAQKIIQTKAYSLWLNDRRSPSGRILFGGIDTAKFIGALKVIPLIPDVTTKNITSFTVALSGFDIELSNKTKTKIDLRSDSNPALLDSGTTLTYLPAAMADKVFAMFGAVEDKNVTGLAYVSCEYLQKEKDMVMSFTFARGGGTIKVPGYEMILDVVRNLDGFQTPKGLPFKDVCLFGIQSTGQFAQQYNSLEGADFTLLGDTFLRSAYVVYDLDHNQVGIAQANLNATESKIVNLTSSDNGLPRLTGVASQVVNIAVQTTVTGADGLPTVTTTEVPAASESKNAAAGLVVGLGREVASLVGAWTLFAVFGGVFFVL

SEQ ID NO: 22650 - protein, 254 aa, Magnaporthe grisea 70-15
MSTPSPPRRIVGVSTKMYFSAARTSSYITSLLSLLPSVPSNTDVFVIPDHVTLLPSIQQLRAASSPILPGAQDCYSEDAGAYTGEVSPAVLAEVGCRIVELGHAERRRLFAETDASTAAKAAAVVRNGMIPLVCVGETARQAEISAAVADVAGQVQAVMAAVPGSAEVVLAYEPVWAIGAAQPAAAEYVVSVARGIRELECVRAREGTVRILYGGSAGPGLFEKLKDGVDGLFLGRFAHDPEQFVRTIREVSEA

SEQ ID NO: 22651 - protein, 408 aa, Magnaporthe grisea 70-15
MGSHGTDNVGTKAVGTTDVQNTATHDSADMGNNAHTDAVVGQALHQIEARKVHWYSYLTTIDFWIVLALGQVLALCITGTNTLSQLLSNAGTSIPAFQTIFNYVLLTLIYLSYTLYEYGPRKLGRIWLRDGWKYFILSFLDVEGNYFTVLAYRYTNLLSAQLINFWAIVVVVLLSFFFLKVRYRPFQVVGILVCCGGMGLLIGSDHLAGSNGGPGEDMLKGDLFALVGSTCYGLSNVFEEWLVSRRPVYEVLSFLGVFGVVINGVQAAIFDREQFATATWSPAVGGYLAGYTLVLTIFYSLVPFVLRMASAAFYNISLLTGSFWGVIIGIHVFGYVISQLYPVAFVLIILGLLVYFLSGSMLGESKKPWLGDNQEEGHAGFGTAKLKALNLARKQGLTGTAADDSRFA

SEQ ID NO: 22652 - protein, 271 aa, Magnaporthe grisea 70-15
MSEIERAIAAENESYSANSWLDLFRGAANRKRTLIAVIVGFFSQWNGVGVVSYYLTLVLNTIGITDPKDQTLINGMLQIFNWLIATFAGALMVDRLGRRTLFLVSTSGMLVSYICWTGLTSGFVTSKDEGMGRAVLAFIFIFYFFYDIAWTPLLQAYPVEIYPYTLRSRGLSITLITSFTGLIVGNQVNPIAMGAIQWKYYIVFCCLLAVLLVLVYFLFPETKGRTLEEIREVFEGPTLNSVDVKVEEAAGRDDGDVQVEAMHSKHVEAVK

SEQ ID NO: 22653 - protein, 319 aa, Magnaporthe grisea 70-15
MGLAVCVWSTLLRGGTVAMSRRFDASATNERLSAAPAGLGGRMVTHYFCVPQMADALRSAPNFRPARWAALRALFTGGAPNPPARIRWWLDRGVRMVNGYGATEAGHFFGMPLAEDVLRQKAGSVGLAGPMTDVEIVDPETGAPVLPGEPGEIVASGMSVTAGYWGRADRDGGLEVVEHGAGVRWYRTGDIGRQDEDGFVYIVGRRKDIFITGGESVAPGEVETALMQHPLVAEAAVVGVPDPTWGEVGYAWLVLEQGVKERVSKEDLISHCEGLIGRYKIPKHFRCTESLPRTGSGKIMKHVLKKKLESEGFGREKEH

SEQ ID NO: 22654 - protein, 342 aa, Magnaporthe grisea 70-15
MAPPKPQPTLRGAANVPRHFNGALTYAVVLIAVSQINFGLDQGIFSNTQAMPHFYRQFGAPDPKTGKYALDPVFLSLLNSLPFICFFLGLVQGSYISNKWGRRTSMHVMCVWALISAAVCVSARGRVQVVAGRMINYLYIGMELAVVPIIQSEMVPAPVRGFIVGTYQLGLGLGHILASLICRATSDIDSNNSWIIPYGCMFLIPSIILCMLWHMPESPRWLLLQGRDDAALASLRRLRVGRFTEEQIRDELASFRSTINVAADKGTWKEVFQGSNRKRTLIVCGVNVFFQLTGHNFVSKYGTIFLRSLNTFNAFSMSLINSCINTLVIIFTMFLSDMVGRV

SEQ ID NO: 22655 - protein, 409 aa, Magnaporthe grisea 70-15
MGSAGPANPKLFEPLAIANGKHVLKHRVVHAPLTRNRGTPVNKNDSREEPNRLWLANDVIKEYYTQRATDGGLIISEGLPPSLEGGAMPGVPAIHQAAQVESWKPVTEAVHAKGSIFYAQLWHSGRAMIPQHIGGPVPAPSAVPWDDPTEVFWYPPAHTTELCKYVDYPPIEMTVEHIKRTIDDYVKAAKNALEAGFDGIEVHGGNGYLPEQFLSSNSNQRTDDYGGSPEKRCRFVLELVEALAAAIGQENLAIRLSPFGLFNQARGTQRKETWGYLCRELKARLPNLSYVSFIEPRYEQLFSEEDKQKFLDDWGMSNVDLSMFREIFAGTPFFSAGGFDAKTGKEAVEKGTYDAIVYGRYFTSNPDLVRRVKEDLPFNPYNRERFYGPFEDPTIGYTDFATYDEQQKK

SEQ ID NO: 22656 - protein, 415 aa, Magnaporthe grisea 70-15
MSTSTMEETATPAKSVNGSGHRPPLSTILPPMILGSATFNSQYVRDPSAMPARPIVSRAFDLGIRAFDTSPYYGPAELLLGDALAAAARPRDSYLLISKAGRVGPTTFDYSPAAVTASIHRSLERLRTPYLDLAYLHDVEFVTTADVLAGLGALRALQSQGLIRYVGISGYPVARLLELAEAITATTGSPVDAILSYAHFSVQNTILAAPETLARFRRAGVDVVLNASILAMGLLTPGISAGPQESWHPAPEGLRAACVALRKECAARGGKRLEEIAIEYALREWGRLAIDAGVAVGRGVGQQTVGGTVIGVTSVRELEETMAAWASACRDLGLVEDGHKAGVTNGNGHVDAVGGAKGGPEDVVAFVRDVMWPILGEWKDFSWDSPHKGWFGEHGNVTSWRSIYQIWPCQNRSHC

SEQ ID NO: 22657 - protein, 474 aa, Magnaporthe grisea 70-15
MARSRAKRRTHAGAKNPNQQKGPINTGNASIRDPKSMVIRIGAGEVGSSVSQLATDVRRVMEPGTASRLKERRANKLRDYLVMCGPLGVTHLLLFSRSESGNVNLRVALTPRGPTLHFRVEKYSLTKDVQKSQRRPKGQGKEFVTSPLLVMNNFSSSSADAPSKTPKHLESLTTTVFQSLFAPINPQKTSLKSIRRVLLMNREQSKEMDGSFIIDFRHYAITTKPTGISKPLKRLNAAEKLLSGKTGKKGGLPNLNKLQDIADYMIGGEDGSGYMTDGGTSGSEAETDAEVEVLEPTSRKVLNAKARAAMREAENGDEGSQAGTEQQNVEKRAVKLAELGPRMRLRLLKVEEGVCAGKVMWHEYINKSKEEIKAMEKKWEQKQREKEARKKVQKENVERKRKEKEEQKKNSKKSGENADGDDDDEDEMDVDYDSDDYEFDSEGMAGDAETLVNEKAEEDGEWEDEEEEIAAGAG

SEQ ID NO: 22658 - protein, 1367 aa, Magnaporthe grisea 70-15
MSTETSPRAVRFSQGEDERLMRPFVLGADSGNSHSSGELSSPDLHHMVETPDEMGSLTRYVDVTSHGGSHVSLATNGSARSHRNSGGESTAAGYTNGGATPRPAQRPMGPARTPSNTYQPPRKPTAQQTPSYLHTSTSDLRNGSRMRNGYGQQEKEYVRSLRAQHYGGDYFVSYSNGSQLGASSGDGYPDSDSEGETPSSEAPYDDAYDQNVIMIDSNEDTAPSEEELKDPASRERLEWHGMLEAVLTGDVVRQEKKRLIAGTGEDLGKLQRGAELWMGIRARVCGRHLSVQRRMVEETRATLARMIDEVIDFSVKGESTAGKSAAEQIAEVLEKIDKIEGQYPTRNALLAVHTSANTERFQEACDAVYTWTNINYLINTELTILRNWVGNHELDFTRAREKSPNGHHGLSDESSFMDRLMKEEGLKSLHDHEEDEGDRKSRRNGMLHRVGKTIEKAKEALVEQHQVFKKRQMSLDMDELLMLLGFPARLIEEIIKVRLAYTKRMKESAQQNPMMQDNMIAQFQTLLKLAIRIKQEAAKLSEPQPGWELPPCIDESFDQVVLDALKYYFKMLNWKLGGNKNTFKEAELLFQEWGFANEIASHLYRGDIEVAEQFSSLTYKTLNRLAITFEKELQRRPKETPSEMSKRYKQVLESVRVRQRMLQRFSRMLNDNYENASDFSINFRPDKMQEFFLRLQETGHFQVYTGSLEHEGLLVIASPSLANRESEIQSLIGTTAYDEIVQDATNPYILIMRPEGQLGWWGPKIQLSVREEPVELKMGHLRLIAGGSQTRLSNAKQNFLATIEMHLDLLIEQRSNLPKVNARLMEIRKVQYKLSNTFMDSVEIIRNNTKGLGLQDLIQTCFIFATEFGQRSLLYLDSNRRQMNNIKLTKLALDWVGFVCDDCQSSDRKAFKWAVLALEFAMVMTRGRHILALGEAEFVKLRLKVAGCMSLLISHFDIMGARSTVAAQAEKLKLEAMVGQMRRMDHNMMDDQEAIRYVRNHRLSGLNLIDEARKEIALERSALGRVLEVSNEVDRSLAYLSSTATNFTMRWQQGHFVGGGTFGNVYAAMNLDTGHLMAVKEIRLQDPKLIPSITGAIKDEMRVLESVDHPNVVSYYGIEVHRDRVYIFMEFCSGGSLASLLEHGRIEDESVIMVYALQLLEGLAYLHEIKIAHRDIKPENILLDHNGIIKYVDFGAAKVIARQGRTLANQDLMSAATKPNKSMTGTPMYMSPEVIKGENPGHFGAVDVWSLGCVILEMATGRRPWANLDNEWAIMYNIAQGNPPQLPTPDQLSPEGIDFLKCCFARDSTKRATALELLHHKWIMTIRDRIVPQQPPTPSDTSSSSAQNTPNPASSSKGGGASSDGYY

SEQ ID NO: 22659 - protein, 4483 aa, Magnaporthe grisea 70-15
MRMEVGFEIIYCHFEEGGGLDLISLDATALSNETGWVDPQVHAFEWVRAVGLRYDGFPKTRLNIDWSSIVSAYFYNINLTNPDTQRSEMPRVVNATNEERAAIKSKVQETMAVQRHTGNNIDWQGIVDLLVGRYSDRLAFLSKEDITVEDMRQEVNFLLYSYINFDDSDAKPSLERCRAKHLETALLTRPSWTQEDELLFTAVETVSEDICSTLIDMWEILGHKDASLAKPKQYLQGLKSRLNWSTWKKCGTCASVDEVCFVAMFPFGTVEDHYNPRCKNRTEIAGGWRDGDALGRFRKTFKMLLGNVGNVVTTVVGLLATTGVSQAQAVCGDGLVSGNEECDMGAQNGQPGVICDTQCLCVRGLQNVERGNQYCRPMVDVTFRKADVLIVTDTPPGQATEALGEVKAARAWNYSINFITTQAFIPMLPHEIQVHRAVIIVTVPGSPPAGDKEGVNSWRPHTINRFWYLFLSQRRWQPAMTGNVIMFLHRPTTENTTRALNFVSKTMRFAVEGTGTGLWLQPPTEIRSGTTEEINFLQVDFLEQWGNFSMRFTNSYPPSPGVWRYNYRLIGRHRLLGDLSSNDRSNVRGVFGRFPSTFKPISITDNFRPTQNPPYAMTVRGITGWPTVIARYAEEIPDSCPNGVIDRPAEECDGTGGGCNPESCYCSQGYNSTSQSCNNTPQCGDSVLDRVNGREQCDDGPRNGSPTSSCNSQCKCAYGEAYNPLTDAYYCCPAGQYSDGMWDPNYGGIPCRPACGNGVVDRPAEECDGGNDPNCNLDTCKCKWGTTFDPATQQNVCLAEPFCGDSRVTFERGEECEGSQNGDCVDCKCLYGRQTNATGGYTGLCLPRCGNRVLDAGEECDNPADPLCDAASCRCFYGLDPSTNRCHAAPFCGDGRLTLDAGEQCEGSQGGTCVDCRCPWGFVPDAQGRPSGTCYPKCGNRVVDDGEQCDDPADPNCDAATCLCRYGLDESTMQCLDAPRCGDGRLSPEVGEECEGALGGLCDEQTCRCRWGAVLDGQGRPTGDCLPEPVTTPSSSSASPTSTEVSTSAEVSESSSETASAEASTTAVESTASQEPVVSTTEAASTSFEESVDPDFATESSMVPSPSEASASPTPTEVPTSAEASESFTETASAVTSTTALDGITSEEPIASTTEAASISYEESVDPDFATESSAIPSSSAVSATPTGEPALPGSSATTDEPVISESTTASTEGASSTGSPDGESGSTAEPAATITPGPESTAVAQPTDATSGSPATEASASPAPGESGSPTVSPSAGEEGSSSEETASASATGVDGSDQVTGGSETPAATATASQSDGSAQTTAAFPTTGEEESAAATPASPASTISVAESTAVETTAVETGVPADITTAPSTAQETASGSASPAPSDAGNAPEETASSATASESEDGEQATTAASASEDAAVSPGDGPTSVAEGSPAPTDEAATPAPSASAGASEAASDEQVSASATTTGSTDGAEVAPTASLSASPSGSAEDGSTSASEASPGSGDEVTATETAAATRTPSASTSEASNNEEGTASMTATASGEGAQETSVAASADASATGDGTTSTAEGASVSSEEAQATTTAEPSGTASEAASEEQVTSSASATASAEGQETAAPSSGDASSEAEDGQMSASASASASVTLTSPTDDTPVTSAEAGSTPASETPSQTVGDGQASASATSGGSTDEEQATPLPTISETAGETASASGDVSVSPTASQSADDEQATASATASEISTETANASGDVSVSPTASQSDDEQVTASVTASETLAGTASASDDVSVSPTTSETTDDDQVTSPVATVDTQTETASDEVSASPTASQSMDSEQATASASASETPAETANTSGDVSALPTATESTDNEQVTSPVTSLDIPAETASVDGSVSATTTESTDNEQVTSPATTLDIPTDTASVDGSASPTASESADGEPGATSPVSSENATATASGDASALPTAGEPTDVEQATASATASEADAEPTTAEVSASATITGSDAASTITSDETPTLPTASELTGGEQATASATSSGAAVEPTGAEASASATATGSDTASATASGETPASPTASQSIDVEPATPSGITSGADVEPTSVDTSVSATITGSDTASATASGDSSASLTASQSMGDESATPSPISSDAPVGPTGVEASASATITGSTGDEEPTPSATASETGSVSAGVTTADNQASPSPTLSSTASESVGDEDASASATVTSSASDEQAAPSGTASVTASDEEVSSPTPSPVTPTAFTDDGQATPSPTPSPTVSVTEDGDQVSASATATSPASDEQATPPATASASTPDDELPSPTPTPKTSGTASGEGASASPTFTGTASGEQATPSASASERISDDGLPSPTPTPEASGSAGDEGASVSPTFTGTATASGSTPDDGSASPPPIPDASGTTSDEGISASFTVTGTAGDGQATPSPTPSAAVSETVDDEIPVTSAASADDEQETASATASATASAIASESTSDGTLVLTPQSTEAQPTPSASTSDSPDDEPAASITASGTTSDDQPAPSTTPSASTEDGMPAPSSGATETSGAEQELPLPTASASTEVDQLPGSVTASDGTAATPTTAVDTGLGSSEAASDSASAPTSSVEGDGTSPSVTPSEGTPAPTTDADTSPGPSAGTASDAASTATGSAEAGGSSSSEAVSEGTPAATTAEVENDASSGIPSGGVPTATISADPDPSSTAQGSSEVTPAPATSFEGGSSGAPAATLLTPSSAEASPSADPSGSGLPSQTWTTESASSWATAEPSGEQEGTQSAPAAETSLSSQVLSSGSGTDSPPSAEATTSVTGDISVEPPTASVTETSSEASQTAEGSTGGIPGESATETASPGPQETIATNTEESQTPTAGPSAGPSASGTATPSGSTPAESPSEIAGSTTEAPEGGAVSTTESETAAASTSESDAKEPDASVTESPVSGGVSGGESASAVDTATADESTPEPSATVISTASEGAVETTSALPGSSAGDIASSTTQEATATPEASESQTTASPVSETGSETVGEPAGEISGTITITDAPEGTATVSATGTADGSGIQDSGTPSDQNGTQTPSGTATSTSTEETGPADSDASATSPGPSNSGEEAATTATAEPSPTETEASGTSVEPSSAEGTASQSDEPAAGEPTSASGSATAESTATQTDDSQAGGTSLTVGPTTTEGSTLPADETTAATVTNDASTITEPPSTATTASPGEESLTEPTISGTSGVVATDDPPPGSSVTSPTDAVSTTGQTGITQTDDPSSAEETTTAEIEASSSQTAGQTGSEESPTDPSNEVTASFTQISFTFVDGPSTFETLTRSLSAEATGTAPDSSAEGATTTPAGEDASSPAQPLPLRLRSRRHPTQITTTASLQLREPQPQMHQVLREQTRPRLLASPETPAASNTATEETGTTATSATPAETTSNSASDEEQTTAGGTEISMFSQTVAETTAVASEGTSTAVAEADDAATSAAAPTSDAETGPAPPATIPPTNTAAATEKPPTSPDGASAIASATSTDGAPSATTSPWEARMPRFLATASGGRFQRTGCAAGGAEMDNFRLMAREADMTLDRCSEVCGDWAYSAAHDTDCYCSMGIQWDGADTPSGETCEIRCPGNPDQVCGGVVEDAGAGGGSGTGTGDGDGAGSGAGAGSGTGGGSGAETGTGGSGTESGTGSGAGSGAGTGTDGSGTGTGTGSGTDSGTGAGTGGSDTGSGTGSGSGSGTGTGTGTGTDGDSGTGTGGSGTGSGDSGTGTGTGAGGSGSGSGSDTGTDTGSGSGSGSGTDAGTGAGGSGTETGGSGSGGSEGTPISPPVNQRFSIYQKILQDPGSSPAPPAAGQTTSGLTATVTPSPGGSTSDSLADTIATSTLVTSVGGNGQQTGDATDPSSPTTPAAPPADNGGNQQPGNEPNTTPTTLAPGDNGGNQQPGTEPNTTPMTPAPGDNGGNQQPGTGPSTAVPNPSGDGGDQEPGAGPTTPITSPTGVPPANGGNQQPGNATPTAVSTPGGDGGAQEPGGEPNTPVTTSAAVPPTDGGNQQPESTVPTTTVPSSGNGGGQEPDGGPNNPVPTTATTAGAPPANGGNQQPGNAIPITLSTQLGGQQPSGTGFDESALPVAPTPTGSGQPPDGGQTSPPSNTTPGSPAPPATVPGGIATNGPAPRPEEGVDEPIAVDPDNSLPTAAVTTSIPPARDGWPSGVVGTGDEFSLSRFLTSTYTVKPSTSWPSSAQPSEAWAGTAEPSNASTAAPSVPNSGAQTAPTAMATQTVPVVRTVYVIMIKYVCGNCAGETVYVPSCGGRPCKEGERPTAWTPVRCGAGGVDCTGLETFRPETCGVPEEKPEYCRDAGSKHPVVEQRPCEGDGCRDGDVQYVPAEQDGAHPGGSDGSGGSQDGTGAGGEGAKDGGPSAGSPDSDSDPGAGPSGPDDTGAGEGEEGENMPDDGQAGESPEDGLDDYDPEENAGSNEDDGTDASGRDDVYPYPKTASAHAIVTPRRSVVLLAIAVVMFGQAL

SEQ ID NO: 22660 - protein, 360 aa, Magnaporthe grisea 70-15
MPYPEKFTGFQVKSPDSWTEFHKNEFDPKPFGDYDVDIEIECCGVCGSDVHTVSGGWGEQKFPLVVGHEIVGKAIKVGPKVTLIKEGQRVGVGAQSYACLDCKQCKNDNETYCKKQLDTYGSVWPDSGVVSQGGYSSHVRTHEHWVFPIPDALASTIAAPMLCAGLTAYSPLVRNGVGPGKKVGILGMGGIGHFGLLFAKALGAEVWAISRSRAKEADCKAMGADGFLATSEKGWNEPHAMTFDAILNTASSFEGWDFGAYLGLLDVHGKFVAVGLPEGEGMKIRNQDLLSNGVFIGASHLGSRRETIEMLQLAADKGIKSWVEEIQIGEDGLKEALTRVHKTDVRYRFCMTGYDKVFTA

SEQ ID NO: 22661 - protein, 364 aa, Magnaporthe grisea 70-15
MAATDYKFEGWLGDSPESANGKMRWGEFEPKKWTEDDVDIKISHCGICGSDLHTLSSGWGPTPYPCCVGHEIVGRAVRVGSNVKDIKVGDRVGVGAQARSCMSADCPECSIGRENYCSTKGQLINTYGSVYPGDEGKSYGGYATYNRTNAKFCIKIPDGVPSEYAAPLMCGGVTVWSPLKDNKCGPGKNVGIVGVGGLGHFAVLFAKAMGADKVVGVSRRESKRKEVMSLGADDYIATEDEKDWEKHHRRSLDLIICTVSHTGMPLDKYLMLLKPNGILINVGVPEGGALPNLNAFTLVINAVSVGGSLIGSPSEIREMLEFVAEHNIKPLIETRPMKEANQAILDMEHGKARYRYVLVNEDNE

SEQ ID NO: 22662 - protein, 428 aa, Magnaporthe grisea 70-15
MDTSDHAIARRHIPYGITAPQNDEEQRVLSIAIVIASSLSILGAGCIILSFATFRGLRLFRHRLILGLAVSDFLRAVVILVPAALDLANQPLTAASNYSACVCDGFMVQLFVTQSDYWILTIAIYTFIIVTGQKQTAAWIDNHQPVVLVIPWALSLISAGVSLTITSYNDIGSWCWIHQESVRLWYNFVPRWTIIVAMLVMYARISVVLRKAQRGFGTAVSKKTTAGRPSSGEPKPDGINAFEPLSLAEEGGRCSVTENSNRLRKLARHMAMYPIIYIILWILPTIVVLYHVSTNTAAPFPLQTVDKSFIVIQGFVNAITYGVSESSVACWRTLFFSQDIEEITEQDGPHFPGSPRGMTSEQRNSNALISQSLSMPLAPESPSGSIYEELGNDADNHHPAVFDNETGSLGLDDLGDSLDHSAENTSIL

SEQ ID NO: 22663 - protein, 334 aa, Magnaporthe grisea 70-15
MSANLEAQAAAEATLQGFLWRQREAPKPLPAGTSAKGQTSIITGSNTGLGLEASRQLLRLGLSHLVMGVRSKERGEAAAEQLRAEFPDAKISVWIVDMASYDSIRAFAAKCGAELERIDSVILNAAVQTPQFSLVEATGHELTMQTNYLSTAFLSLLLVPVLKAKKKEGAAPPVLSIVGSDTSYMTTLLSMNPALPACDKPENYSQFQAYARAKLLLVFFVAKLAEHVDPADVIINYPNPGLTKGTEIGRSATTLSKVTFAAMQYLLARELDVGASVYLDAVFNYGAKGHGSFISDWTIKPYPPVWYTEEGKQLRTSLWEETLNELKPAGAPLP

SEQ ID NO: 22664 - protein, 325 aa, Magnaporthe grisea 70-15
MSGFKYSIIITGGTAGMGFAAATQMAKDCPDHLIVIASRSSNDDAAGAINKSLNQSNTQFLPIDLANPTDVRRFARDWMADESKPPIKALVFNAALQFPNGLTLTPDGMEKTFAIAHAGHALLFHLLFPRLVPRGARVVLTSSGTHDPAQRSGMPDPVYTTAAQVAYPPPERAALPSRAHYTTAKLCNVLWAYALARHLGDAVPERSVSVTAMDPGLMPGTGLARETTRVQRWLWVAVLPRLLWLLRMVFSPNVHTAEESGRSLARLAVGADVEGVTGRYFEGREEIMSSKDSYSEKLQEDLWDWTVNFVAGGDKAEAERLNAFR

SEQ ID NO: 22665 - protein, 332 aa, Magnaporthe grisea 70-15
MSNYYGAPNNQAYRPSSAQNLQFYPSTYSPGVGGSAQPQQAGYGGYGAPPAQQGGGYGVSSGAGFNSGFGAAAGVSGRMGEQGGLRTGLLAAFSTEGYEGEPPLLEELGVNWDHIWTKTLAVLNPFKRIDQHLMDDSDQAGPILFFILFGFFLLFSGKLHFGYIYGLAALGSIGLHLILSLMSPSDGPHSSAPGAAPPYSSSPAYPDAPGSAVSGGGPGQQAGGHLSSTLTIGRSASVLGYCLLPLVGTSAIGVVVPMDTPFGIVLTAFAIMWCTYSASGIFVAVGRMRGMRGLVAYPLALFYVGFGIMSIFSSRGSGSMAKLADASSRAAA

SEQ ID NO: 22666 - protein, 297 aa, Magnaporthe grisea 70-15
MGLELVRTLAKTGMRVFFTARDPAKGAKVREMLRAEDASFKLELVVVELKSLKSVEAGARHILDRADRLDLLMNNAGIAATPHGFTQDGYEQQFGVNYLAHFYLFQMLKPLLLKTAAEHGVQVRVVSTSSTAHTASTVLPAGDYGTADPNGRGYEPGVSYAHSSTARIWFCNEAERRYGPRGLHAISTHPGGFASGLMDSADEQARAALARAIEMPHIRRIWKSVEQGAATNALAGVGREYDGHGGFYMEDCGVARPVPDHLDWAGHGYKSWAFDEAGEKRLWLDSLEMLGLQDDQE

SEQ ID NO: 22667 - protein, 359 aa, Magnaporthe grisea 70-15
MSTSSGTPESWISSFCSLIGHEYFAEVSEEFIEDDFNLTGLQTQVPMYKEALEMILDVEPEDDEDEEDEEEEDEIDESGDGVGAAARHGERRNHSRIASDLSMIESSAELLYGLIHQRFICSRAGIQQMSEKYELGHFGSCPRTNCNLARTLPVGLSDIPGAGTVKLFCPSCLDVYVPPNSRFQTVDGAFFGRTFGALFLMTFPEFDLTKHGADALSGGSHSLSSMRLQGEDASGVVVNGFHARNIAPGLGRGKIYEPRIYGFRVSEVARSGPRMQWLRDKPENVTELDEAKRYIEEHPDTDDEEGDLNMNRNGASSRRRPVGNARLRQQRRQQNGSPMAVTEQMGQSRNCESIYPNRR

SEQ ID NO: 22668 - protein, 1598 aa, Magnaporthe grisea 70-15
MSHLLWRAYWQNDVDRFRRLLAPSGHTNHATSHRASLGGGAGGGSGGAGSPNALGTSPRTVATPNKARKSSMPFGGPGGGASGIGKAEVNSRDYMGLTLLLRAASSASENALAFVRALLDHPAIDIYAQDPESGWNALHRALYYGNISVARMLLAKERRDITEGVYKAGGAAASISRIGQLIKTKDHEGNSPFDLFATTIGDADLEFTGTIPDSNDAGDSTEDGAGSDSEEYPAHQPTSGNAGLQDLTDGDELFSFGSNKNMSLGVGDESDRQYPERLHLRRPDHLLYRFYAQYLEKAGLEQTQFPKLEELPAMILTRPIIVHNVVLSKFHSAVITTDPVSNLYICGVGRGGRLGLSDDQRVRFTYVPVQGALADRKVTQVVLGQDHTMAVTDKGELWTWGSNAYSQLGYALPPPAKKDEEPMSLAPKQVFGALKKEVVIGVSASAIHSVAHTTNSVFCWGKNSGQLALMDADSRSLEVQQTPRKVAASLFSAPIVMVSAIDKATTVLLANHIVCVFTNYGYNMVKFPEIDPFATYHISNPAVVLGYDAAASKGQRICHITSGGETIAAVTGRGDLFVMGLNHNADVSSSASTTNPAKIKGSVSQPQCIWRAWKDGVKSVGVGDHGSVIIATKSGAVWRRVKRATAKDAYAGVGAKRKDYKFQRVPYITRVVTVRSSPSGAFAAVRRDSSVMKQLGVGRQEIWEDLDALLPLRGLVALKPKFDNAMAAKLLPKRFSEDDSDTGRAIVAMLQSSDPNADLAHHLDSFTSNDLEGADIWISSSSCPDLKVPVHGWLMSARSPTIRAALAAYRSHGAHTIADCLAIEDMDGKACIQLESLELSTVLNLILFAYTDRIAPAWNIRQPSPSLTQASRQQRVELMKVAARLGIAPLEAAARLQNDPNRSLADDLGTAIKEPSFFDDGDILLELEGGEVAAHSSLLCQRCPYFEGLYNGRSAGMWLTGRRDDAAVAEPVKIDLKHFEREPFEYVLRYLYSDAGTELFDEAVAASFDDFTDLIMDVMAMANELMLDRLSEICQKVMGGFVTTRTIAHLLNEISPCSVTNFKEAGWNYICTQMETMLENHLLDDLEEDVLQELDEQVKVNQANHASKCDSEQRLLETYTDLATDIEEERMVRVKEMAYKASQKEDDRKLSASFKGRVGSLDDGTMTTSTPDKGKRKSTRNEPFSPSLRPKVSTADLMFAMDEDDDGVLSPGGKQQQQPSFSRSEDPSIVSTPRRPAAHRSSSSIHTPAGRVDITISPSPINASPLTKTGSPWQQKPLVTSKLDLRDIMSEDSMNTTSALSAGLAAQKQKEANVKAATANVSQPQKMSQKERKKHQQQMQAALLAQEANQPNKTPWEAVPGQKDRGSPWKPTPATTKVSLKDVTAAEKHTPPASAAASMAKPFVAAESSPKPAQRRTASPDTRFAGQSRTPKGLEGRSPQPSSSPLVPHSKSYMKQHKNQKAEPTLGLSMADIIGQQRREQELVKEAVAKRSLQEIQQEQEFQSWWDQESQRIQEEERRRAALLAARDKGANGEGSSEGARGGRGRRGGRSGGKSRGGSAAAPAGGTSSPAEGPAADQKGPGRRSRGRARGRGDSKKA

SEQ ID NO: 22669 - protein, 251 aa, Magnaporthe grisea 70-15
MAPQAIIAPSILSADFGNLGEECSKTIGQGADWLHVDIMDGHFVPNITFGPPVVAKIRGHVDRPEAAHGKGTFDCHMMIAEPKKWVKEFKAAGCDLYCFHYEAAFSSAAEEPSATSDAKTSPRELIRYIHDQGLLAGIAIKPATPADVLYELLDSSDAAERPDMVLVMTVEPGFGGQKFMASELPKVQALRQRYPELNIEVDGGLGPGTIDQAADAGANVIVAGSAVFGAKDPAEVIKVLRESVQKRAGKI

SEQ ID NO: 22670 - protein, 479 aa, Magnaporthe grisea 70-15
MGGEKDFIVPLVIGGKEKTTSDSFPVVSPATGETVHKCSNANVADAEEAVEAAAAALNDWKRKTPAERRDIFLKAAQILVQRTDELASYMESETAASRNWANFNLDLTREMLIDVAGRISAATTGAIPATRDANLSAMVVKEPYGVVLAMAPWNAPYILGMRAVLFPLAVGNTVVFKGSELSPRTMWGICSVLAEAGVPHGALSLIFCSRETAASVTETLIAHKHMKKINFTGSTSVGRIIGRLSGQHLKPVLLELGGKAPAIVWEDADLDNAAAQCTLGAYLAAGQVCMSTERIIVHKAVSEQFRGKFAACVDKFFPSSADAPILVQSQGVTRNHELLKDALSKGAEVVVGDAEAKEANAHSMRPVAISGVTPDMDIYMTESFGPTVSLIEVSSEEEALRIANDTEYGLSSAVFTADLRRALRLAHGIETGAVHINSMSVHDETGLPHGGAKASGFGRFNTADGLNEWLRTKNITYRI

SEQ ID NO: 22671 - protein, 489 aa, Magnaporthe grisea 70-15
MPPKFTANPQKPSRYRAGKPTQPESSSESDSDDEQPREKAAKKVPEPAAAARKPTGAGKIISTGSASKSVVPSVKPSTGVDAAARARAEAERKAKEDGFVTESEESGSGESGEEDSDDESGSSSSSEDEAPRRRLMMRPKFIPKSQRNAAQDASASGDKPDEEADAAARQAALDAAIEEQVRKDAAAKAAGQKHWEDDSDAEPGSDFVDDTDDIDPEAEYAAWKVRELKRLKREREAIEEREREVQEKERRMALTEEERRAEDEAKIAKQREEQANRGKMGYMQKYFHKGAFFADDAAREGLNKRDLAGVRFQDDVKNRELLPQALQMRDMTKLGKKGATRYKDLRSEDTGRWGDSGGKDRYGRGLGDRFDGDERFRPDNDRGGGYGPDGAKGANAIPLGERKEDSRRDRYQESRRDDSRDRDRKSYRTRSRSRSPRRQDRRDYDRDRHTSRSPRRDRRDYSRERRKRSTSRGGRDGDHGDKRRRIDTR

SEQ ID NO: 22672 - protein, 343 aa, Magnaporthe grisea 70-15
MPETMKAVDVRGGAGPASALFINAETPRPTPGAGQVLVKVSAFGLNRMDLLQREGKYPLPPQAPKTLGVEFSGVIESLGDFSASASTDADGIPFKKGDAVFGLAYGDAYAEYIAVSARMLMHKPAGLTHEQAAGIPETFITATQALHLVGGFAKGDRVLWHAGASGVSIAGAQLARRAGAGAVFSTAGSDDKCAFLREELGVDGAFNYKTQDWAEEVRRATGGRGVDLIVDFVGADYFSKNMDAAAQEGRIVCLGLLSGAVVKEVNVAQLLFKRLRIEGSTLRARDEEYQGMLRDRLEECLPQFETGELKVFVDKVLSWEQIQEAHELLEKNVTRGKIICTIP

SEQ ID NO: 22673 - protein, 162 aa, Magnaporthe grisea 70-15
MAPKMTSKKRARDEEAQSGGSEAETKPAPVKKAKSKASNPGGSQVDAEGNPFWEISDKRRVGISQFKKMDFINIREYYEAGGEMKPGKKGIGLTVDQYTAFLKAIPAINAELRSRGHDITDDSDGGGAPVVAKPEGNAKKSTKKQEKKANIEATSDEGSGSD

SEQ ID NO: 22674 - protein, 1533 aa, Magnaporthe grisea 70-15
MYPGSSQSRPYQVPPPPPMSPPLSQMHQQMSFVPPPPPPLNRYQTTPNLGASAPPPPPPGPPPASALNPQAPWNGAWGGVPAPRQAYDNRSGMYAQAPIQQYNPQAHAATAPGLNIPPPPLQTDAPMSDTYNPGQDPMFDGFMPDLSFDLEQETMGSSQTWQTTSSSSTNTASVNDNVQSNAPTEERTRRNNSASITGTQSSSNVPGIPSDITASWSLDKVIAWLQMNSFSRDWQETFKSLNIHGAQFLELGSGHFGRGNFGMMHQQVYPKLAKVCTASGTGWDQPREREEGKRMRRLIRGLVHARAVPDSARVPSSHGRQGSINSRGNDKGTHDGSDSPNTPIMKTPSSQSRSTTIPTFPDGSSFSNHRGVLKNIDIDRHSSPKLNGDSPAASPNPVMASSTPKSSTLSVSPHSSRFGNNVRNSTDSVKAIYGSGIPADAQKMMSNSNLDELINGRGARQSPSDLGDNSAGTDSPVSARDTKLPFRQRMQAKDIDGNLSSPNGEGSLSPQMYRNGLGLDDYLRFKKPGGSIYLMATADGWNYRVVDVTDVETVLDLRSEISRGLGIPDEDGVEFYLTELGKSDHSQPLDDNQLMNHNKSRADAEGTLKLFVKPPPMSQQSTWSAGDTGQRHRFGTSSSMSRQQNTLKDDQSEEARLRAQREYKAEIDRKGREYLAIRKAKLESNNNGLSSSTEGIGIVGKPVDFDTPRHSPYEDKNTDRMFPTRNAPAPPVAPSATLNRVNSLMTGQRRVQGSMDGYPSQRVPPGVGTTTSPKEMSEDRRRQPMSGSQPMGGITSALVDMGRNLGGVALPNRGVSANNVPSKPSPPYRVATAPVSGRDFVSPDNRAAFPRSQTAGDLSPISQMPANFAAYQEPNPSPRGFGAAPVSSAAHKRAPSGPDIDFTEPEVSFDRPAPSTAQNEAQSDDDSGDDSDDGLFVIPIAARKASMKKAKSRASVTFDASDSGDGKRPALTVNTARDRKSVSFNSPQSARTGDDDDDSGRQRRTPKSDMWDSEDGKLGRRKSFKMDVWANRPPAEALINNLEDFFPGMDVDQPVLEEGDQEQNIDGSPVAPSPIAEVDETQSPGHLQINATPLNSLPPSRVQSMYNESDTLGSDESTLKALERPPSFQSLAQRSVRRSGGLGRMKSIREKARGAHEAHKRYTQTSMAAPQGLSRSGGTPATETQPTQNNSSALLRRKSTKMFNANIVQIRPNRDSMLVPDIPQDSISSSSRGAPKHPTTFRWFKGQLIGKGTYGRVYLGMNATTGEFLAVKEVEVNPRAAAGDKKRMKELVAALDQEIETMQHLDHVNIVQYLGCERKETSISIFLEYISGGSIGSCLRKNGKFEESVVQSLTRQTLSGLAYLHREGILHRDLKADNILLDVDGTAKISDFGISKKTDNIYGNDKSNSMQGSVFWMAPEVIRSQGEGYSAKVDIWSLGCVVLEMFAGRRPWAKEEAVGAIYKIANGEIPPIPEDVQDTISPIAVAFMMDCFTVDSHDRPTANKLLSQHPFCELDPNYNFLDSELYAKIRGTY

SEQ ID NO: 22675 - protein, 512 aa, Magnaporthe grisea 70-15
MDFVIDGWGVASEESPKNGDAIAAAETPVMDEFARSKTGYVELEASSLAVGLPEGLMGNSEVGHLNIGAGRVVWQDVVRIDQSIKTGEFSKNEVITQVIEAAKSGNGRLHLCGLVSHGGVHSKQEHLYSLLKAAKEAQVPKVFIHFFGDGRDTDPKSGVGYMEELLEKTKEIGIGQIATVVGRYYAMDRDKRWERVELAMKGLVLGEGEASEDPVKTVKERYEKGENDEFLKPIVVGGDEGRIKDGDNVFFFNYRSDRVRQITQLLGDVDRSPRPDFPYPKIKLATMTRYKLDYPFDVAFEPQKMGNVLAEWLGKQNVPQVHVAETEKYAHVTFFFNGGVEKAFALEERDESQDLVPSNKSVATYDKAPEMSADGVADQVAKRLGEQKFPFVMNNFAPPDMVGHTGVYEAAIVGCAATDKAIGKIYEACKAHNYVLFITADHGNAEEMKFPDGKPKTSHTTNKVPFIMANAPEGWSLKPVGGVLGDVAPTVLACMGLPQPEEMTGENLLVKA

SEQ ID NO: 22676 - protein, 400 aa, Magnaporthe grisea 70-15
MATTQTTQGQIQPCRYKVGKTLGAGSYSVVKECVHIDTGRYYAAKVINKRLMAGREHMVRNEIAVLKKVSMGHQNILTLVDYFETMNNLYLVTDLALGGELFDRICRKGSYYESDAVDLIRATLSAVAYLHDHGIVHRDLKPENLLFRTPEDNADLLIADFGLSRIMDEEQFHVLTTTCGTPGYMAPEIFKKTGHGKPVDIWALGVITYFLLCGYTPFDRDSDLEEMQAILNADYSFTPIEFWRGVSDSAKDFIRRCLTIDPTKRMSAHEALQHPFVAGYLADKGANLLPTVKKNFNARRTLHAAIDTVRAINKLREGQGLNGQRLMAGVKSREPNKAAAAAAAAASIPTSTGEVGTVGAATHKDSGYGSTRPDALRPGVETNKVVETSKGLWTGVGSRG

SEQ ID NO: 22677 - protein, 1068 aa, Magnaporthe grisea 70-15
MQLKNTDSSGGVAAQVEPVEFKKGSSSLPLGQHVAIDSISGPTYATAQLLVQQIAYKLSDKIFSYSPETFDLDLAVKQWASDKENNIHGYATDVLPLQIRTGAGAFALGYIFSKDFDLSKRHIPQSLLAPSASIRHLREALDQLSLLYGVASPFVAHIAALDYSKQDGLVAEYGSALQAAEELGLALVSSSSAYETQHMAIFATLLAGILPTLHIYDGVRTARETLRIVDGLNEAGIKDVYNKVFQAVGSLNKRQDDASKVLETLKAFNEELGTDYRPFEYFGHEAPETVLVVFGSVESQIATQVVSYLAGQDKRVGAVVVRIYRPFIEEAFLDVLPDSVRQIAVFGQVHGENQVVDASVQSVLYSDVLTAVSFSSKWNNEPTIVDSKYAATDALTPEALATVFSTLIAKEGQTFDVRISQLQEAQQFSFWDVDNAAAVSVPTAVGHLLTKQSNNNISLDEVHDSVVQGGIVRTDIRSSKKIADAPYQIEEADVTYVGDENLLKDVDILRTNKENGKLVLRLPTYKAEDLEKRIPADSRKTIQERAIELHVLDTAFSPAYETIAKQLVEMAFLKVAKPELSTPELVKLASSIDEPKAVQESVDALAECLHKVDVPESWAEVPSEFVPPRRLKQIKNRSFQPFQKEEPEEVLDLSNWEAAAKGLIFKEAYGTADSLRPDLTVKTFKITVKENRRLTPLTYDRNIFHIEFDLGDSGLTYQIGEALGIHADNDPVQVQDFIKFYGLNPEDIVQVPSREDPAVLETRTVYQSLLQNLDILGKPPKRFYEALAEFATDETEKQKLTNLGGQVGAEEFKQRSEVDTSTYVDILEEFQSARPSFTDLTRIVSPLKRREYSIASAQAVTPTSVALMIVVVDWVDPKGRTRFGQATRYLSQLPVGATVTASVKPSVMKLPVADTAPLIMAGLGTGLAPFRAFVQYRAMQKAQGKDIGAILLYMGSRHQREEYLYGEEWEAYVDAGVITLLGAAFSRDQPQKIYIQDRMRQTVDQIVQSYITDGGSFYLCGPTWPVPDVTAVLEEAIAQDAKATGRKVDPRKEIDRLKEDGRYVLEVY

SEQ ID NO: 22678 - protein, 276 aa, Magnaporthe grisea 70-15
MGAMEDQLQRLGSVLDSLDARVKKLEQHPTLGGGSSTAQEIRMILIGPPGAGKGTQAPKIKEKFSCCHLATGDMLRSQVAKKTPLGREAKKIMDQGGLVSDDIVIGMIKEELDTNVECKGGFILDGFPRTVPQAQSLDAMLQARNQKLQHAVELQIDDALLVARITGRLVHPASGRSYHTTFNPPKKAMTDDVTGEPLIQRSDDNADALKKRLATYHSQTAPVVDYYRKTGIWKPIDASQEPGTVWKSLLNIFDGDAKKASSAGGGILDKLAASGR

SEQ ID NO: 22679 - protein, 211 aa, Magnaporthe grisea 70-15
MADLGGFLPNAVVLIGDSGVGKSNLLSRFTRNEFNLDSKSTIGVEFATRSIQVDSKTIKAQIWDTAGQERYRAITSAYYRGAVGALLVYDISKHQTYENVTRWLKELRDHADANIVIMLVGNKSDLRHLRAVPTEEAKAFASENHLSFIETSAFDASNVELAFQNILTEIYRIVSSKALDSGDTPSMPQTGTNIALSNPTEDSAAKNGKCC

SEQ ID NO: 22680 - protein, 321 aa, Magnaporthe grisea 70-15
MFGRSAPKFDPAKDIPNQAGRIAFVTGGNGGLGLETVIQLAKAGMERIFIGARNEEKALKAIKEISTNLNCSTTFTFVKMDLTSFDSVCRAADQVISQTDKLHLLINNAGVVGTAPGLTPEGYETQWGTNHMGHALFTRLLLPLLKQTAEGGRVDVRIVNVSSLSERMCALHGCGDLEVFKRAEAKGPLWGAGLFWGYGASKLATILHARMLAKKHPSVKAVAVHPGTVKTTITGSFSKTSPFIGGYVMPFITALFFVDVSEGARNQLWAATSDQANTGEYYAPVGRPNMGSGKSRNMKEAERVWEWTERELDAYLRKTGR

SEQ ID NO: 22681 - protein, 512 aa, Magnaporthe grisea 70-15
MGAVELQGQPLILTVSALTSLGFMLIGFDNGLMGGLVNSPAFNATFDSPASDMIGVIVAIYEIGCFFGSLCSAIFGEKLGRRRSITIGAWIMIIGAILQASSYSRAQLIVGRIVSGYGMGIINSTVPVFQAEFSPKSSRGVYVCAQLSTLNFGIFLVYWIDYAFSSITSSYAWRIPVILQCFCIIPMLFIITIVPETPRWLASHDRPDESLQILARIHGTSTDDVEVRRMHSVIMQTVAIESSVSSGGWKDLLKSDSIKSRRRLLIACAIQSFQQLGGINAVIYYASTLFQHSIGFDAHMSSLMSGFLQTWFFLASFIPWFLIDRVGRRPLVRHTRPVPSMSKRMLLTAAPLQLLSMISVMAAVMAIQAALIYQVQNETAIARSAGIGAAAMLFVFQGAFTVGFQATVWVYPSEILPLRMRQQGSAISTAMNWIFNYMIVQVTPIAIDSVGWKTYIIFAVLNATWVPIIYLFFPETKGLELEDVDRLFAGEDLVDRMDHKHMGEATTVDKLE

SEQ ID NO: 22682 - protein, 341 aa, Magnaporthe grisea 70-15
MAPPAQIPTRRMGKDGPEVACIGFGLMGLSFGYGAVESEEERFKVLDRAWEIGATNWDTADIYGDSEDLVGKWFKMHPERRKDIFLATKFGVTGTIENLSANSSPEYCRQASRRSFERLGVDYVDLYYVHRLTESVPVEKTIEAMAELVKEGKVKYLGMSECSSSSVRRAHKVHPIAAVQVEYNPWDLAIEGDEGTNLLATCRELGISVVAYSPFSRGLLTGALKSREDFNDPTDCRLFLPRYSEENFPKNLELVAEIEKIAKEKGCTSGQLVLAWLLAQGNEIIPIPGTKRIKFLEENTAAAHVKLTAEEEKKIRNLVDKANIQGDRGAFINSYGDTVEL

SEQ ID NO: 22683 - protein, 418 aa, Magnaporthe grisea 70-15
MSPPRFEAAPADPSPLGTPLKYPVSGRSAPNRFLNAAMSEGLATFDEADPSKRGIPTEQLVQLYRRWGQGEWGQIQTGNVMIDPEHLEAPGNMVVPRDAEPSGERFDMFSKLAAAAKEHGSLIVAQVGHPGRQARGSVQQHPISASDVQLKQEMFGSKFGVPRPATKEDIKAVIEGFAHTAEYLEKAGFDGIELHAAHGYLLAQFLSETTNQRTDEYGGSLENRMRLILEVTAEVRRRTSKNFILGIKINSVEFQEKGFKPEEAVQLCEALEAAGMDFVETSGGTYESFGFAHRKESSRKRENYFIEFAEVIRKAVKHMVVYTTGGFKTVGAMVDALQGVDGIGIGRAAGSEPDLAKDIIAGKVSSIIKYAMGEDEFVLQLTACSAQIRLMAKGEEPFDISNADEVARVTQLMAEGKV

SEQ ID NO: 22684 - protein, 1050 aa, Magnaporthe grisea 70-15
MAAVDEKSVGLGRSPSDSDMADGQVVGVDRDADVVAKYGETQRGLSPRHVQLMAIGGSIGTGLWVGIGGVLSKAGPLSVLLGYAFWGLLYIWPLNLCVAEMCAYLPIRGTIFELARRFVDPALGFAMGWTYFFAGLMLVCTEYAAVATIMQYWSKDINPAVWIAMAMVLCIMLNVVAVKWYGESEFIMASTKVILLFGLIILTIVTMAGGNPQHDVYGFRNWGDGNYIHPYLAQGDTGRFLGWWKVVIYAAFTIAGPDMIALAAGEIVNPRRTIPRVAKLIFYRLVGFYFIGVLCVGIICSSRDPRLMGALADGASGAAASPWVIGIENLGIRVLPHIINAAIMLSGWSCGNAYLYSASRTLYGLARDNQAPQFLLYCTKQGVPLYCVLTVSLISCITFLVSSNSAVEVFFWFVDLTTTALIMTYTMMMITFIGFYRARKAQGMDPQTLPFLAPFTPYSAYLALFLGCVAVLFVGFDALGPFDVRSFITAYFALGFGAFMYVFWKVVKRTKLVDPREADLYSGKKEVDDECRHWEEGGIEEVERARLAQMSFARRCWERLCLVHPSLDMRRPDIRPNHLPEPVDPPRARPVNPHHLDAAGPGTNNIKRVRRDQPHIIDTDRTVASAPTAAAPARRGLGDEVVVDGAGGLEGAHGLDAERRLLKDGRVARQRGRAGDARAHGGRGAVAEDEAAHVAAALAPLRLELPQALLHVAVDGQRVVAALQRGHGLRAQGHAGLGGGMLEGRFGDVGKGAVYSWKKENEGGVGVGFLRTTAVEQMEDDTDSTANHNIDIFRDCVSAVLVERLSQQTETKTKKKRSSKRNSRRKSTTHQPDPDVAGAGSAETVTTTTAPPPQAQNDDAEELSEFIGYVADTTFDLLPPELRLLTNRSWTEDPSLADRYSLPLTGPSLTAVLPTAVDPDVSTALSAYGDPEDLLAPVVTAYITTATAAPVKVTRGQADECELCGRDWIHLTYHHLIPRMVHDKVLKRGWHREDELQNVAWLCRACHNTVHRFASHEDLARYYYTVDLLMAQDEIAAFAQWVGRLRWKGR

SEQ ID NO: 22685 - protein, 352 aa, Magnaporthe grisea 70-15
MPEIPTEQWAQVIEKTGGPSVYKKIPVAKPGPDEVLVNIKYSGVCHTDLHAMNGDWPIPTRLPFVGGHEGAGVVVARGELVQDVEIGDHVGVKWINSSCQNCDFCRSANEMLCPKVTLSGYTVDGSFQQYAIAKAALVARLPKEVSLEAVAPVLCAGITVYKGLKETGARPGQWVAIVGAGGGLGAMALQYARAMGLRVIAIDSGEEKRRACLEDLGAAAFVDFATSADVVADVRKVTADGLGPHAAVLLAVTSRPFQQAAEYIRPRGTVVCIGLPSGAQIKADVLDMVVRLITIKGSYVGNRQDTAEAVDFFARGLIKAPFKTVGLSELGKVFEALEQGKVVGRYVLDTSK

SEQ ID NO: 22686 - protein, 496 aa, Magnaporthe grisea 70-15
MSLVTELKTPVTGAYQQPTGVFINNEWVEGVDKKTFETINPSTEEVICSVSEATEKDVDIAVKAARKAFEGEWKQTAPGQRSKLLTNLAELVEKNLDLLAAVESLDNGKSLAMAKGDVGAVAGCLRYYGGWADKIEGKTIDIAPDMFHYTRSEPIGVCGQIIPWNFPLLMLAWKLGPALATGNTIVLKTAEQTPLSALVFANLIKEAGFPAGVVNIISGFGKVAGAAISAHMDIDKVAFTGSTVVGRTIMKAAASSNLKKVTLELGGKSPNIIFNDADIEAAVSWVNFGIYYNHGQCCCAGSRIYVQEGVYDKFVAAFKERAEKNKVGDPFKEDTFQGPQVSELQFNRIMEYIKSGKEEGATVETGGERHGDKGYFIQPTIFSNVRPEMKIMKEEIFGPVVAMAKFKTEEEVIALANDTNYGLAAAVHTKDLNTSIRVSNALKAGTVWVNCYNMLHHQLPFGGFKESGIGRELGEAALANYTQNKSVAIRLGGPIF

SEQ ID NO: 22687 - protein, 1717 aa, Magnaporthe grisea 70-15
MAPAPPPLPTRFPCWCRAVYSWGGESKRDLGFIEGDLIECLNAGDGSWWTGRLRRDRRMVGVFPSNFVELLPDNFRPMSRSTSPLPQNNTPSPKDTPQKSRTFRKPFEAYAKAPHYTTAKQPETYKESPTHSRDASATSVAARAPSPAPPRAHHQSSHHQSSHRAVSPAPTHRYDDMRRAASPAPSHRYDDIRRAASPAPTQRYNDMRRAASPAPSHRYDDMRRAASPAPLQRYEGMRRAASPAPLQRYEEMRRAVSPGGFDAFGSRAPSPAPSDIAYKPYRPSVGSFDSAQQLNLQDGPESPPPPAPPPHRHVPRHNSNMSYDSQNGAGLERHVSNLSYDNRQAGLSRHGSNVQYDHQQPEIEGSRHGSNVPYGLRTTGYHTPRAPSPCPPSPGLGRGGMTPSPLREAMDGVMEQLGALGLPPQDPSPEPTTFDPWSPESFDMVHQQSRRRNNKKEQLRPQTSMGIARADSGYETYSGGSSQGGSQENTLNNVGHDPDELGLPQLSNYVERMETRLRNMHNQSSSRVDDEMAPPPPPKSQAYERPKSSMGGSIHGSSGHSGSQPKLRHRKSAYDVGRQVLGRTFTTKTNSTSTSSGNQSTTTQSTSHSLMSGASAGGISATSAGSLARKNQHRRAQSAMSMREPELDRPETPFTGVTYHSSHASDAQVTRPKSQVAYHNDDPMANIGGLGGLTTPKTKKSNFFKKILESAKTGVASTRGSIATAGAGSMNSPRGRSTPNGFIGIAGGLAGPGAGRDTAREMGLGAGVDWVQIRRDVNRSNTLSRNEGSERRERCQMMDYPALDPVDELYGSIDGDEGADGMAVAEPMNYAAINLSQVDKNSRFISGLPPTTTSITLATTYVCRPYRSDVQRLRAIFTWVAEKICWEEDFEGQIDTRRSIASKRGCAEEYAVLVYEMCAAVGIHCEVVRGYLKSPGEVPEMGLMPRSNHWWNAVLVDNEWRMIDACLASPSNPQRGLYSSAGSGVADAFWFLTRPTEICWTHIPEHHGQQHICPPVAHEILLNLPCASPPYFRNGLHLVDYNTSLTRIEDLEMVHVKFTVPEDVEVAAEVEVRAFSRDADGDIFESGDVVKKRALAQADWVGGEKRYTVKALLPGDEGTGVLKVYAGKRGLMHSIKDIPHPVAFAVPIMHTGENPPYEFVTRHPTPHAQRHDIYVVQPQCQRLALNNTFVFAIRQHPSSLGTGSAMTPSSNPGGASPIPFARPGSAMSMTSSSAAGSMPSSASTNGSGVVSGKKPAKLAIQTPGGKILRLMRKEERRNGAVGVGGRTAGSDEDASDGGTWETIIKCSEKGVWRGLVLADRTARWCVFAEWAGDGRLRPATIMTSEQQPPSPPTASQKRHAFSWFTDANYLSINQLKTLPEPKSDFTGKTVIVTGGNSGLGREAARYFARLGAAKVILACRDTAKGEVARADIEVSTRSSRPPSAAGVRLAVEVWQVDMSSGSSVHDFCARVERELPRLDSLVLNAGVAIGAFVECEGGWESSVAINVIGTFLMAVLCLPIMRRTAAQHNVAPTIAVVASEAHVFASFAERKRQGLIFDAFKSAADMNEDRYNVTKLLDVLLARELAARLGPDSPVVVNALNPGLCQSELFRHCPFPLSALLRLGLMILGRKTEVGSRTLVAAAAAGRETHGKYMDSCELANESAFVRSDEGRASGVRVFDELMGIMEGLAPGARGNLNASTTTSMATAPASTAQASS

SEQ ID NO: 22688 - protein, 1764 aa, Magnaporthe grisea 70-15
MSSADKSSRQSSGGKSFFSRSKNKDRRNTSDDSNGRYLVGGDQDHASIISSRASSRHQRDSSVVSIDAPDSPNPGLNHMAGVITSIPYDNVPPDRRSPIPTEYLPKGDQAPVRRDPLPHQLNKAGSDFHQYPNFDTNSMDYNRISHSSQGAPRVVPGSNVTMASTGRQTQFQQWGPARDSGFGAGSHNSRYNSYATSAGRSSADQSSIYSALPSASSQSSYPVQSPRESHRLTKFPGSPSAVVQGSSEDFRLAKPDDDHIIEQMFLALMQKRGWHNLPDQARRQMVAYPAAKKWTLIYQDRLSEWQGEQRRRQTARPGQIQSFDVTTFSDEEGTPEWYVRKVMDNSLDTKLLGSLEVSLRTQQINWVKRFIECQGQVALTNVLMKINRKTASGPAGVTSDAKNDKNLDREYEIAKCLKALMNNKFGADDALAHQNVIVALATSLMSPRLHTRKLVSEVLTFLCHWADGEGHLKVIQALDYVKNQTGENGRFDAWMRLVEVTVDGRGKMGSLVGASDEMRSGGVGAENLLMEYAVATLILINMIIDSPEKDLQLRLHIRAQFNACGIKRILTKMEAFQYDLIDKQIERFRSNEAIDYEDMLDRENSSIKDNVEGEIKDLNDPVQIVDAIQSRLQGSRTHDYFVSALQHLLLIRENDGEERLRMFQLVDSMLSYVAMDRRLPDMDLKQSLNFTVQSLLDKLHTDSEARQAHDDALEARQIADAAMAERDEMKAQLELGADGLVAKLQRQLDEQARFIEAQKRQADGLKSELENLQTIRAKEAQRYELETRELYLMLRDAQDVAASQAVKGVKAVGNDEAARVQQQGILDRDRLMERLQMQIERQKTQFKLEGRVWGEAAGPSDRLRALREEMDGIGGDPEMEEQGGTVSGTAPRDLTNSMLGSVKRQTRVSRKPVKTSANLVPGAVTEEDIPEEDDEDVIYEKPRVVEIRRPTVDPKQQAGLLNEIAGKVKRYDGSDSEDAEDGVTTGPTHPSVESQTPLTPKDQEPPKTPKIEVTPAMDGVVGAAAPPPPPPPPPPPMPGQLPGAPPPPPPAPPLPGTAGTPAPPPPPPPPPLPGKGMPAPPPPPPPPPPPLPGMKGMPPPPPPPMPGSMSGHFLAKQPGFVAPTIGLPVVRPKKKLKALHWDKVDAPSTTHWAAHAPSAEEREEKYLELSRKGILDEVEKLFMAKETKMIGKGQSHKDDKKQIISADLRKAYEIAFAKFSSYSVEKIVQIIIHCDKEVLDNNVVMDFLQREDLCNIPENIKKQMAPYSKDWTAPKAMEEAREQDPAELTRQDQIFLMTAFDLNHYWNSRMRALALTRSFEPDYEEISEKIRQVVSVSESLRDSVSLMNVLGLILDIGNYMNDANKQARGFKLSSLARLGMVKDEKNESTLADLVERIVRQQYPEWESFATDIGGVLTAQKINIEQLQTDARKYVDNIKNVQRALDSGKLSDPTKFHPQDRVSQVVQRCMKDARRKADQMSLYLEEMVRTYNDIMTFYGEDPADENARRDFFAKLALFVNDWKKSREKNVQIEETRRKNEASMKRKQAQLKPLGIGGPSDVGPVSPSSAGAMDSLLEKLRAAAPQARDQRDRRRRARLKDRHQVRIASGQKIPDLNEIPEVEAGLQTGRSTTSSRATDDDGNLLSPDFASLGSPKSADENDVAQRAAMMLQGMRDGEGPEDAEKREMMRRARRQTAEEERRARRRRREQAGSTISSHGGDLEERAEEGGGDGAEDANGDLLTPKPEQEPGSESEPKSEATVAAAT

SEQ ID NO: 22689 - protein, 1484 aa, Magnaporthe grisea 70-15
MTPPGGFAERAYSGSNGKAVASSSVSNSGGSRTPGTPRKNSTANLAREKALQDPGLRDYRLGDCIGKGAFGSVYKAFNWGTGEAVAVKQIKLVDVPRSELRMIEAEIDLLKNLHHDNIVKYIGFVKTSDCLNIILEYCENGSLHSICKAYGKFPENLVGVYMTQVLQGLQYLHDQGVIHRDIKGANILTTKDGKVKLADFGVSTSTLAGPDKEAQVVGTPYWMAPEIIQLSGATSASDIWSVGCTVIELLQGKPPYHNLAPMPALFAIVNDDHPPLPEGVSPAARDFLMQCFQKDPNLRVSAKKLQRHPWIVGSRRSDAPVSKAPSNFSEAVEEVKQWNKALKSSEHGLRVSIGPDGAHHSGSNGTKGTTVDGHRLNVITNIKGPLTLAKPRPMADAFRSPEIPDNDNWDNDFATAISPSALHLPHLKPQDNFGGLLSSDRLKAFASIDDSRNLSADWDDDLGGSEQLVTIKAPRAQLSDPDMQQTIRPTPRKNDHSEKREKKASLPDFKLQQPNKTKQSRTSAKSPTKPHFPAKFTIPPRPESMFREHSVEDYSDILEDNDHVFAEKMGLVPKDSPQLFHPSDLTSLPRSMQPPNGGSVRRAAQPRPSVLPDRNMRRTRSSIEIQRFAENESDEDFSDIFGPSDTLTERDESDRGSEDGGTGGGRMILSKLSNNSWLGDDEDEDDPFALLDPGWDEMDLEANIARDRHARLSHKVEELVRSLKTTEGEDTLLVVSEELLSLLWENGDVKDLIISAHGLLPILEILEPCTVKSRQHMILQLLKIVNAIILDDVELQENLCFVGGIPIITKFAARQYSNEIRLEAAAFVRQMYQTSTLTLQMFVSAGGLNVLVEFLDEDYDASRDLVLIGVNGIWNVFELQGPTPKNDFCRIFSRSKILDPLALVLHKVLDEDDKSELTELVEGRIVNIFYLFSQAENYVKEVVAERQVLKTVLRDLRRMSPIHQITMLKFIKNLSMLSLTLESLHSADAIDFLIELLSYSMKKGHKHFREISNQVLNTMFNLCRLSKERQEYAAVNGIIPLLLKIMQTDRPPKEFALPILCDMAHSGSKGRRYLWQNKGLDFYVSLIADQYWQVSALDSISVWLQEETAKVETHLLDGKFTAAITSSFNSIKTNAFDSGVLEPLIKILRLSPSLAASLAKSEMYSGLAQKLGHKKAQVRLNLLRLVRNIMDACVSEGGGSSMSTASSGRQLRALFEQIRVLADKDPAVLVRNLASELLRSHLDPDGVTNPIGLTTSTSAVGNGANPLSSAVPPSSSGAPSSRSRSGPRRTSSYTPPGLSSSASAPPQTPTHHQRPSQSSSIYTEVAVTATPRRSAAIAQERDSGGVFRPRSRDGPGSSGSSSSIPRRVSGEGGAILLGGKNGVSSRLPRTSSAYGRQSISMAQGRSESSSSNKENTNITQMGGGSDSRYHTPTAANFDQHDLDWERERDRQRGDRAERVAAQQHKRRSRMTASSSDIRHGAPSR

SEQ ID NO: 22690 - protein, 249 aa, Magnaporthe grisea 70-15
MASTTSTATPIKHSFDARVSAVRSPKSDINAVILDYLTMEGYPKAAANFAKEANIPAQQDVVSIIARREIQNQIHQGQISDAIDGLNDLDPEILGNDPKLHFELLRLQLVELIRTSGHGDIERVIKFAQEQLAPRAPANEKFIKELERTMSLLFFDKNDLPENLRHLLNPDLRRQVAEMVNKAVLELQTQRREAAIRNLVRLRTWAESTARQRKVELPAHIALGFRVEKDGRDMTDDHGADHDPELMVT

SEQ ID NO: 22691 - protein, 1533 aa, Magnaporthe grisea 70-15
MAAAPGSISTPEEAVARIAYISSDVVISVQPSLATETDFSRYLKSAAARKEPSLVAKNPNNVPEIQSVRHNADPLLSVFTPIRSGRFVSVTTTSNILLPSIAHLYKLAEYPVVIHVALHPDRFPDFSSITAIRNSGWTFLQSESIQEAQDMAMTAHALAIRSGKGVIHFYSPWVLSNDEPVEREGLAVIREILDIDSVRRYQSAPISASGLYADDGRTVLASDQPEQVPSGAASAPLNGLSSGAISHATSQANSSQVSVKSSENSTSATPHSTSSATTIEAPPTAVSSDDIYKYVTSIWAQLESLSGRKYSPFEYSGPPTPENCLFVFGADAGLLGSAIDEAKSGDVYAKAGILTPRLYRPWLGAKLLEAIPKSVKKIAVLEQISKRTTKWGPILIDVLTSVKSGPGGVETIVGYHVGYINNETVKQALRGICQNLALDKPVQNLEVGSREGPQKADKYALEKPKLETAYTKILDQLFGTRLYTANAIDSDNAGISATISATPEFGFGALLARKEHRHRFVSEAKEAATSGVFLTEKPKRLLTNWAIHSDDPKKIDAAAEDLISELTLENSTAARKLLKNQAFFRRQSLWLVGSDAWAYDLGNSGVHHVLASGENVNMLIIDSQPYSEHTAADANKRKKDIGLYAMNFGNAYVASVAAYSSYTQVLQAMDEADKFNGPSIVLAYLPYNGEHDSPLTVLQETKKAVDLGYWPLYRWNPDNEKQGLPTFSLDSERIKKELKAFLDRDNHLTQLMKKEPSFGASLAQDFGTEVRAQQKRRARDAYNQLLEGLFGAPLTILFGSDNGNAQSLAKRLGNRGRQRGLKTTVMAMEDYPVEDLPTEENIVILTSTAGQGEFPQNGKPFWDAIKDSTELDLASVRFSVFALGDSHYWPRKEDKIYYNKPGKDLDRVLANFGAQRLAEIGLGDDQDPDGYQTGYAEWEPKIWQALGVDNVEGLPEEPAPITNEDIKLASNYLRGTIVEGLNDNSTGAISAADGQLTKFHGTYMQDDRDVRDERKAQGLEPAYSFMIRCRLPGGVSTPQQWVQMDDIATKLGNETMKLTTRQTFQFHGVVKGKLKPAMQAINRALMTTIAACGDVNRNVMCSSLPTQSEYHREVYACSQKISDHLLPSTTAYHEIWLTDDNDKKTMVAGDAVQDFEPLYGPTYLPRKFKITIAIPPHNDTDVYAHDIGLIAIKGKDGHLEGFNLLAGGGMGATHNNKKTYPQTGRSFGYVSKDQVHIACEKVMLVQRDHGDRKNRKHARLKYTIDDMGVDVFRGKVEELWGQKFEEARPFHFDSNIDTFGWQRDEKGLNHFTLFIENGRIEDTAEFQMKTGLREIAKVHKGEFRLTGNQHVILSNVADEDLDNMKALLKKYKLDNIQFSGLRLSSSACVAFPTCGLAMAESERYLPVLIDKLEACLEENGLKQDSIVMRMTGCPNGCARPWLAEVAFVGKAYGAYNMYLGGGYHGQRLNKLYRSSIKEDEILAIMKPLLKRYALEREEGERFGDFCIRAGVIKATTDGQNFHNDVAEEESDEE

SEQ ID NO: 22692 - protein, 270 aa, Magnaporthe grisea 70-15
MALSPILRNHGTAALAELVGTFLFLFFAFSAAGVANAVPPEFSDGIAVPNIAALLYISFAFGISLMVNVFAFYRISGGQFNPAVSTALCLVGAIPPLRAGFCIVGQIVGGIIAAAAVDGLYPTFLNVETTLGSGVSPAQGVFIEMFLTTQLILVILLLAVEKHRLTYLAPLGIGFALFVTHLAGVYFTGASLNPARSLGPAVINRSFPSYHWIYWIGPMLGALLASGFYTLLDFCKWKQVNPGQDWDGIGEKEAQRDDFDGARDPLTRVA

SEQ ID NO: 22693 - protein, 1003 aa, Magnaporthe grisea 70-15
MYLPTRLCTTAIVLVSVVTALPAPINGAPSRSSLESRQNVAAVQNADGNCADMTVVFARGTTEAGNAGTVVGPPFLQAIRKLAPGLSVNMQGVPYPANFAGIMAGGDRQGTAKMANIIKTLATDCPNTGIVISGYSQGAMLMHNAAAQLDPETASHVVAAVSFGDPFRRRPVNGVDQSRTLVVCHAGDNVCQGGGMILPAHLTYGQDVGKAAAFVMEAAAAVVASMGAAPATEAAPGTEAVPGAGAVLGAGAVPGTGGAPGTEAAPGTGASPGTEAAPGTGAAPGTEAAPGTGAAPGTEAAPGTGAAPGTEALPSTGASPGAQVVPRAEGSSGARTLKKGPRALPGPGGSPIPGGLTGMGPLLGAGPLAKGGGLPGSGGPGGFPKGGGLGGAGGLGGAGGLGGAGGFPKGGGLGGAGGLGGAGGLGGAGGSPKGGGLGGAGGSPRLGGPPRAGGLPGLGGPPRSGGPPKAGGLPRGGGPPKPGGLPGAGGPPKPGGLPKAGGLPPAGGPSSAGGSPGGGGSSGGGGASGGGGASGGGGASGGGGSLGGGGASGGGDSLGGGGSSGGGGSLGGGGGSLGGGGSSGGGGSSGGGGLSGGGGLSGGGGLADAGGSSPGGGLPDTGGSSGGGGLSGSGGSPGGGGLTGGGGLLGGGLPPGGGLLGGGLPDPASLLGGGLPDPASLLGGGLSGGGGLLGGGLPGAGALPDPASLLGGGLPDPASLLGDGLPDPASLLGGGLPDPASLLGGGLPGGGGLLAGGLPGGLAGGGGLLGGGLPGAGALSGAGGSTGGGGLLGGGLPSPGGLTGGGGLLGGGLSGAGGLPKPSSLLGGGLPGGGGLSAGGLTGGGGLLGGGLAGAGGLPKPSSLLGGGLPGGGLAGAGGLPKPSSLLGGGLPGGGGLSAGGLTGGSGLLGGGLSGAGGLPKPSSLLGGGLPGGGGLSAGGLTGGGGLLGGGLAGAGGLPKPSSLLGGGLPGGGGLLGGGLPGIKTVQNTGGKAVDGDKDEVTS

SEQ ID NO: 22694 - protein, 493 aa, Magnaporthe grisea 70-15
MEPPPKPVQLPKLEILPRGKGWKFQAPTKKINDGADVSHFLTSKAYRDICVFVLQLNRSLCPRKKSGAPANAGTVFTLASPRDDPPSVRRLQTLLDKVVAIVDETPPDPGPRRFGNIAFRTWHKHLEDRVDALLAGSIAPEILSFDNDGEQPKADDSAEGKADEHKIISTASAIDELRAYFLGSFGSSQRLDYGTGHELSFLAFLGGLWKLGAFTDGPESDHGDIERSIVLGVFEQYLKVIRKLILTYTLEPAGSHGVWGLDDHSFLPYIFGSAQLTRPISEDETMPLEGSVMRAPKLGDITKVETVEVQRELNMYFSAVGFINDVKKGPFWEHSPMLWDVSGIKDGWGKVNKGMIKMFNAEVLSKFPVVQHFPIGSLFSWEVDPEAPIPTQSVHMQNQPVFAATGQAPMGMPPTGMPPPQLNPMGVSMGTAAPWAQGGRMPAPGISSRVQQPVTGTTRPPPPDPVARQSGGPAAASSGTNDGQAGLTKAPWA

SEQ ID NO: 22695 - protein, 512 aa, Magnaporthe grisea 70-15
MSRNTEGAKPPPFSDVGNHPPFATALAGILGPQPESLYWDNDRGVLADPNCSTAGKYLQQDSVEPPPLVTMWRAGLVNVSNVRSSPLQYCTAVNYMPPSWHWLQSQVRSAILYGPDLSAPFAKFFQNGFTLTVLSLRHPLATAAHQVICFARVFQCSAPDNLCHSFRLFAPTTVNMKFNALALLVGLVAASPLETREELIKRQANQACNIGYCTQNGGTRGGAGGSTVTVKTLSALTEAAGRSGPLTIIVSGNIQGSAKVRVTADKTIYGERGSSLTGIGLYIRQAKNVIVRNMKISGVKASNGDAIGIDASTNVWVDHCDLKGDLNAGKDDLDGLLDISHGADFITVSHVYFHDAQRLTLGNPSPPTDSWKASLIGHSDNNASEDRGKLRVTYANNHWQRINSRTPLLRFGTLHVVNSYYDTVMASGINTRMGAQAFVQSTAFNNCANKAILFEDSPQTGYAVTEDVSLGGSSNTAPKGTLSAGSFPYSKIATIGSGNVKNQVPGQAGQIL

SEQ ID NO: 22696 - protein, 363 aa, Magnaporthe grisea 70-15
MAPPEVHHLFHNPIADHSFSADRQTLAIARDSTVELYGRAEKGFRLQDELKGHDKTVTSVDIAPSSGRIVTCSQDRNALVWEPSPTGYKPTLVLLRINRAATYVRWSPSETKFAVGSGDRVIAICYFEEENDWWVSKHLKKPIRSTITTVAWHPNSVLLAAGSTDAHARVLSSFIKGVDTKPEPTGWGERLPFNTVCGEYLNNSAGWVHAVAFSPSGEALAFAAHDSSITVVYPGGPDQPPRALISINTQLLPFMGLVWNGESEIIAAGYDCEAFRFRGGEGGWQLSGSLESKGRPGADAEREESALNMFRQMDLKGKVKDDTQLKTVHQNTITTIRSFQESGSGLVKMSSSGVDGRIVIWDV

SEQ ID NO: 22697 - protein, 339 aa, Magnaporthe grisea 70-15
MSLPSTYKAAIFKAQGQQLTLEDQPMKEPGRGEILVKVEACGVCHSDSFVQNNAFGGGFPRIPGHEIIGRVAAVGPEVSGWEAGQRVGSGWHGGHDGTCKACNKGLHQMCEAKTINGIIKDGGYAEYCIIRSEAAVRIPDHVDAAKYAPILCAGVTTFNSIKRQGIAAGETVAIQGLGGLGHLAIQYSQRMGYRVVAISRGSDKEKAARELGAHEYIDAAKEDPAAALQKLGGAALIVATAPHANAISPLIGGLGLMGKLLLLAVPGDLSVNTNIMIGQGCSVTAWPSGNALDSEEAINFTELQNVDCKVETFPLEKAQEAFNVMMDGSVRFRSVLTMT

SEQ ID NO: 22698 - protein, 442 aa, Magnaporthe grisea 70-15
MSAEKKTLSKPAAGVPYYTPAQEPPAGTPLQQQDAIPTLFKPLKIRGVELSNRFGVSPMCTYSADDGHLTDFHLVHLGQFALHGTALTIVEATSVTPNGRISPEDSGLWQDSQIAPLRRIVDYVHSQGQKIAIQLAHAGRKASTKAPWHDSFTPSGEYKPREGLQVVGPEYGGWPDDVWAPSAIPFSEDFPNPKEMTVEEIEGLVTSFVDAAKRAIEAGVDIIEIHGAHGYLITEFLSPLSNKRTDKYGGSFENRTRVLIDIIKAVRAVIPEEMPLFVRISATEWMEYAGEPSWDLEQSTQLAKLLPDLGVDLLDVSSGGNSVAQKIELTPYYQIDLAAKIREAVGDRLLIGAVGNINTADIARDVVDEQGAEKVAEAKQTHDTIEVVSESHGGKTKADLVLIARQFLREPEFVLRTAHNLGVNVQWPHQYHRAVWRKGARI

SEQ ID NO: 22699 - protein, 457 aa, Magnaporthe grisea 70-15
MGSPSPGTATSPPEDGDTADDYVNPLDQSPRWALATRAYAIRSGASLGFGISNAWAPPELAPVKVIWLDALLGDWKAKRAIRVDVWEPPSQPNTDKPDFPSTSQSSASDLLALAAPNVVVKTPTDEIDDNASIKSGCSSALSSSGRSSSSKLGTPKRPRIYKVASNLSSRSSRSIASIRSRLSRSNTASGLSLDSIPKRPVVINFHGGGFVVGEGTDDSRWCSAVAKSLNAVVFSVSYRLAPGYPFPNAVEDCASAIVQICSQDMASQYAIDTSRVILSGFSAGGNLALASWVALQDPARWGYESVLPSPPLEMAGLALFYPLLDWTIARDTKRQRCERPDLTLPKGLTDLFDASYIYPPLQSSKRDDPRLSPGLMSDRMLQQLPPVHFCLCEYDMLLAEGLTFTERLKSHGRIVETRVVKGEKHAWDKPPLWAPKENAAVEYEAAIESLKTWVGLD

SEQ ID NO: 22700 - protein, 385 aa, Magnaporthe grisea 70-15
MIVTCLALAFWVNYGVSIWATNKLDNTGWRLALGIQMIPGAALFILTFFVLESPRALISRGKKDLGLKNITALRGLPAEHPYVAREYMEICAQVDAEQEYAVGNNYLVVAKDVITNASNRRRFFLAVMLFLFHKFTGTDSLNYFAPDIFNMIGVPSGSSSLLTTGVYGLVKMFTTLVYVTVIVDRVGRRLPLMVGATMQATAMLYLALYIRFAEGSGGISQGGSGGGTPAGGIVGIIWIYIYAFGWSFGHSVAPYVVAAEIFPPRIRSVCMGICLFVNWIVDYGITLATPTMMTQLGYGTFLIYAMLTYIGVVFVYFCLPELKGRSIESMDDLFQRSIWTMWRHAYPTEEEKVRHDVQDMIVQKEQQLAEEEDARKKQTEHIEAR

SEQ ID NO: 22701 - protein, 347 aa, Magnaporthe grisea 70-15
MSTKMEYVRLGNSGLKVSKLIQGCMVFGDPNWQGSPWTLGEEDGMKLLKKAYDLGINTWDTADTYSNGASEVIIGKALKKYQIPRSKVVILSKIFNPVLEDGSRPPSINDGPLVNQMGLSRKHVFKAVDDCLKRLDTDYIDVLQIHRLDRETPPEEIMRALHEVVVSGKVRYIGASSMYTWEFARLQYTAELKGWTKFISMQPFYNLLYREEEREMIPFCNATGVGVIPWSPLARGLLARPAKKEEGAQESLREQTDAKAKKWNESSNPAIIDRVQEVAAKKGVSMAVLATAWVLHKGCAPILGLSTEKRIEEAVEALSVKLTDEELSYLEEEYQPRTVQGILIQNP

SEQ ID NO: 22702 - protein, 497 aa, Magnaporthe grisea 70-15
MAATSIRGLLLLAVAAAAGPLEAAQEPHDPGCLHMPIMHMSKAEQYQKRAVKVPFDQRFDVGYYTKLSFGTPAQEALVHLDTGSFELWINPTCNNLDGAGEQQFCRAGGSYDPAQSTTVQRLGTTNTLRYGIGSANISYVKDTVGIPGTNMSVRSAQFGVATSSETQNAGILGIGHGVGQAIGYRNFIDELKAQNVTKTRAFSVALGGKDEKQGTVVFGGVDTSKFAGGLARLPIIPAAQSPDGVRRYWVNMSSISLHPPSGRNKTYPGTNMPVFLDTGSTLTLLPEALVKSVASDFGSMQQDAGGYWPVDCSLVGINGTMDFAFDGVTIKVPYKELIRQFGNSCVLGLSSHSSFTLLGDTFMRSAYFVFDQDSDCVWMTQYTNCGSTPAALASVASLRTLQGACPLKQGSVSAVTAGTAGAAAPSTTASPKAPGAGGGSGSNGGGGAKGSPPPGASASAPDSKLKNAGGRAMQVPAISSAVVTLVLTTLAALHLAL

SEQ ID NO: 22703 - protein, 349 aa, Magnaporthe grisea 70-15
MKLAIFSAKGYDKKYFSQVQAAHEKLSNIDLSFIDFPLSPDTVQLAKGAEAVCAFVNDNLSRPVLEGLSDLGVTTILLRCAGFNNVDLDCASQLGLSVANVPSYSPEAVGEFAVALLQTVNRKTHRAYNRVREGNFNLDGLLGRTLHGKTVGVVGTGRIGIAFARIMVGFGCKLLAYDVYQNEEVGKLGGSYESLDEVLSKSDFVSLHCPLMEATRHLINSTTLAKMKPDAILINTSRGGLIDTKAVIKALKARELGGLALDVYEGEGALFYNDHSADIIQDDELMRLMTFPNVVVCGHQAFFTEEALTEIAECSFRNLDDLANGRECKNSLVAAKKPLLRRESIPHRI

SEQ ID NO: 22704 - protein, 492 aa, Magnaporthe grisea 70-15
MKLSSLLAMLGVATTATAFMPADRPRNAQEFRAKHPVARRADSGCRRRFTPRASTHDLDDVSAEFEQAVRDANNGGTVHLPKDQLFVIGKPLDLTFLNDIHVKLEGTIRFTNDTPYWQANAFYHPFQRSLMFWKWGGKDIKIYGEGVLDGNGQRWWNEFSGLEILDPDNPYLRPVLFYAENTTNLHVEGIFMKDSPVWHNFVVTSKDVTYKDVIIEAISNNATSPPKNSDFFNSLNVDGVTVERVWVNIGDDCFSPKSNTSNVHVNTMYCNGTHGQSMGSLGQYEGEVSIVENVLIENVALLNGDNGARLKIWAGESVGSGTVLVRSAHSTLIKIHQRLTGPNTTKQTGWIRNVTFRNFYAANLDFVARLDSCYFNIPSETCNRFPSKMSIQDITFENFSGTTSGKNGDAVARLTCSTSPDAVCENVVFKNFNITSPCGGAPVVICDGITGLQHGCVAFDSAEAKAAMDNKCKAPVASIEPPWPVRDWRNSK

SEQ ID NO: 22705 - protein, 1138 aa, Magnaporthe grisea 70-15
MTKEKATGRTWNTIPPELRLEIYKKLWVPRTVTIYRSAHHDVNTSFEHQVLSLARSQDRDRFEQDVAIDALSVAAHCPAIQVPREDPVPDANNDPLTAGNGFLCGPHGHWDANWLRLVRDSMPPDADASGSAPNGPSRQLLPPPLYTTTTSARVDRSTLVPITLWIDRESRAETLKHYRPAFALRGGATRVYFNFALDTLRIPVHGKLWRLVQRRDLQDLVRLRMVGTADDPSGSRSRSLNPTAATTHNPAEPPAAMGSLLRALCPRLRHVTVEPAWGCARNNLAWRRHEMDDNLVIFNWREIGELQVGCSSCTWNHGHRPCGVLLRRLRELKWMVDMPLIMPGSNGPSEPGLVLTFHSSRPIDDFVNGGDDGYGVPGYVRSDETNPGLDEARVKSTLFLDGQHPRASVEEDFHRLCTINAMQHNIRLACDLTTHPAGGTSGKETCIRVCHQANSFLEGGLAIGKQTHVLLHSPLFISERMPWRALLELCQEEESRPSLTETRLLNFGGVSQCRAGEIFKNVKIWRCQALGLLGTSYIVLGSYSGAEMNPLFWDVGVSGQAAGSGPSIHFEPHQQSYSHQQITGAMGGGTSIWASPDWKKDPREIFNYKLWFLVTTVAFAGFSYGFDHGNVGGVLTLPSFRHTFGLDKMSAAASAARQGDIASMMSAGAAVGALSAGPFSDKLGRKWSVFMYGFLFLVGAVMQLVANLDVFQGGRFIGGFAIGGTSVLSPMYLAECAPKTIRGSLTTLYNLAIITALALAFWVNYGVSRWSYPGLESDERQWRTAMSIQIIPGGLLVVMAAFLIDSPRGLISLGKREKGLENLCKLRNLPADHNYVRQEYLEICAQADVGQELNKNRTYLLAARDIVKVPSYRRRFTLSCLLFIFHKLTGTDAINYFAPQIFAMLGVQQGSMSLMTTGVYGVVKLAASLIYVTVIVDRVGRRLPLMIGASIQATAMLYIALYTKFGNPDPNAGPGPGGIVGIIMIYLYAFGWSFGHSVAPYVVAAEIFPSGIRAFCMSFCLMLNWLFGFGVAKATPVMMESIGWATFLVFAVITYVGVVFVYFCLPELKGRSIESMDDLFEHRLWEMFRWAYPSEDEKIRKDVQQAMMDESKGVVEHSERTVGEESDSTGNQQAAPKV

SEQ ID NO: 22706 - protein, 408 aa, Magnaporthe grisea 70-15
MKATILTLAAAVAPVLAGIPPAEFKFPEAESELSVEFTWSGQSRTVMAGQLFGSNITSQKPQLAVDQQKFKALADYKGEYIIVMIDPDAPSPDDPKLKFILHWLQTSVTAQTTMASNSTLGGQMALLPKAGQQPQVPYAPPAPPPTSSAHRYIIYAFAQPSNFTMPRTFANFSGTNRASFNIDNFVRDANLDKPLAAEYFYVSRQSNVPGTFVDQPGGSYPGGNGNAIFTANQTRPASPSSGSNNGTRPAPTTPSSGGSGGGGGTPAGGQGTTFTPPSIPGNAAVKQSAGMVCCYGNGIVIHARGFKRAASASCPAAIGCMQRPCGQVRLIGDFDLYYPAPRTELEETLTFAEILSEERSASPRFIILRSFYHVNCDSAYKQFFDDYCAIKVRLGIVRTPRDAIRVNG

SEQ ID NO: 22707 - protein, 430 aa, Magnaporthe grisea 70-15
MRSIINLLYLALLATVVSAAPANNQKRSIQKRSFKVDRVRNLNFKGHNGPRELMKAYAKYSMPVPQGLLDAIAAQGKPEFKSQSVGESKISAQDPATNSSKAAGVGLVTATPEAGDVEYLSPVTIGGQTLNLDFDTGSSDLWIFSTMLPQNVQAGHTNFDPAKSTTFKQAQGLSFKIRYGDGSGASGVIGTETVDIGGVTVTGQAVEMATQVSGSFVKDTANNGLVGLAYSKLNTVSPVPQQTFFDNVMPSLAEPLFTADLRKGAVGAYEFGRIDNSKFTGEMKFIPVNTTRGFWQFSSEKFQVGNGQVKQGTKGGQAIADTGTTLILANPTTVQGYYSQVPGAVNDQQVGGITIPCDAKLPDLMLDVGGVMAKVKGSDIVFAQVQGNTCFGGMQPTTSSLQIYGDIFFKSQFVVFNGGNNTLGIADHAV

SEQ ID NO: 22708 - protein, 203 aa, Magnaporthe grisea 70-15
MSAVVIPAGGTFVDTLKKSFVDVPIDANNDNAIGTTEFLEAAESLTTIFGSVAFTPVKNDILGNIKKVRDRQLAAPAESETIQALVINELKTKKHTAAEGLLWLVRGLEFMCIALSQNIAKTSEELADSFRTAYGATLKPHHSFLVKPIFSAAMSAVPYRKDFYAKVGSDQEKVSTELAKYLASLDKLIGIIKGFQERKEAKW

SEQ ID NO: 22709 - protein, 501 aa, Magnaporthe grisea 70-15
MASAPEKDRHTFFAGKVQPSPDSPGTFTTVNPATAQPIATIHTSSRASVDAAVDAARAAFPAWSSTPAPERAQILQRAVAILRERNDALARVETLDTGKAFSETQAVDVVTGADVLAYYANLVASDGLNGESFRLRPGAWVYSSKEPLGACAAIGAWNYPIQIALWKSAPCLAAGNTLVYKPSEYTPLHAQYLADIYAEAGVPPGVFNVVYGAGDVGAQLSSHPKIAKVSFTGQVSTGRKVAGTAAGGLKSVTMELGGKSALVVLPDADVSQAADGAMMANFYSSGQVCTNGTRVFVPRALKEEFERAVLEKIVHVRAGDLFDANTNFGPLSSKVHYEKVVSYVRHGIEQDKARLLCGGIGQPRGVPKELGKGFWIEPTVFTDCTDDMRIVKEEIFGPVMSILTYDTLEEVVQRANATELGLAAGVFGKDLNQCHQVIAQLEAGITWINTWGESPAEMAVGGWKQSGIGVENGHKGLDAWVQNKSTLVEMGGAVPTVFAKI

SEQ ID NO: 22710 - protein, 167 aa, Magnaporthe grisea 70-15
MSVTLHTNLGDLKIEVFCESVPKTAENFLALCASNYYDASPFHRLIPGFMAQTGQPANPSPPENPKGGRSIWGGNFEDEIRPALRHNERGVVSMANKGPGTNGSQFFLVFDKAPHLDGLNTVFGKTIGDESLRTLAKLEAVEIDKKNRPKEKVVIERVTIHANPLAE

SEQ ID NO: 22711 - protein, 485 aa, Magnaporthe grisea 70-15
MATKGSEGFATHEFFNIINGQRRGAGAGGVDRVIDPRTEEPLWEVPIGSAEDLEDAVTAARAALPGWAATTAEERQQLLAKMAEALGANMEFLAGVVMKETGKSQLMATIEIANSLDQCKYFANNTLQDKVQFEDDTIKIIETHAPLGVVGAISPWNFPLILSSIKVVSALVMGNTVIMKPSPFTPYCVLKFAELCQSFLPPGVLQAINGGGELGGLMTLHDGIDKISFTGSIPTGKKVMANCAKTLKRVTLELGGNDAALVCANVDLDKVVAQTCAGSFFNAGQFCAATKRIYVHADIYDAFVDKFVAETKANYESAFAGDGVSVPTIFGPVSNKMQFDVVKRILDDAARPESGGKILTGGKPHDKGYWIQPTVVAGPKEDSMVVKDEQFGPVIPILKWSDEQDVIKRANLSNSGLGATVYSKDLTQAERIARQLESGSVWINMSEKPNAAAWFGGWKDSGFGGEMGLLGLYSYCHIKSIHFAK

SEQ ID NO: 22712 - protein, 426 aa, Magnaporthe grisea 70-15
MSTGSAKFQPAARVAGRRQDVWSIINEAATASPKQPIVNMGQGFFGYNPPDFILNAAKQALDKVDCNQYSPTKGRPRLKKAIADAYAPFWGRQLNPDTEVTITTGANEGMLSAFMAFIEPGDEVIIFEPFFDQYISNIEMPGGKIVYVPLHPPTEGATKTLSAGAWNIDFDELERAITPKTKMIVLNTPHNPVGKVFTKDELQKIADLCLKNEIIILSDEVYDRLFYTPFTRIATLSPEVERITLTVGSAGKNFYATGWRVGWLMGPAELIQHVSAAHTRICYSSVSPLQEACAVGFEQAEKEGFWDECVRDMKRRMDLFNQVWHELGIPFSEPEGGYFVMVNLSTVQMPENYPFPPHVASRPRDFKLAWFLIQELGVAAIPPTEFFTDANAHIVEDYLRFAVCKPDDVLELAKERLRGLKKFIKQ

SEQ ID NO: 22713 - protein, 485 aa, Magnaporthe grisea 70-15
MPSIKRVAVIGAGPSGAITLDALAKEQAFDVIRVFERREGPGGCWIGDSAEPPHLSGFKRLADRTADLPVPIPEQIPAHGVAALTQPRFADSSIYPYLETNVQDLSMQFSQEPIPADRSELSVSLYGPSTPFRHWEVLKRYVSNVIHATPGHSEVVSYDTTVELVEKVGDEWRVVLRKADGRGGDHWWDERFDAVVVANGHYNVPYVPEVEGLEEMQRAMPGSILHSKYFRGRDQFRDKRVVVVGASVSAADIAFDIVKVAKSPVHAVFLGHTANPYFGDEAFRHPNVKMQPSIARVEVPPGGQGATVYFVDGTSASGVDYLIFGTGYSWTLPFLPQIQPKKNRVPGLYHHVVWQQDPTLLFVGAVGAGLTFKIFEWQAVLAARILAGRTSRPLPSLDEMQRWEVNRIAETGDGPKFTVIHPYFEEYFETLRELAGDGEPGLGRKLPKFDQKWLDAFMDGHELRKGMWKRINDQARDEIRPIPRL

SEQ ID NO: 22714 - protein, 300 aa, Magnaporthe grisea 70-15
MANVTGVASATDMPIQAVFAEVSQHFQQLTMMERLWATWYTWMQNDVLATGLLTFIIHEVVYFGRSIPWIIMDSMPIFQKYKIQQTKVPTIKEQLHCAGLVLLSHFTVELPEIWVFHPVAIYCGMAFDVPFPPAWKIALHIAVFFVLEDAWHYWTHRLMHYPPLYRSIHKLHHTYTAPFGLTAEYASPIEVLVLGLGTAGTPLLWVYLTGDLHLFTMQAWIVLRLLQAVDAHSGYEFPWSLHHILPFWAGAQHHDIHHEQFVGNYASSFRWWDYFMDTEAGAEANAKRRERKMAALKKTL

SEQ ID NO: 22715 - protein, 348 aa, Magnaporthe grisea 70-15
MLKGTIIVTGANGGLGSAIANKLLLEAQYAEYHMIFTVRNVEKANVLQEVINSHRGKGLSSSNDVVPLDLTSLASGRKLADDINARVAAGSIPPIRALVLNAGWQEWTTESFTKDGFEMAFQSNYLTHWLLTVKLLQSMDKNKGRIVVLGSWSHDPDHPGNNYQGFYKGEQWRQLHPNTEAVAKGTFSKPESLPAGGHGFRRYGAAKLCQIMMVYELQARLDADPALSKIAVLGVDPGAMPTPLTRRANPFFVLVGRAIFPILIFLSGLFSKNPEFRSSKKSAKDVMAAALSEDEPYGHSPKAVYYNGDEISTSSAESRDKRKGLELWRSSVEYTGLTEGETCLRNWR

SEQ ID NO: 22716 - protein, 460 aa, Magnaporthe grisea 70-15
MATTKSAFLHRSLKEFPAQVVEAKDKTLVFSDGTKVLDSTCGAAVACIGYNNDLSERVKQAMIRQMDKFPYCNSFFGHEVGEQLAQELMDGTGGAMSKAYIVNSGSEAMEGTMKMARQYFLELQPPQPSRINFIAREGSYHGTTLGALSMSGHVGRRSKFLDLLLPNVARVSRCDAYRGMKEGQSVAEYVEQLADELDKKFQELGPETVCAFVAEPVVGATLGCVPAVPGYFEAMRKVCDKYGALLILDEVMSGMGRSGTLHAWQQEGVVPDIQTIGKGLGGGYAPVAAFMINHRVADTLESGTGEFMHGHTYQGHALGCAAALEVQRIVREENLIDNVKQRGVQLEKLLQQHLGNHPNVGNIRGKGLFWGIEFVADKASKEPFPRSVDLANKVNRAGVKEFGVSLYPGTGTKDGVLGDHVILAPAYNCTADEIEEIVIKTKETVARVLRVKNAETATSA

SEQ ID NO: 22717 - protein, 1280 aa, Magnaporthe grisea 70-15
MPPRGGRVSKGPSLPLNLLREIGADGASSKGRGRSNRSGGRAFDRRPNRGGDRPKGSSHASHRAVEVTKKPNLKRSKRGHETDSEDSEDGSSEEQDDSGLEDEDDYDDDDEDVSDVEESTDEKSLPKAVRDKIAEDDKEIAELERRLGIKGRKGLPKSFKEDGLGDLLEGIDDAIGVESNEKKKRKAEADEWLAQKRQKANQTTRQVERDDDDEGSDSEDDDIDEDDFDMGDESSQDGGSDGEFEGFESDPETASAPKPQRENPYVAPTSGVTVTKYIPPSMRAKTGSDDELMLRIRRQTQGLVNRLTDANLISILGEIEKLYREYPRQHVTSTLVDLLLIQVCDPSSLPDTLLILTAGFATAAYKVIGMDFGAYLVQTTAEKFKEHYAKTVGRTQEQQEVTKETSNIITFLAQMYNFQMIGCNLVFDHIRFLLGELSELNAELLLRIIRMAGKPLRQDDPMALKDIVALIRPAMAKFGENNVSVRTKFMIETINDLKNNKMKAGATASAINTEHTTRMKKLLGTLSSRKLKATEPLRMGLKDIEEADKKGKWWLVGSSWAGKDKTDKKKTSDKPEADDVSDVNDLEIYDDDDLDVDLEALARRLMLNTDIRRSIFFAVMSALDFEDAYRNLLKLRLNKERQREVSHVLLQCCGSEEQYNPYYALVARKISGDDRRTKWNFQDTLWKFFRRLGESLFDEEADEVDDEDDKATELRRIVNIGKFYGNLISEGVLNLDVLRCLNFVYLKPKTKMLVEVILVTALLDFPCKNRAGADEVIRKMFTLPGKPEFARSLKYFMEKVMPRTDFLILLLLPEQKDLVIIGGGVAGYVAAIKAGQQGMKVTCIEKRGTLGGTCLNVGCIPSKSLLNNSHLYHQILHDTKNRGIEVGDVKLNLQQLMKAKDTSVGGLTKGVEFLLKKNGVEYLKGTGSFVNEHEIKIALNDGGETSRTAKNILIATGSEATPFPGLEIDEKRVVTSTGALALEKVPETMTVIGGGIIGLEMASVWSRLGAKVTVVEYLGQIGGPGMDTEIAKSAQKILKKQGIEFKLNTKVNGGDTTGDKIKLDIDAAKGGKAESIESDVVLVAIGRRPYTGGLGLENVGLETDDRGRVVIDSEYRTSHPHIRCVGDVTFGPMLAHKAEEEAVAVVEYMSKGYGHVNYAAIPSVMYTHPEVAWVGQSEQDLQKAGIQYRVGTFPFSANSRAKTNLDTEGMVKMLADPETDRILGVHIIGPNAGEMIAEGTLALEYGASSEDIARTCHAHPTLAEAFKEAAMATHAKAIHF

SEQ ID NO: 22718 - protein, 269 aa, Magnaporthe grisea 70-15
MRLRKAARVILVGAPGVGKGTQSERLLQRFPQLSSISSGDLLRSNVKSRTPLGIKVESTMKAGGLVSDDLILRLISNEFNKRGWLFADPATKASSIMTLASASAVADQSAFSHDTDVFLGNNTGGPPPRLSDNPAASFLLDGFPRTAAQAERLDHVVPINLAVSIRTPFEVIMQRISGRWVHEPSGRVYNDTFNAPQVPGRDDVTGEPLVRRPDDSEEVYRQRFQKFQETSEPLLEHYARKGVLWEVNGMSSDEISPKLFKEFERRFLE

SEQ ID NO: 22719 - protein, 338 aa, Magnaporthe grisea 70-15
MARVYADVNANMPRSYWEYDTVNISWGVLENYEVVRKIGRGKYSEVFEGINVVNYQKCVIKVLKPVKKKKIKREIKILQNLAGGPNVVALLDVVRDSQSKTPSLIFEYVNNTDFRTLYPKFNDIDVRYYILELLKALDFCHSKGIMHRDVKPHNVMIDHENRKLRLIDWGLAEFYHPGTEYNVRVASRYFKGPELLVDYQEYDYSLDMWSLGAMFASMIFRKEPFFHGNSNSDQLVKIAKVLGTDDLFDYLDKYEIELDAQYDDILGRFQKKPWHSFVTAENQRFVSNEAIDFLDKLLRYDHMERLTAKEAMAHPYFEPVRGEGVLERLLAAGTNTSA

SEQ ID NO: 22720 - protein, 311 aa, Magnaporthe grisea 70-15
MDTEPMPIDAHEDTLGGIEGSPHVGSSAQIRGSDRRHGQSQSLDQGFGSQAHQSPHNEDMERYNTPPIPPPGPSLSRPASGLSGGYHNGNSHANNNSADHVSRGSGAHVDSGSNRDTGRNHVVIKVGMVGDAQIGKTSLMVKYVEGSWDEDYIQTLGVNFMEKTISIRNTEITFSIWDLGGQREFVNMLPLVCNDAVAILFMFDLTRKSTLNSIKEWYRQGRGFNKTAIPILVGTKYDHFVNFPREDQEEISNQARRFAKAMRASLIFSSTSHSINVQKIFKIVLSKAFDLKCTIPEIENVGEPLLLYQSC

SEQ ID NO: 22721 - protein, 369 aa, Magnaporthe grisea 70-15
MGDQQVYPQPPYPLHDSIKDKLDPEYVEFYNKYLLNAPQVHYQPVAASRVGGKIIPVKAPLAAFPSQNPRTDKLSTQNQGGTDPVPVGKTIDKAIPRQETTGPDVRVRAFVPAGQPPSPSGWPVFLWYHGGGWVLGNIDSENSLCSSICARARCVVVTTDYRLAPEHPFPAAVHDAWEAALWVATGAAAPALGEPLDLAKVAVGGSSAGGNLAAVVTQRALRHEAFARAGLFRFQLLVVPVTDNTASVETSTTYAEYEHTAALPVDKMLWYRRHYLPDRADWASVEASPLFADADTFAKLPPALVVVAGLDVLRWEGEEYARKLRDAGVEAEVKVIEGVPHPFIVMDAVLQKGKEGVDFVCERLAAVLA

SEQ ID NO: 22722 - protein, 412 aa, Magnaporthe grisea 70-15
MASNTSHEDAVNHFSDLTGVSANEAKTYLTTYHWDMDQALQAFYEDEDDDTPGARAMPAPGQEDSYTGPRTLDGRPVPYSSGATASSSSQAPKKSTGGSKLRTLGDLSGQDDEDHQDDEAKRRSLFAGGEKSGLAVQDPSQAPRDLVRDIIEKARRNAERGGPSSSGGAAPEAPSRFTGSGQTLGGDGVPSRTIPDPRGSPIPRETSQPQQTVERTLHMWEDGFSIEDGPLHRLDDPRNTQTLRMINQGRVPLHLMNINYDEQVDVKLVKHEENWHQLPRIYRPFGGEGRRLGSPVPGDGNTAVSSSATTTQAPASSSSNSASNPTTSLDESLPILTIRIQMPNGARVPARFNTTQTVGDVYEFVQNAHPETLTRNWVLATTFPNKEHIDCSTVLGEMNEFKRGGTAVVKWV

SEQ ID NO: 22723 - protein, 490 aa, Magnaporthe grisea 70-15
MDKPLPTERPAQTVTEILETQSKNSSHGRFGLTPSLIKLYLLLAPACLVICATNGYDGSVLTGLQGIERWRSQFGDPKGALLGITTAALPLGSIVSTPFSAWLSDRWGRRSSILVGSFIMIIGVILQCVSTSIGTFLGGRMIIGFGITMALTAGPILISELAHPRHRAAPACVQMFFVWFLPESPRWLVFCDRSDEAYKTLATYHGGGNWEDPLVRAEFWEMKETLMAEKATKGVGPGIFLKTPANRKRLVILITLAVFGQWSGNGLVSYYLTKIFTSIGITTQGEQTMLNGTIATVNYATALMSAVMANKFGRRQMFVGGAIAMFISFSSLTASLAVYNETGSNAASKSALGFIFIYFACYNVCLNPLIFVYPVEVLTYKQRATGLSIFLFVMKTASVFNQFVDPIGMDALGWKFYLVYCCWLLIEITVFYFLYPETKGYTLERMQEVFGDVIKYDCPEEKATIAGNLDEAAEKASMKDDSYKHVEKAG

SEQ ID NO: 22724 - protein, 497 aa, Magnaporthe grisea 70-15
MNIQLSAPNGKKWIQPTGLFINNEFVKSSNGQKLTTVNAATEEDITSVYSATEEDIDKAVKAARAAFKHPSWRNLSGTERGEMMHKLADLVVKNAETLATIEALDGGKPYSVALGEDVVEFEKTIRYYAGFADKNFGQTIDVGPNKFAYTIKEPIGVCGQIIPWNYPLCMAAWKLGPALACGNTVVLKLAEQTPLSMLYVATLIKEAGFPAGVVNVINGLGGEAGAAIVQHPDIDKVAFTGSTATGKQIMKACAGTMKNITLETGGKSPLLVFDDADLDLAAEWSHIGIMSNQGQICTATSRILVHESVYDKFVGRFKDTVEKVSIVGDPFDEKTFQGPQVTKAQYEKVLGYIKLAQEEGATIATGGKPAPQNGKGFYVAPTVFTNVKTSMRVYKEEIFGPCVSIISFKDEEEAVELANDTTYGLGAAVFTRNLTRAHRVAREIQSGMVWINSSNDSDCRVPFGGVKQSGIGRELGEAGLASYCNIKSVHVNMAAHL

SEQ ID NO: 22725 - protein, 366 aa, Magnaporthe grisea 70-15
MLRTKSVRSASSQLKLYTGSFAQPRRGIVTETDVEKARAYCVNQLRHGDYEAYLIRRFLPPSAQDAYDAFRTLNLELARLPETVSNPLIGQMRMQFWRDSINSTFAGNPPREPISILLHKVISDLGRRGSPSSIKFWLLRLLSTREQYMDNRPFASLAALEDYGENTYATLMYATLAATGLRSLHVDHLASHIGKACGIAAILRGVPVLAAPRPPVQSPLGENSSNAGPALLLPLDVMAKAGVREEDVFRRGPEAPGLQDAIFEVATRANDHLITAREMLKNLKAGQNPGHDFEHEGESEHVYDAKDASAERTKLEVQRGFGTLLEAIPAADFLQRLENANFDPFRVKSSWKLPWSLWRAAQKQQI

SEQ ID NO: 22726 - protein, 445 aa, Magnaporthe grisea 70-15
MSIGGNAPLPWLAPDVGDGFDGIRYLTRPLDNSSMDGQGWDEPGNKLSSPRWYPSAQTLPDGRVFVASGSLNGLAPENASNNNPTYEMLDRNGVSSGQFVKMDLLERAQPYYMYPFIHLLNDGNLFIFAAQISQIFSVGSGATTGTVVKEMPELPGDYRTYPNTGGSVMLPLSKANGYTPDILICGGGPYQDVTAPTEPSCGRIKPLDANPKWEMDAMPDGRVMTEGVLMLDGTVFFVNGAHQGAQGFGVADKPAFTSLLYDPAQPLGQRFTTAATSTIPRMYHSVSIMLEDATVLIAGSNPVQQPILEVSADTPFATEFRVERYTPPYLSNGKQNLRPLNMTLSGTNMTPGPAGSSVLNVRFGLPSATVKDVKVALYYNGYVTHSVHMGHRMVYLEHTGFAVGKTAQNLMVQPPPSNNITPPGYYILFVIADGIPSVGQQIMIN

SEQ ID NO: 22727 - protein, 288 aa, Magnaporthe grisea 70-15
MRITTLTALAIALLGNSATVVATDGGPVIQRRMYNGGYGGGYGNCPGGSCPPRGGYGGGYGGGYAGYGGGYGGGYGNCPGGSCPPRGGYGGYSASGYGGGGGYDDGGYGHSPSYGGGGGGYDDGSYEHSPSYAGGGGGYDDGSHGHSTSYGGGGGGGGHRTPEVESTSERRTESSSSRWPPGTRSEDYPDPPISPYLNQRVRECVWFWFEYAQPTTKSSGGWFRSGKKKPTGPKQWIMREAGEMYSGHTIRMNVGLKGEIPVTSDEGCDMSGDFPTGWTVVGRRRKGY

SEQ ID NO: 22728 - protein, 454 aa, Magnaporthe grisea 70-15
MTEPPHPYNALDAAKLQEAADSSLLSYGPSFHNEIIARAEGVFIYTVAGRRILDWTSGQMSCLIGHGNPEVVSVIHQHATSLDHLFSGMLSPPVINLAAELKKLLPPGLERSMFLSTGGESNEAAIRMAKCVTGRWEIVGLSASWHGMTGGAAGAQYHSGRRGIGPMIPGNLMLPAPNTYRSIFRHADGTYDWETELDHGWAMVDAASSGSLAAVILEPILSSAGMHALPDGYLAAMKAHCERRGMLLILDEAQTAIGRAGDMFAFQHPSNGGVVPDVLTLSKTLGNGLPLSAVVTSDAIAARARGEGFLFFTTHVNDPLPAAVGLKVLQIVQRDGLVQRSRRLGERLHAGLRRLQERYACIGDVRGRGLMAGVEIVSDRETKAPGMELADRLGKRMMELGVSANLATLASFGGAFRIAPPITISEEELDLGLGFMEETLRSTEGSMPTGAIRK

SEQ ID NO: 22729 - protein, 389 aa, Magnaporthe grisea 70-15
MSTVGKVSKANTRMTITCKAAVAWEAGKDLSIEDIEVAPPKAHEVRIEIYHTGVCHTDAYTLSGKDPEGAFPIVLGHEGAGIVESVGEGVTNVKVGDHVVALYTPECKECKFCKSGKTNLCGKIRATQGKGLMPDGTSRFKCKGKDLLHFMGTSTFSQFTVVADISVVAVQPEAPMDRTCLLGCGITTGYGAARVTANVEEGSSLAVFGAGCVGLSVVQGAVINKAGKIIVVDVNPAKEEWARKFGATDFVNPTKLPEGKTVVDALVELTDGGCDYTFDCTGNVQVMRAALEACHKGWGESIIIGVAAAGQEISTRPFQLVTGRVWKGCAFGGIKGRSQLPGLVDDYLQGRLKVDEFITHRKKLVEINNAFETMKQGDCIRAVVDMRAV

SEQ ID NO: 22730 - protein, 309 aa, Magnaporthe grisea 70-15
MEAFKNATIAAGATALNSSHGYFDVFEEVSKYHVQLSVLERLWAAWYLWWQNDTLATGIMSFAMHEIVYFGRSLPWIIIDAIPYFRQWKIQNQKIPTAKEQWDCTMLVLLGHFTVELPQIWVFHPLATYFGLDHGVPFPPAWKIAMQIAIFFVIEDLWHYLFHRALHYGPLYKNIHKLHHTYSAPFGLAAEYASPIEVMLLGFGVVGTPIVWTSITGDLHLFTMYLWIVLRLFQAIDAHSGYDFPWSLRKFLPFWGGADFHDLHHERFIGNYASSFRWWDWVFDTEAGDEPARKRREKKLAALKAKKAQ

SEQ ID NO: 22731 - protein, 273 aa, Magnaporthe grisea 70-15
MWPGQAMTLKVEKVLHHERSKYQDVLIFQSTDYGKVLVLDNVIQCTERDEFSYQEMITHLAMNSHPNPKKVLVIGGGDGGVLREVVKHDCVEEAILCDIDEAVIRLSKEYLPNMSAGFNHPKVKVHVGDGFKFLADYQNTFDVIITDSSDPEGPAESLFQKPYFQLLFNALTEGGVITTQAENQWLHLPLITKLRKDCKEIFPVAEYAYTTIPTYPSGQIGFMVCSKDPKANLKEPLRSWTQEEELEKCRYYSSDIHKASFVLPNFARKALQD

SEQ ID NO: 22732 - protein, 479 aa, Magnaporthe grisea 70-15
MYTMTISVRPLRRTCCSRPSIIGRGLFSSSSRQLAPNGTVAGSNESKPLDTGSRALNASFDEGQISRLARKHLHNLNLADLVKLISSEPLTRHGRPPLSEEALLQSANFTLSLLPIRLAHRLQALRNLPYIVVSNPNIRTIYNNYQRSLETLLPWEERGGINTLGEEVEFTEVLAQLVRTHADTIPILARGFLECRRYVSPQDVTAFLDAHLRARIGTRLVAEQHIALHYSSQPHFDPAASPVPCPEEPSFVGVIDTALKPVDILDHCGGAVAEICELRYGVRPEWVVNGSPDTTFAYVPMHLHYILTELLKNAFRATVENNMSREPIEVTIAPALPLDDGRGLRLKPPSVSRGVFRSDAIQPLDDNAPGVTIRIRDRGGGIAPEVQPNIWSYSYTTFFDQDDSLPGGAGGSGGGSTGDFALNIISSASNGRSSIAGLGYGLPLSRAYAEYFGGGIDVQSLHGWGTDVYLRLNGVGRLE

SEQ ID NO: 22733 - protein, 320 aa, Magnaporthe grisea 70-15
MSSLIPGSNTFNPDKDIPDLSGKHYIVTGGSAGIGFGIAAHLLQHKADNVTILSNKEEHAQSALEELKEYGDASKAHWVKCDFEDLKFTEKVANELARSQDKLDGLVLNAGLGVGVYNETKDKIDSHFQVNILSQFLLLKKLLPRLQKTPGARLVFESSDLHKAADGGAQFKDEAEINNDIGPTQLYNRTKLALILLARALQRRKEAGELGFQPGQSVFINAVHPGAVATDQQLQAEEAYGTLGVVGHAIVRPFLKDPVSQGCRPALFATTSKEIEEQEISGQYIVPDKKVTSPSSKAQDDELGERLWNLMEQMLKDRLG

SEQ ID NO: 22734 - protein, 207 aa, Magnaporthe grisea 70-15
MTVMAGGALASRHLPASPRPAGRRAAPSSRRPHSTFVTWRESQLTPAAAEKGEETPLADYKGKVVLVVNTASKCGFTPQYAGLEALYKKITEKHPEDFTILGFPCNQFGGQEPGTDDDIQNFCQVNYGVTFPIMKKVDVNGDNADPLFKWLKEEMPGIMGLKRVKWNFEKFLIGRDGKVKGRWASTTKPESLEKDILKEIEAPKPSI

SEQ ID NO: 22735 - protein, 321 aa, Magnaporthe grisea 70-15
MAYGAKTTGSAIVGDYASQIANKTILTTGVSPTTLGAAFVTTIATASPALLILAGRNLAKAEETAEAIRAVAPQVPIRTLELDLADKQSVRKAAATVLAWDDVAGIDVLVNNAAIITDEYGTIEGIERVFAVNHLGPFLFTNLVLPKVLAVKGRVVNVASEGHRFSNVRFMDLNFEDGKIYNKWRAYGQSKTANMLFSLSLARKLGSRGLVANSPHPGTIITPLSEGMDLALEYELTRPYDQFVGYYPKERGVIKTLDEGISTHIYAAFEPSLKDHNGTFLLDCHVADPNVDFVMSWAASEVEAEKLWKLSEELVGEKFEW

SEQ ID NO: 22736 - protein, 349 aa, Magnaporthe grisea 70-15
MAKTEKAFTNAEKILMAKAWIYGIRPFFKHGKNFNPTRDIPPQTGKTMLVTGGASGIGAAFVAEIARHSPAQVWIADLRPEAAEKAISAISAECPDVKIDFLQIDLGDAESVKRAASEFLSRTERLDVLLNNAGILPAKGWTTKDGYESMFGVNFVGHARLTELLLPRLMETAAIPGADVRVVSVASGGHGVHPKPDGVRLSSGGALLKEPTCGGMTAMQRYAQSKLAVILWVRRLAREFPAITIVSAHPGTVATSIANDLSGSTRQPPAFFVKLTGTKTPEMGCYNQLWCATAPRDQLVSGKYYCPVGLPDQEFGIARDRKKADELEERLWVWLQKELKGDSFVKVDA

SEQ ID NO: 22737 - protein, 1728 aa, Magnaporthe grisea 70-15
MYNRCCRKVWIQGRVAYRPAYIRQSPPQQTLYRGIDLLPFTTIVMDHQSGFQNPSPSGGLMFSASAKRFISRIVGFVGRGAEVQQKAVGLCPLKTERRRAAAGGLLLPTGLRMGRSIIMSVRPLPFLTGPAPSPDTAAGFKPSPPTGNLVSVSPLSKAQMALWFDYLQHPTSTHYFLTLKVELDKQPLSLDKIIQVIRGLGKQHAMLRTTFHVDTDTDDMSKSYMAVHDDSWDQEIHVLMNDAQLYEALRKPFQLSSESPVRWVVQMKLQPGSARSTYTVYAAGHHIGVDGASMSVLSNQLLEAVASEVEDQPDHSGPHYGDYIQRQARYLRSSAGAAAGRFWLSQLRHTQPFRWRMEPPEEINTPNYRQLDTWNFFPTAEIQEWGNLYKTSWFRVATSIVGLVTAAMAEPQAHHDHALMVAFGARPRGFENNVSHMANTMPVKFPLSSLLRDDATFSDAVKAMGRNVSTAKKHENFPFMSLMEQANRHMDPTLLDFKVAITYSPKLANKSCELFPVEGIWDLFFCFLEQEDGVALGVISNPRVFGAEALGQLQSLFNEVFALSKARPSFKLSDLAFLQNRTPARFISGPALDDVESISKSRVYRLIKARAASQPDLVALMSAEKGVQMTYRELAAQSSQVAHFLQKQRLCKGDAVLVHLERGFAQIVWILGVMEAGACYVALDKTWPAARKEAILRTANGKLLVTDDEQMDFEKQDTTVVFLAPSAAEIASMPQSTCECEVADDDLAYVVFTSGSTGQPKGVMVEHSNLSHYVSATRSLVKTGPHSRMLQLASFAFDAIVLEYAVTLAHGGTLCFANHPEVLVGEYLADVIDSNQVNFFHCTPSVLSTLPAGRRLPSLRIVSVGGEASPPGLLDHWRKRVELLHAYGPTECTVICTLESLTQDESTQTAIDATVIGKALPNLDIRICEEGKLEPLAPNQVGEICVVGPQVSRGYMGQEELTASKFHNITLADGHPSRLYRTGDKGFIDDDGKLHIQGRIGNREIKVRGYRLDLYEVEKNVMAFDPEVTQVSIQQVGESLVALVVPASIDCDRIRSKLLKDMPRYAVPTRFIRVASLPLNTNGKIDHTQASSLAAELVMHDTVLPTVDATPTPTAAVRAVGVTEENLRLKTKENGMERQEMLRRHLTAEVTALWAKLLGSSRQFDPEVGFFDAGGHSLLLTQLHKLIKERFGTGSRPSLLDIFSMSSIRKQVDCLMGIVDQDAMLGSEPTGGSSSRSQSRRSAETSSSSTSAPSSVPVDAERNLYAIVGISCRFPGANTAEQLWNVLMEQRDAITTFCPAENLGFALEENSVFVPRYGMIDALKDFEPSAYSMSDAEAQTIDPQKRVFLDVAADALADAGTSASPGNPLDPVGVFVGAATNTFLSSRDNPGSKPPGDEEPQSFANHYQQLLDCPIGTFASFKLNLTGPVVTLNTACSSALAALHLACASLSHGDCNAAVVGGVSMAYPQEGGYVTARPGGDSSAVFSPSGVCHPLDSRADGCVPADGAAALVIKRLADARADGCRVYAVIEGVAVSADGSDDKAGLGVPSSSGQSRTVEAALRRAGPQALSRLRYVEMHGSGTPWGDALEVQGLKMAFDRLSKTGAAEQSGTGRAQPEADRIYLGSNKGNCGNTEAASGLLSLIKASMALNLGVVPPLPNLAEPNPKCEFEETKFEPLGKQLALAPGDRVMNKRQRIVRSPNWISDATWFVISTVDNLLPKLTPAAVA

SEQ ID NO: 22738 - protein, 507 aa, Magnaporthe grisea 70-15
MEKSKDIETHPIEGTISHHDKAPVSREQELTLREVFKNHKIIVWWCFYWAMCAVGWGFDAQINGAMIAVDSFRRDFGYLDLQGEAILPAEWQAAFNTIASVGQIFGGFLCSWAADRIGRRYSLICGLIICTGGIAGEIASDNRPAFLASKLVLGFGLGFYLTLAPLACSEIAPVAFRGFATAGVNLGIAVGQLLSNAVVKAFGERTDAWAYKGGFSTQLFFVLFLVVFLHFLPESPWYLVRAGKKEQAIKTIKKLYGKDYDAETQILAMEATIAEESAILSEQRLVDCFRGTNLLRTGISTGVFLCQHLVGIIFVLGYSTYFFRLVGVQQSFDLGVGVTACGVLGNICSWFVVERFGRRPVFVGGMASLTGLLFLIGIMDVVPTAAAGWVMASSTVVYAFVYFMTIGAMAFAILGEASSTSLRAKTISLATATQAICGIVFNFAIPYMVNPDQGNMKGKVGFVFGGLALIGTVGSWVWVPELKGKTFDEIDRLFAAKVPPRKMGKSL

SEQ ID NO: 22739 - protein, 339 aa, Magnaporthe grisea 70-15
MLNAGADIAEVRMSVDSEPIYAPAVEILNRRGEVSATLGTLPELKPYAGYLPDSFFSKGLAAVQNLAGIAIARVKSRLENPPDVNRKDLLARLQEGRDAKGEPLGFEELTAEALTQLIAGSDTTSNSSCALLYWTARTPGVLAKLQAELDAAIPDGVFAPAFDMIRNLPYLEAVINETLRIHSTSGIGLPRQIPADSPGVTIRGQYYPPGTVLSVPTYTIHHSKEIWGPDADEFRPERWIENGGLTDRQKNAFIPFSYGPRACVGRNVAEMEMKMIAATWARRYDVEVRQDVMEPCMSERTFLSPAYSQLNETCIYYSTDKYADLAMLVRGPGLVSLNQ

SEQ ID NO: 22740 - protein, 356 aa, Magnaporthe grisea 70-15
MSRANPPSNSSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDNLSKEQLKQFIYQEIMR

SEQ ID NO: 22741 - protein, 157 aa, Magnaporthe grisea 70-15
MASIATLERIPAAKLRDLLLAEKADDPKVAVVDVRDDDYIGGHIKGALNVPSQQLEARMPTLIRQLQDKPTVIFHCALSQQRGPGAALRYIRERDEALKKANDKDAAASSAPGASQPVEQKVYVLDRGFVGWQEVYGEDENLTEGYRKELWKDGYWC

SEQ ID NO: 22742 - protein, 1120 aa, Magnaporthe grisea 70-15
MAATQSRDWASFGVSLPSTALGRHLQAAMPFLSEENHKSQGTVLIPDAQGPIPFLGSVPLVDPELPSQSLQRLARQYGEIYRFVIPGRQSPILVSTHALVNELCDEKRFKKKVAAALLGLREAIHDGLFTAHNDEPNWGIAHRILMPAFGPMAIKGMFDEMHDVASQMILKWARHGSTTPIMVSDDFTRLTLDTIALCSMGYRFNSFYHDSMHEFIEAMTCWMKESGNKTRRLLPDVFYRTTDKKWHDDAEILRRTADEVLKARKENPSGRKDLLTAMIEGVDPKTGGKLSDSSIIDNLITFLIAGHETTSGMLSFAFYLLLKNPTAYRKAQQEIDDLCGREPITVEHLSKMPYITAVLRETLRLYSTIPAFVVEAIEDTVVGGKYAIPKNHPIFLMIAESHRDPKVYGDDAQEFEPERMLDGQFERRNREFPNSWKPFGNGMRGCIGRAFAWQEALLITAMLLQNFNFVMHDPAYQLSIKENLTLKPDNFYMRAILRHGMSPTELERSISGVAPTGNKTPPRNATRTSSPDPEDGGIPMSIYYGSNSGTCESLAHKLAVDASAQGFKAETVDVLDAANQKLPAGNRGPVVLITASYEGLPPDNAKHFVEWLENLKGGDELVDTSYAVFGCGHQDWTKTFHRIPKLVDEKLAEHGAVRLAPLGLSNAAHGDMFVDFETWEFETLWPALADRYKTGAGRQDAAATDLTAALSQLSVEVSHPRAADLRQDVGEAVVVAARDLTAPGAPPKRHMEIRLPKTGGRVHYSAGDYLAVLPVNPKSTVERAMRRFGLAWDAHVTIRSGGRTTLPTGAPVSAREVLSSYVELTQPATKRGIAVLAGAVTGGPAAEQEQAKAALLDLAGDSYALEVSAKRVGVLDLLERFPACAVPFGTFLALLPPMRVRQYSISSSPLWNDEHATLTYSVLSAPSLADPARTHVGVASSYLAGLGEGDHLHVALRPSHVAFRLPSPETPVVCVCAGSGMAPFRAFAQERAALVGAGRKVAPLLLFFGCREPGVDDLYREELEGWEAKGVLSVRRAYSRRTEQSEGCRYVQDRLLKNRAEVKSLWSQDAKVFVCGSREVAEGVKEAMFKVVAGKEGSSEEVQAWYEEVRNVRYASDIFD

SEQ ID NO: 22743 - protein, 1374 aa, Magnaporthe grisea 70-15
MSFRRLANDATAESAIGSFTHLRPATPFDDEVQTINRAMTLLLDGSSPHEVLLERSSASAAAGDAAQSNNAFSLSREHAYTPRRMRVITIGAGFSGLLMAHKFQHRFPELRDAVQHTIFEALPDVGGTWLVNQYPGLRCDVPAHIYAFPFDPKPDWDRVYATGEDIRGYIMATVRKWGLDENLHLNSRVVAARWLEQDGQWRVTVSHGGVERDEYCEVLISGQGVLRGQNWPSIPGLADFGGHLVHSASWDLEIDYSGKRIAVIGNGASGVQIVPEMARLPGTTVTNFIRGPTWVYSRALEAAEAAAPATCPDPNPKYTPEDKIRFRDPRAHAEYRKGLVAKANKAFCAMRKGEMNIAAANVATAQMAARLGHDKRLCDILIPKWELGCKRVVPGFGYLESFRESNVHLSNSAIVKITKNAIYTADGQVYDVDIIICATGFDTSHLPRYPIIGQDQTTDLASDWKNSPYNYMSVAVPKYPNFFMQMGPRCLGGQGSLIQCLDWTGDYIARWVAKMASENIKYVAPRDDKTRDFMRYGDSIHSGLVWSGGCASSYKRGTVDGPVTVLFGGGIQLFCRLISEIRAEDFDIVYRSPNPWRFMGDGFLDWEFKEDSDLAWYVEVASGPEEDSSRREGEPPEGAPEFVGGSFSTEPAPVPINCQSSLETATNGSNSAESLCQNKLRSQIVDWIRKISTNHRLISRNCNQNNILAVDAYHGLPSATMGARDTQVFPPLFDAKRYCKAPSNTAKCQKARDAPDSIPLEEFMCNEEYGRRPFAKSRNPFTCGLTGRTYTPAELFLRSTHLARALARRTAWGPNDDLTPWDKVVAVFSVNTIDYILPIYATHRLNGIATAANAVYTAGELEHQLRSAGAGVLFTCAQLLDIALQAADAVGMARDRVFLLPTVQGAPETPFPTVEELIDEGRGLAPLEPLRWVSGQGKRQVAFITYSSGTSGLPKAVLISHHNVISNVVAHVAYDSVGRRIHGIETEVELGLVPMSHTYGLLVVSHTATWRGDEVIVLPKFEIKSYLDAIQTFRIQRLLVVPPIIVAMLHRRELCAQYDLSSVRFVFCGAAPLGQETVVRLAREYPAWTVGQAYGMTEAAVIVTNTSEHDVLNGSSGSLLPGTRAKIIDPLTREEITSYNSPGELWIQATAETFVYDSDGRWLRSGDEVCMAISPQGYEHLFVIDRIKELIKVKGQQVAPAELEAHILTHPAVADVAVTQTSDPWAGEVPKAFVVVEAPEYKDLPPGEIENMVVGYVAEHKAPYKWIKGGVEIVDTIPKSPSGKILRRLLRDRERTKAGSEGGKKNANDLGLVNGRQKHLDFPAINLLETVGPRLNSGLNVTQRTPIRKALPKHKLAAAAEELGSLTTVADEFD

SEQ ID NO: 22744 - protein, 489 aa, Magnaporthe grisea 70-15
MCVTYPYYQPERDIPSLRGKVVLITGGTIGLGKEAAAQLSQNGRPAQVWIAGRNAERAGAAIAEIRRRLRKKPGPMPTPHRAAPSSMAESESPFRSSNTSIASSVESTGSQPSTSSTTTGDQSGLQGSSSTGILDASSLRRNRSYIDVGSRSLRPDKVGRSLPDSASGSTTRSHLGVDDGGGKLPDETEVYFLYMDLANLDSVRDAASRFLACVDRLDILILNAAEVSVPSGVTAQGYERHFGTNHLGHALLIKLLMRLLVRTATCDSVGSDVRVICVSSFAHRFTPPEGIDFDSLKPDPSSFHDSASATGSTTNITQSDTNQPGQQGRDGGGGGRPATSGSSQRPTLRRRRSSHTGSGPSSRLLYGQSKLANILYARELAERCPLFTTVSIHPGIAKSEGNWRRGGSRVVGSGAVVERFEQWIVPVFGASIDEGAKNHLWAATGRGISNGQYYEPVGVPARPSGVGDDRVLSWKLWEWTQRELAGYSL

SEQ ID NO: 22745 - protein, 354 aa, Magnaporthe grisea 70-15
MDPRSREVHLVTGGNGYIGLHVVTALLSKGFIVHTTVRSNKFKKVAALYALRDRHQPGRLQIFHADLLRPGSFTKAMKGCTVVHHIASPFLLPEDIKDGETQCIIPAVEGARNVLASVNETYSVKRVVFMSSVGAIYGDSRDVIEYMDGTLTEEYWNETSTSHHYPFHYSKVLAEKEAWMISKEQSRWDMVVICPGLALGPSLSQDGSDSGSVVLMNRIFGGQLFFGAPNLHLPVVDVREVATAHVQAADLPWASGRYILAATETRSLGDIARICRRQKGASRLIPTHKVPDFLLRICAPWIRLSQYWLSRNLGVGFSLDNSRSYKDLGIDYRPLEETIADHFVVWKEAKLARR

SEQ ID NO: 22746 - protein, 1019 aa, Schizosaccharomyces pombe
MAEYEIDEITFHKRLGILLTSWKNEEDGKTLFQDCDSILVTVGAHDDTNPYQKSTALHTWLLGYEFPSTLILLEKHRITILTSVNKANMLTKLAETKGAAADVNILKRTKDAEENKKLFEKIIEYIRATNKKVGVFPKDKTQGKFINEWDSIFEPVKSEFNLVDASLGLAKCLAIKDEQELANIKGASRVSVAVMSKYFVDELSTYIDQGKKITHSKFSDQMESLIDNEAFFQTKSLKLGDIDLDQLEWCYTPIIQSGGSYDLKPSAITDDRNLHGDVVLCSLGFRYKSYCSNVGRTYLFDPDSEQQKNYSFLVALQKKLFEYCRDGAVIGDIYTKILGLIRAKRPDLEPNFVRNLGAGIGIEFRESSLLVNAKNPRVLQAGMTLNLSIGFGNLINPHPKNSQSKEYALLLIDTIQITRSDPIVFTDSPKAQGDISYFFGEDDSSLEDGVKPRKPPTRGTATISSHKGKTRSETRDLDDSAEKRRVEHQKQLASRKQAEGLQRFAQGSVPSSGIEKPTVKRFESYKRDSQLPQAIGELRILVDYRAQSIILPIFGRPVPFHISTLKNASKNDEGNFVYLRLNFVSPGQIGGKKDELPFEDPNAQFIRSFTFRSSNNSRMSQVFKDIQDMKKAATKRETERKEFADVIEQDKLIEIKNKRPAHINDVYVRPAIDGKRLPGFIEIHQNGIRYQSPLRSDSHIDLLFSNMKHLFFQPCEGELIVLIHVHLKAPIMVGKRKTQDVQFYREVSDIQFDETGNKKRKYMYGDEDELEQEQEERRRRAQLDREFKSFAEKIAEASEGRIELDIPFRELAFNGVPFRSNVLLQPTTDCLVQLTDTPFTVITLNEIEIAHLERVQFGLKNFDLVFIFQDFRRPPIHINTIPMEQLDNVKEWLDSCDICFYEGPLNLNWTTIMKTVNEDPIAFFEEGGWGFLGAPSDDEGDDSVEEVSEYEASDADPSDEEEEESEEYSEDASEEDGYSESEVEDEESGEDWDELERKARQEDAKHDAFEERPSKKRHR

SEQ ID NO: 22747 - protein, 1116 aa, Magnaporthe grisea 70-15
MSHNHNPRANNRRGSIREKLKMGTAKNPPKAVPEQDDDEDVKLVPIPQPSRAPFVGNLPDLDVKFPLDSMVNLANKYGSIFKLDLPGLEFVTVSDWDLVHEVCDDSRFKKSIKGDLEELRNAVHDGLFTSSGEDEENWGIAHRVLMTAFGPLSIRNMFDEMHEVASQLALKWARQGPHEPLDVSGDTTRLALDTVALCSMGFRFNSYYRQDLHPFIKAMNEVLDEAGRRANRFMPSVFYHSHNKKFRENIKLLRTTAREVLDARKTQKGPEKRRDLLTAMLDGVDPKTGKKMTDESIIDNLITFLVAGHETTAATLSFALYNLAKFPEVSRKAQKEVDDVVGKGAVKLEHVPKLKYISALIRETLRLNAPITAFGREAIGDQVLGGKYLLKDKTQIVCFLTKSQSDPVIWGPDADEFKPERMLDDSFDRMQKKHPHCWAPFGTGVRGCIGRPFAWQEMVLCLAVLLQNYNFVMYNPAYALRLAQSLTIRPKDLYLRAISREGLTPAQLEARLAGGYTNGVHAEAPAEAAAPGGPVDGSKGAGRMAIYYGSNSGTCEFMAQRLAADAGSHGYTASVDTLDAAKEAMPTGIPVVIITASYEGQPTQNACHFVNWIQNLEEGKLKGVKYAVWGGGHSDWADTYQKVPGQIDTTLHKLGATRILPIGTTNAKDRDMFSDFETWEDQTLWPAMRDQFGGSEAAEAAPSVEVTFSTPRASDLRQDVRESLVVDARSLSKPGGEAGAREKRHLEIRLPTGCSYAAGDYLAVLPHNPRESVARIMRRFNLAWDTYMTVGAARATTLPTGVSLPVSEVLSSYVEIGQTATRRNITDLGQFANDDDTKYEILKLSKDSFDDEVRAKSLSVIGILERFPSLLVPFETFLFMLPPMRVRQYSISSSPLVDKGKLTLTYSVLNAPAHSGMGRHVGVASSYLSSLMPGDKLQASVRPAAGGFRLPPDPIRTPMICIAAGTGLAPFRAFIQERAALLRTSAQTPPAAPALLFYGCRDPDQDDLYRDELDAWEAAGAVVVYRAFSRRADASGGCRYVQDRLWREREAVGELWRRDARVYICGAGRMAGGVKEVLVRIMQSEGERMGTPISVEEGMAWFDKHRNERFATDVFD

SEQ ID NO: 22748 - protein, 238 aa, Magnaporthe grisea 70-15
MGESRLLQLNITKVEQCGTGAALCQVFDSIFLDVPMSRVKFNVNSEYAYIQNFKVLQNTFTKHQVDKPIPVAGLVKCKMQDNLEFLQWVKRFWDQYYPGGEYDAVARRKGAPLGAAGGGGGGAAVRAPVAGGAARRAGGTTPTTGAARAGLGVSKANPALAQENATLKETVVGLERERDFYFSKLRDIELLVQNAVEEDPEIEKQEDGLVKQIQAILYSTEEGFEIPAEGEVDDQETF

SEQ ID NO: 22749 - protein, 380 aa, Schizosaccharomyces pombe
MQQSPTAGKIINCKAAVAWQPAAPLSIENVQVFPPRVHEVRIKIVNSGVCHTDAYTLSGKDPEGLFPVILGHEGAGIVESVGPQVTTVQVGDPVIALYTPECKTCKFCKSGKTNLCGRIRTTQGKGLMPDGTSRFSCNGNTLLHFMGCSTFSEYTVVADISVVAIERLAPLDSVCLLGCGITTGYGAATITADIKEGDSVAVFGLGSVGLAVIQGAVKKRAGRIFGIDVNPEKKNWAMSFGATDFINPNDLQSPIQDVLIHETDGGLDWTFDCTGNVHVMRSALEACHKGWGQSIVIGVAAAGQEISTRPFQLVTGRVWRGCAFGGVKGRSQLPDLVKEYLDHKLEIDKYITHRRPLKEINEAFTDMHNGNCIKTVLSIP

SEQ ID NO: 22750 - protein, 2405 aa, Magnaporthe grisea 70-15
MKQHCVIADNQQIDCRDRLPIIWPSFMIHFNLQSAWSRTTGLELFGNCVKLAVQTAGASWLVIPRHVFCNRLLIWATMSLTIPKTDTPICDNIVSMTKNLSKMAPSAVLPESPPAAESYWSRLKNAVTGSSTGPPLPELSSSHAASGSTAPDHADPPRQQQQQQQQHTPIAIVGMACRMPGAVSSPAEFWELLARCRSGFGPIPAATRFDPAAFQHPVPGRGGCFTPAGGSFLQCDVRAFDAAFFGLTEKEAVALDPQQRLLLECTFEALENAGMPRHAIVGRDVGVFVGGSFPEYESHLFRDSDAIPVHQATGCAYAMQSNRISHFFDLRGPSFTSDTACSSSMVAVHLACQSLRAGESSAALVGGCHLNMLPEFWISFSTSRLLSDTGRSIAFDNRGTGFGRGEGCAMMVLKPLDQAVRDKDAIRAVIVGTGINQDGRTPGITTPNGAAQEALMQQVYRKFGLSRRECGFVEAHGTGTRVGDPIEARAIYKALGRGRARRDPLLIGSVKSNIGHLEGASGMAGLLKAVLMMERGFVLPNCDFKEPNPSIRWREWNLRVPTMQTPFPPDKKYISVNNFGFGGTNGHVVIQAAPYAAKEELSNNLPEKQHRMFVFTANDRESLAAVMQGVVVYLERRPEVFEGALMRNLAYTLGQRRSLLQWRAAIHSRHSLELIDGLNDKRAVVRRESEAVRLGFVFNGQGAQWWAMGRELYEQYPVFAASIDLADGSLADLGATWSLVDELAKDEETTRVGEAHISQPACTAIQLALVDLLRGWGVHPTAVAGHSSGEIAAAYSAGIITFKSAMSIAYHRGRLIPMLKEQFPALQGRMMAVGGSKSDVQGMIDGLCEKQVRIACFNSPSSLTISGDEPALAELEKVVEDRQMFHRRLVVDVAYHSHHMDLVAEEYQAALAHLPDPSRSTGVKFYSSLYGRLAEGSELRASYWVENLTCPVRFSEAVENMLEPSETSKTGVTALVELGPHSALQGPIKQILKAVGGAATAVTYDSALVRKKDAVDTLMDLGVSLFTKGVNLDFEAVNFPKPDKEPTLLTDLPNYPWNHRTRYWQESRMTTRHKQRPHPRSDLLGVEAIYSTDVEPTWRNILRIDEVPWLRQHKVQGLVVYPFAAFVVMALEAVAQRAASQSRQVDSLEVRDVTIVKPLVVGDADVEIITALRSTQEGGEVLAGSWNRFRISSYSPDAGWTEHCVGLVSARAKEINEVDGDREVAAREEELQSIMDSMESPGTSIVQTGSMYSKMAKAGVDFGPLFQGLQDCRASETHSSGNIPIPDVAKEMPQGVLASPIIHPCLLESLIAMYWPIVTSGDATVKTVYLPSSLGKMSITTDAIRICKEPDHSLLAYCHANSPSGLSRPLKVNAFATNSTNPKRALIAIEELVVSPIVDSGAEAAVDVPRELCYKIQWEPVSDLVDPVASHTDNSTARNGQGIPSHFSSLSVAVVHDKSELQNSLASTLSVDIKALIGNTPDVCSLEDLEPDGKTLIVLCELDRPMLSQLSEAKFNLLRNALTKAKSCLWVVRGAYASSSNPEANMISGLSRTLRSETAIKFATLDLDGDDEISADHATAVVLQVFERVFGVGSTPTSELEFTERGGRLLTPRVVNDEDMNAYVHSETCSSVLEDRPFANGDRPLRLAVTAPSSTESLHFVDDIANGTLDDDNVEIEVKAIGMNSRDIMAVKGQTDDEAGYEISGTVIAVGASCRDVEVGDHVCALVRGGYASRVRTKEMTVMRVPKTISFDEAACLPLAYCTAYYGLFDLGRLEKGESVMIHGAASPVGQAAICLAQEHGAKMFATVSTSQEKELLMKEYGISEHQIFSSKISGLGPKIRAATCGRGVDVVLDSSAGDAVTEAWECLAKFGRLVNLSNRDSSRGARWDMAERSKNLSYASVDICALAEEKPSVIRRVLAKLRMLLESGAMRPPGPIHKFPISNLESAFKTLQTGRLLGKIAVVANTGDQVKATRSRRASNLLRPDATYVLVGGTGGLGRSMARWMVTNGARHIALVSRSGMVSDNITELIDEGIQVGAEIVVRRCNVAIKADVESLISDGLRGMPTVRGIVHGTMVLRDVLFENMTWEDYTTVIQGKVQGAWNLHHALRDTPLDFFVALSSAAGMVGNRGQAAYAAANCFLTALVQHRLARGLPASSLDLTMVTDSGYLAENEEKLAEVARNLGGDGIREREVLALLRAAISGRLAETCNNHTVTGMRITPAVQPFWTLDAKFKHLRLAMEAQLEQANPSAGTGGVVSFGAALKAAKTAEEAEGVVCAGLVGKISAVLMLEAEDMDVTRSLTHYHLDSLVAIEIRNFIAREFEASMQVMELLASGSILSLAKMLVDESEVQLQDAARNVALAKAIRKFGKQYRETIINVHIWTNLRYCETSLKNLHFMQFLRPV

SEQ ID NO: 22751 - protein, 311 aa, Magnaporthe grisea 70-15
MSSTSTSPSGLPLGFPYRQERDGVWGEPTSTLNWCEEDYNITPYVAEFVNTFTNLIFIWLGFKGIRDCIANGFSSALVLSFVGYVVIGLGSMAFHGTLWYSMQLADELPMIWTVCVMSQVTFAYGKSKASSILLGFVFAGVAAFVTIYYVTNKNPVFHQVAYASITIGVVVKGALCTKYDLEPALKRRSPLQADKIMKQMWTLMTLGVGLFLLAFAIWMYDIVYCHHLVSWRSHMLLPWSVVLEGHGWWHILTGLGAYNLIVWRVWLSCCLDGKEDTFELRRITLLRVPEVVPIRHKSNGVISQKPKSKSA

SEQ ID NO: 22752 - protein, 261 aa, Cucumis sativus
MAISKTLSFGFLLLVSLGLASAARSLLSYDIPPHRSGYDNYDHPVVNPKVGYEHDRRDGYYHDRDHHDAPYGGGAGGGYGAGAGAGSSLGGSGYGSGGGGGSGYGGVGNHEVGYGSGGGGGYGAGVGSDLGGSGYGSGGGGGTGGGYGDLGGRGKGYGSGGGGGSGYGGRGDHGVGYGSGGGGGYGSGVGGGAGVVDHGVGYGSGGGGGAGSGYGGSKGYGGGSGGGGGAGYGGGAHGSGYGSGGGAGSGEEGGYDGGYAP

SEQ ID NO: 22753 - protein, 507 aa, Magnaporthe grisea 70-15
MVEADTNSPTWKFTQCFGDKGDVEDITEGKHPPDIISTVEFDHTGNYLATGDKGGRVVLFERNETKKTCEYKFHTEFQSHEPEFDYLKSLEIEEKINKIKWCRRQNASHYLLSTNDKTIKLWKVFEKSLKVVAENNLSHDLTPANIAGGGGAPRPPPASTFRNAADLKLPRLTHHDTVVAAVPRRTYANAHAYHINSISVNSDGETFISSDDLRINLWNLNIQEQSFNIVDIKPANMEELTEVITAAEFHPASCNVFMYASSKGTIKLADMRESALCDQHAKMFEQEEDPSSRSFFSEIISSISDVRFSYDGRYVLSRDYLTVKIWDVNMEKQPVKTIPIHEHLRPRLCDTYENDSIFDKFEVVFSGDAKNVMTGSYNNNFMIYPSDPEKETEVVLQADKSAFKAKKVGVPTPINSSTSPTANGGKKGGSRAGSPAAGGQGQRMRKETDADQIDFNKKILHMSWHPFEDSIAIAATNNAACNPVVGKSTRCKLTLFFLAQLFVFSAL

SEQ ID NO: 22754 - protein, 273 aa, Magnaporthe grisea 70-15
MEDFGSESDSDYTSYWRDWFIGSKGNEYFCEIDEDYLTDRFNLTGLNTEVSYYQYALDLITDVFDLDCDDDMRETIEKSARHLYGLVHARYIVTTRGLSKMLEKYKKGDFGKCPRVHCGSHPLLPMGMCDIPSSKPVKLYCARCEDIYNPKSSRHAGIDGAYFGTSFHNILFQVYPALMPVKSAERYVPRCFGFRVHAAASLVRWQSGRREDMRRRLRKMEVESGFKDGADEIEDDEEEDEEEDDEDGMKQEGMAVGLVDSATVPGDSMMQGV

SEQ ID NO: 22755 - protein, 443 aa, Magnaporthe grisea 70-15
MATPHEKLLEYFTAMDAAGAVIVKGRTRYDRLMLIGQCSVVLCVDALKVAVAEAKRGKDVARYREAVDLLRQASPNEPEASLDRKWIDVTEKSNREETKRLEQELKGYKNNLVRESIRMGNEDLGKHLEEIGNLADAAEAYSRMRPDVSTSKQVADVGKHIIRVALQKRDWTAVNSSLNRIAGLQSQLSEDLGFPTYIRVMDGLANLGQERYKEAAAAFLKADHSAPASSYADAMSPNDVAIYGSLLSLATMDRVAIQTNVLENSSFRSFLELEPHLRRAITQFVNGRYSSCLEILESYRSDYLLDMHLQRHIPELFLQIRSKCISQYLLPFSCVTIASLDESFAIDGESIEEELVTMISNGILDARINSVDKLVTATAVKPRIQMQLAALKAAQQYETEAAERLRRMNILAAELEVKSNNKRGMTAADTEWEGSSSAMASVF

SEQ ID NO: 22756 - protein, 1303 aa, Magnaporthe grisea 70-15
MWASGVPRESRWEQDTRAEVELVGKRLPQVPYGHAHSARPNTTGLLRFQAWLMHVARKPILPVGTRCCSKSKGIPPFRPELIGIPGWLSMPTGAYTDKANSGEPQQCTRLSVNNMKFGRNLPRNQVPEWSSAYIDYKGLKKLIKAAGATSKNGGQADLAEFFFALDRNLEDVDSFYNKKFADACRRLRLLHDRYGSSVDAISNLDQDEVEELMGAMLELRSKLRQLQWFGEINRRGFVKITKKLDKKVPGTVTQDRYIATRVDPCPFAKDNTIVRILNDINKWLSVLGDAQNMDDARSDRSARSLGRASVKAMLNFAPALLDKMDSAIRSDDVAGLKDGLEEGKVDTSDSGSQSLLLNLLQRSISSRSKASIAYILSQVNSLEDPDDINGRNCIHRLVLHIGRTKTTSAGEQEPAPYPFPHSSKFETQMGTHYLNPATSTGHIPAAGSESKEEKLLGHGDDAVQILNYLLDSLSDDHRPGLSARDSFGRTPLHYAAQFGIVDILELIIARMQDWGQFDVSRGIDAPEWEDNEGNAPLHLSVIGGHPRTTKALLKGESWQGLSESDKTELRRNVSKSSAVLAIATKHNHARIVAMLANAGVDINWRDKSGETALHIAARFGHYECARILIRGTDEQKADLEVGENFFAWTPLHIAAVDGHLSVAQLLVDAGADVDKPDSSGWTAKEHAALRGHMPIARLLAAHSTVEETATASAGESQPNQPSTGTSPPEVSSLGDRRSTAAVSRPAEPVRAYGHRYLKDQTMVLVSLGTMDMRKHVDAVKLDRVPLAEAHTTQLDTALSLVLSATGAQGDSTVIDLPVHENICTEPVIFTTTDVTKVKLLFDIVPTYSGNEKNKIGRAVALLSSIRPSIGAKRMSLQGDVCIPIIDSNLDVIGAVNFNFLVITPFSHPNMEVTSKQTYWKKMSSTMVIGHRGLGKNQAANKSLQLGENTVPSFIAAANLGAQYVEFDVQLTKDHIPVIYHDFLVSETGIDAPVHTLTLEQFLHINPDSSRNHSPNGRDSNGQPKNSQIKKIRSNSPGPRQRSLSMGWANTDSTVLDERMKHTRDFKAKGYKANSRGNFIQAPFATLEDLFHKLPEDVGFNIEMKYPMLHESEEHEMDTYAVELNSFCDTVLAKVYDLAGTRNIIFSSFNPDICLCLSFKQPNFPILFLSDAGAVPVGDVRASSLQEAIRFASRWNLLGVVSVAEPFVLSPRLVRVVKQNGLVCVSYGVWNNDPKMVQRQVKEGIDAVIVDSVLAIRKGLTAGQEQEHSDAAQTGENGEIVDLSAHPIDSNNSTKSGAVVASTA

SEQ ID NO: 22757 - protein, 486 aa, Magnaporthe grisea 70-15
MSAKSITEADGKAILNYHLTRAPVIKPSPLPAAATHNPPPRLASLYFAEDADVNGVLDQAEVTYPWLLQPGAKFVAKPDQLIKRRGKSGLLALNKTWAEAKAWVAERAGKEQKVEHVTGVLRNFLVEPFVPHPDGTEYYININSVRDGDWILFTHEGGVDVGDVDEKAEKLLIPVDLSEYPSNEEIASALLKKVPKGIHNVLVDFITRLYAVYVDCQFTYLEINPLVVIPNEDATSAAVHFLDLAAKLDQTADFECGVKWAIARSPAALGLAATASSKINIDAGPPMEFPAPFGRELTKEEAYIAELDAKTGASLKLTVLNGNGRVWTLVAGGGASVVYADAIASAGFADQLANYGEYSGAPTESQTYHYARTVLDLMLRAPLAPEGKVLFIGGGIANFTNVASTFKGVIKALREYAKALNEHNVSIWVRRAGPNYQEGLRNMKAATQELGLNAKIFGPEMHVSGIVPLALIPGKWEEGNFEEFKG

SEQ ID NO: 22758 - protein, 512 aa, Magnaporthe grisea 70-15
MAPSTLVGRPLNWAITAAAGAGFLLFGYDQGVMSGLLTGAAFTKTFPEMDTLNGGSASLQGTVVAIYEIGCFFGAIAALFIGEPLGRRKMIMLGCIILAIGGALQASASTIPHLIVGRIVAGLGNGLNTSTIPVWHSELMKATKRGKGLCVELAINIFGVMLSYWVDYGMSFEKSDAQFRFPLALQCAFAIVTFLGVLFLPESPRWLVANDRHEEAQDVLWSVEENARSISRDDERVTKHLVEIQTAIREEREAAGNNGYSALFHNGEQKFLYRTLLGIGGQFCQQLSGINLITYYAPVIFQQSVGLSRDLSLLLAGFNGVAYFFSSLVPIWLIDRLGRRKLMLFAAAGQGCCMAILAGTVANGSKSAGIVAIVMLFLFNFFFSVGLLAIPWLLPAEYAPLAIRSRAAALATASNWIFTFLVVEITPVSITNIQWRTYIYFGVFNFCFLPLIYFFYPETRNLTLEQIDKLFTGDRVKMHWDPSMGSVEGLTTGSPEGEKEAAVQTEIAERRD

SEQ ID NO: 22759 - protein, 469 aa, Magnaporthe grisea 70-15
MSYIFSWARIASPWLKADFCHCLQAAKSARSRRPSRNATQWIVDHEELPKQVIVANYVLKMLVSPEIHRPRRSTLPTWLNRKVNWIVNLVPSKQAVIRGHARTFQTSRNYPTGSASSDVFLRFSGICQDFRYRRTNGPELHTKPGTYAVSWARLENHLYKARGPSGDILRGTFHVPKSQRYKRSSRLRSPFSGCIAFAAAMTPVVANMPPSEFNFPSVNNDTVLTVAYTFNGNTTVVDPGTMFGGNVARNQPQLAVDPTKFRSLADYTGQYVVIMIDPDAPSPDNPIRRSILHWLASGITQTLGGGSGRISGQRSLTNSTPATVPYAAPGPPPSSSAHRYFFYIWQQPPGFQVPSSFNPNNRANFDIENFVRETNLGAPAAANYIYVSRQDSVPMTFIASPGSEYPGGNGNAVFPRKGDGNGNGNGNGNDNGDPYNPNYPDEGAASGGIQMSNFAALISFVAMGLACLV

SEQ ID NO: 22760 - protein, 202 aa, Magnaporthe grisea 70-15
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMADKKVVDYTVAKEFADSLGIPFLETSAKNANNVEQAFLTMARQIKERMGTTTTNNSKPSVQVGPGQGVGSNQSNSCC

SEQ ID NO: 22761 - protein, 321 aa, Magnaporthe grisea 70-15
MAFTPRGRGAPRGGGGFRGGDRGGRGGGGRGGGSFRGGDRGGRGGGRGGPRGGRGGPARGGRGGGRGGKPGAAGGKKVIVEPHRHKGVFVARGGKEDLLATINLVPGESVYGEKRIAVENSNKGDDDTPATKTEYRIWNPFRSKLAAGILGGMDNIFMKPGAKVLYLGAASGTSVSHVADLVGPTGNVYAVEFSHRSGRDLINMATKRTNVIPIVEDARHPLKYRMVVPMVDCIFADVAQPDQARIVALNASLFLKKGGGTCISIKANCIDSTAPAEEVFASEVEKLRAEKFFPKEQLTLEPYERDHAMVTAVYQQREFIE

SEQ ID NO: 22762 - protein, 484 aa, Magnaporthe grisea 70-15
MKLWTAIPAALSLLSFATASSVRLPSTFKPPQVFKNVNLVHVISLEKIYAKEQVNVLIENIASTPQDEYFFPFTIDELSRVGGFEVKDRKNEDAGPFTVEAVEFDPKSDLQYYRIRLPTPLKAGGQQTLGITYNILKAVRPLPAQVTQDGSQFLAYRFSAYCPSAYVTSKQKTEVKFSSSNVPDYTKLPSVDGDKPNPAKQGSKLTYGPFDEKPAGAVEPVQVRFEFTKPVTHIARLERDIEVSHWGGNVAFEERYTLFNMGANLSSQFSRVKWATQSYHNSPTHALKEIKFPLRVGSADVYYYDVIGNVSTSRFRSNKREALLEVKPRYPIFGGWKFPFTIGWNADAKNFVRRTSEGKYVLNVPFLEGPKQPEGIEYSQVQLRLLLPEGATNVKYHTKTPSSSIMSVEVGTQKTYLDTIGRTSLVITAHNLIDEHRDRELVVSYDYSLVASLRKPLVIFTSMMGVFALVWAAGQVETKFSYKK

SEQ ID NO: 22763 - protein, 480 aa, Magnaporthe grisea 70-15
MSKLFSKKPNAGATIQAQEEAPRFERVSWTKEPGLRQLYFYAVVLCVASATTGYDGMLFNSVQAFDTWKDYFGNPQGQMLGLLGALYQIGSMISIFFVPFFTDHFGRKVPIVMGCVIMIVGAVLQGCCQNLAIVAWLSFGTNYIPNEWSWRIPCIIQGLPSLIQLTFIYWVPESPRYLIAKDKHDQALAMLAKYHGNGDAQHPTVQFEYHEIKETLKLELEHKNASKYSEFLRTKGNRYRLAILISLGVFSQWSGNAIISNYVAVLYDTAGVKGSTDKLGLAGGQTVLSTIVSISMALLVDRVGRRPMFLASTGGMFLTFIFWTLTSGLYEEKGLDGARFAMIFFIWVHGIFYSLAWSGLLIGYAIEVLPYKLRAKGLMIMNVCVQASLTLNVYANPLAFEHFTGHLWKLYLIYTCWILGEVIFVYFMYVETRGPTLEELAKIIDGDQAEVARVDLDSKHYSEDHVLNRSSTEKVSNRAV

SEQ ID NO: 22764 - protein, 257 aa, Magnaporthe grisea 70-15
MATRGPPGARGMGNNRFAQFKLVLLGESAVGKVCWAVVSIVLRFVKVCDFYVTYSLIHCTYLVSSIVITNTASHHQQDQFDSYRESTIGAAFLTQTISLDENTTVKFEIWDTAGQERYKSLAPMYYRNANCAVVVYDITQSASLDKAKAWVKELQRQANENIIIALAGNKLDLVTEQPDKRAVPTSEAEAYAREAGLLFFETSAKTAENVRDLFTAIAKKLPLDQAGPRHARPGRGAGVSLNPPEGANTQTNGSCAC

SEQ ID NO: 22765 - protein, 1234 aa, Magnaporthe grisea 70-15
MTVDHWESIVQIRRSPIVAEHPAGRNPIRSFAWLLRVFMVIVVIAVSLVCLPYDGHSSPSREGYHANLQQPSSNVATQRSSRRPSSHDHQNQHQPQEHSPPIASQSNSPMSSRAAIASPVAVAPAGAPEYYQPTSSDRRRHHAPIAPPRTSSSHQTSAPVNGAQTSRRPVSASHQPQNSSSRRAPDHHGSSADQQTDQSSSSRRRDRHHAPATGDYPPQRQGSTRDPRTATTTTMPIRTNTGGSATASSSKQPSREASEILNSMLVSQPEVDIEREKERLALAQPTSSAHDASEVASPPVVPTQRSRQDHSSKREKHTKFGEYILGNTIGEGEFGKVKLGWKSEGGVQVAIKLIKKDALGSNPNRMQKIMREVSILKQLTHPNIVRLHKMEESERHFGIILEYASGGELFDYILNNRYLKDNAARRLFAQLVSGVGYLHKKGIVHRDLKLENLLLDRNRNIIITDFGFANTFDPALELTEEEEAGLSNREFVKRLGLDKIGANGSRKGDLMQTSCGSPCYAAPELVVSDSLYTGRKVDVWSCGVILYAMLAGYLPFDDDPANPEGDNINLLYKYIVSTPLTFPEYVTPHAKDLLRRILVPDPRRRADLFEVARHSWLSEYAHVVEFITSSTTTHTEIQNTTVPAEDSENPNLARSASVREASRRTPVSPTIGGLASKQGGIDQETEYAARQQKDNKRRTVQVEYVAPTTQTQRGEPAQQQATSGKTRARSGSEGPVEVDPRLSSDKPLPRDPPVSKESYSKPSVRGDPRKPPSSHRNQPSISRPPQSGRVPSDSYVTTMAPGSRPGTSGSMNTAGARPVAGASRSSYGQPLPPTVAGTNVHGRIQQPTDQQSEFGRPSAGGVPSKFAHVPGVAGHDQPDSREGSAKGHRRSNTLGEITGKMFGRSGSIFGNKNRKSSKVDQPQTPTEAKNRDSRKYPPVSMSAAPNPNGEYEPRKSVDSKRSRRSFSFGLGPRKKSGSIHNGSQTSVDKQNKRFSFIPGSISLKAIGIGKETPPGSTQGGGNDSQVDLGYQQEHLREPYRPDSQQQHQRQQSHYVDQRVNEQDLEAAGMDGMYAQLHSPSAPTFSTQQPHQQQQQQHYPAHYTSGQYGDRQMATAVPGYMQSGAHLQTSESESSVNMLSPEQQQFQAHGLRSVSVDHHQKLMEAQGGLGPAGRTGSSVGADGRQARVLQKNKRFVDAYDTDHSGGADHAGSSGAARRVMDFFRRRGKARGGDDR

SEQ ID NO: 22766 - protein, 1048 aa, Magnaporthe grisea 70-15
MTTAISSNHEPPYPPSSGDRGQAYPPVSRSQSTRHRPSTAQPPAPHRSVSHNHSGSMSSRPSSSARPVQDVLPNNDYETTNVAQKATKDSRPPQSSRDTATRQHRRSGSQRSGHHGHDGNAEAGPSTPSQASHGSSDPRTRKMRTVIPAQSGKWNLGKTIGAGSMGKVKLARKEDGTEQVACKIIPRVTPDDGHTPRAERERADLSKEVRTAREAAIVTLLSHPHICGLRDVVRTNFHWYMLFEYVNGGQMLDYIISHGKLKEKQARKFSRQIASALDYCHRNSIVHRDLKIENILISKTGDIKIIDFGLSNLFAPKSHLKTFCGSLYFAAPELLQARPYTGPEVDVWSFGIVLYVLVCGKVPFDDQNMPALHAKIKKGVVDYPNWLSSECKHLLGRMLVTDPKQRITMAEILSHPWMVKGYSGPPENYLPNREPLTLPLDQEVINGMTGFSFGPPEVIKAQLTRIIESEDYQRSIRAYQREKETQQTPKDPEKKRGFGFYRRRNSFSSKDTLTTPSSEGLALGNDPLNAFNPLVSVYYLVREKQEKDSASRRPATSARPNAVPEIAPPQEAHTNASAYEMPGENATGGRTRPRARTHGEDDAPTEPIRPPQLSPPAAPPPERLEPPKKESAAAGLLRRFSTRRRKEQPERLDKDRSHPPVVQVHSPAENSSQPTSAIRKSFSIRRGRRDREEQASAESQARMRAGSSQPQHSDLLSPPLSAGANTQTFRKGLGRSASVNSGEFSRRRAMGTARTSKDPPPTSGSDHSTIHEKPPKEQQEKRSPTTAGPSQSMTSRAKSLGHARQESIQARRQRREAEKKREANVPEETDAEVNGADDSSKERVTDFDLDKPVYLKGLFSVSTTSGKPVREIRTDIKRVLKQLGVDYTEIKGGFYCRHSPSIDLQNVADNGAASPAQTPSGAKRRFSFGALRSDGKEESNGERVPVTPRTPGRSGGGSGTDRDRHDSSSEVSENSEAREETSRRRDHPAGETRTHVRSDMGESMVSEFEIFIVKVPMISLHGIQFKRLGGNTWQYKNLADQILKELKL

SEQ ID NO: 22767 - protein, 478 aa, Magnaporthe grisea 70-15
MALPPKVYQWLIGVFASLGSATYGYDLGIIAQVISAPSFVKRVGDNPAEIGGIVSIFTGGAFFGALAAAPTADRLGRKLCIMMGATIFIAGGLLQALAQSTAYMMAGRGIGGVGIGAMIMIIPVYQAELTHPSIRGTVTALQQFMLGVGALFAGWFSYGMTVGVSDDDENQWRISLGLQVVPAGVLALLIMLFPESPRWLIDHGRADEGLQTLARLHAHGDVDDAWVRAEYSQIRESIDAEHEAEAKSYAELFRDRSCLRRLWLAASIQASVQMTGVSSIQYYSVAIFAKMGISGSDTLKYQGISGVWALVAQALCMAFVDRLGRRWPLILGNAFNCISFIVTTALLASFPPGESGGNMSASWAFIVMTWLYNFSFSATCGPLSWIIPAEIFDMKTRAKGVSIATAVCNATNAIYFWAVLPETARRPLEEMRYLFTEAPFFIPTMDPSRAYSNDLADRLEQAERKQDAAVEGRDETHV

SEQ ID NO: 22768 - protein, 427 aa, Magnaporthe grisea 70-15
MSEQETKIEAAVAVEPTVTAEVEKPQEDTKVEDAPAAPSGETAEQSEQAPSEDTKEQPEVETVDAVENTESATTESSDNILKTTAKHSQDGSKNTKFDPSVLPESNDPNEIRKQVEFYFSDSNLSQDKFLWTQVGGTENKPMKLSVIHNFGRMRRFKSYEAVVAALRESKVLDVAGEAGEETIVRKNAYDPARGNKSMVSSVYVKGFGDEEPDTQIKLEKFFGDFGFEISSVRLRRTDKKLFKGSVFVEFASPEEAKKFLELDPKPKWQDHDLKIMSKIAYCEEKNEQIRAGVIKPSERQAKFYEGKVSGARGGRGNSRGGNGNFNKREGGDKKDFGGRGGRGGRGRGRDNGRGRGRGARGGSRGGFRGGQRDGEKEAPREAPKPSNGNDVKPMIHSSAPSTNGKRARDSDSSAQEPPAKKVDTGSS

SEQ ID NO: 22769 - protein, 1004 aa, Magnaporthe grisea 70-15
MPPPKVPRLGSLGSRLARPFYTSMLISASLAAYALLRTRAASPKQSPLILRRKEEIDCRLVHQAEDQCAFVLANCQDEEAGLLPYLALYYCNLGAAQPVAFGLLAAWLALLFTTIGIAASDFFSINLSTIASILGLSESLAGVTFLAFGNGSPDVFSTFAAMGSNSGSMAVGELIGAAGFITAVVAGSMALVREFKVVKRTFVRDICFFILAASFAMAVLADGHLHFWECIIMVAFYIFYVMVVVGWHWWVTRRKRRWQKEAAARGHFYGANTQPSDELEPYRDNEEECEGSATTGREGLAESAPDISALERAPRIEVDDVGAEQDDEVNLDRDMFVAAEMTSSMRINRPRGGRSRSYTTLAQIRPSFVGALEFRSVLASLQNSSNVRLASMHSRRQSEALVNSQGDRPTLSETESHNALGSTSTNDTSASAGRDRARSHGTLPSVWTFPGPSSAPRIVTESPSSPMMRPTSKNSLPPPSRSSTTKDGRLAPPSEWHEFFPPGTNVAEGTPSIPPGSPMALRLQIPGSQTHSSGQSSPSLSPFPGLSDSPLLLTPISGLPINQSSTPVMDNPGYFGGDIQEECAKPVRWWPYSVLPPPHVFLRTLFPTLQGWATKSIWDKFVSVISAPSILLLVITLPVVETERLEEDPDLADPPTIEDEIGLPTGGPVCAEPVSLGDRPETEWQRYRRNTRSRSISPYSALATTLGNPFESTSLNPMATTNLMPRTNSVSLQPNKPGEQTPLLIQDNEAQEIEEESGWNRWLVAIQIFTGPLFTVLIVWANMADDLEQPTKTLVRLVLYSLLGSLVLLALLLSSTSPNVRPRYHFLFCFLGFIISVAWISTVAGEVVGVLKAFGVILGISEAILGLTIFAVGNSLGDLVADITVARLGYPVMALAACFGGPMLNILLGIGIGGAWMTTKTANERHHNHPDQPLKYKSYHIQVGGTLMISAVTLLFTLVFLLIVVPLNNWVMSRKIGWSLIIIWSVSTIVNLVFEATGTWSEVA

SEQ ID NO: 22770 - protein, 1014 aa, Magnaporthe grisea 70-15
MTLLSLVFLASLSNAAIIPRLPPPEVLPAGWDYMGCYVDIGRSLGAAATSSGLMTAEACINFCTSKGMQFAGTEYHNECYCDSSLPSAATLVADSECSTACSGDATQSCGGPSRLTVYHSAQPVGPQPNPGVNGFNHIGCYTQVPQLRTLIRREGTTSRALPVAGDVPSAEVTAATCTASCLAKGFKLAGVEYGGECYCGNSLSAGSVPAAGGCNTLCNGNSSEICGGPNRLNLYNWHENELPTASVPPTPSTTTSAATGPGSTAPPPPVVSDLPEGFEYHGCWIDGPNGRALPDYQAPDSQTLTQESCAQICSQRGYTISGSEYSTQCFCANAIYNGGSKTTEAECSMPCSGNPAQKCGAGNRLTIFSRGEPQVFLPPAPQTGGLGSWTYQGCYQDNLNDKRTFYWQLSFPNVMTPKMCLDRCAKYGYMAAGLEYGNECYCGDPQNVVTAGVATPRPSTECNVPCDGNRTAICGGGSRLSTYFWTGTLFYSWTFPQTPATAGRYDLLIDAPTIALMTQESITGKVTFLSKWGTGPGSETGAYELDVSMIPTNPAGAWRTLHVKTDIFCSAGVILPDRGARQLNVGGWSGESTEGLRLYWPDGAPGTPGVRDFQENVQELSLQKGRWYPTAMVMANGSVMVIGGQVGSNGAAVPSIEVLPHAPGSAPLYMDWLDRTNPDNLYPFVAVLPGGGILVTYYNEARILDEVTFNTIKQLPKIPGAVNNDLAGRTYPLEGASVLLPQKAPYTAPLGILVCGGSSNGAANALDNCVSIYPEAANPEWVIERMPSFRVMPCMASLPDGTYFIGNGALHGVAGFGLGVGPNLNSLLYDPEKPVGSRITVAANTTIARMYHSEALTLLDGRVLISGSDPEDGVNPQEYRTETYTPPYLLSGKPRPSFTIVNKDWGYGANVAFSLGSAARNGAITVTLLGAVSSTHGNSMGARTLMPAVTCTGTSCTVQAPPNAHVCPPGWYQFFVLDGGIPAVGVYVRIGGDPAGLGNWPPGNTFTKPGVGPV

SEQ ID NO: 22771 - protein, 252 aa, Magnaporthe grisea 70-15
MASSTGNPAAPEVGGTRPAFIPLEANPELMTELVHGLGLSSALQMHDVFSIDDPEMLAFIPRPALALLLVFPVSAIYESHRLAEDSLLADYAGKGPDEPVMWFRQTIRNACGMMGILHATLNGPAKNFIDADSTLDKLLKDATPLEPAARSKLIETNGALAQQNKAVASRGDTAAPEATDDVDLHYVCFVKAEDGTLWELDGRRKGPLARGKLEDSEDVLSEKALVLGPRKFLEREGGDMRFSCVALAQSMD

SEQ ID NO: 22772 - protein, 379 aa, Magnaporthe grisea 70-15
MALPMAPPAKSPLGRYRLLSPTAGVRVSPLCLGAMNFGNGWKAHMGACDQQQTEEILDYFYSQGGNFIDTANNYQFEESETWIGEWMKKRGVRDQMVIATKYTTNYRSGPAGEGSIMANYTGNSTKSLRSSIDASLKKLQTEYIDLLYVHWWDYSTSIPELMQSLNQLVAAGKVLYLGISDAPAWVVSKANEYARNHGLRQFSVYQGKWSAASRDFERDIIPMAKDEGMALAPWGALGSGNFKTEEQRKNTDGRRSRPATEADIKISQVLETIAKRKGSIITSVALAYVMHKSPYVFPIVGGRTVDHLKQNIEALALELNSEEIAEIEGAVPFDLGFPHVMLWGEKAPENRQQVWLVNMGGQFDYVPEPKPIPASKGGV

SEQ ID NO: 22773 - protein, 238 aa, Magnaporthe grisea 70-15
MADGAAKPSSSVKLVLLGEAAVGKSSLVLRFVNNDFQENKEPTIGAAFLTQKCNLPARTIKFEIWDTAGQERFASLAPMYYRNAQAALVVYDLTKPTSLIKAKHWVAELQRQASPGIVIALVGNKLDLTSDGGDASGGGDDDGDAEGAGDDSGDARKIPTEEAKAYAEEEGLLFFETSAKTGFNVTEVFTAIANAIPETSLKSARGAGAGAGAGRSGEQQSVSLNGPRDVEGKDGCAC

SEQ ID NO: 22774 - protein, 177 aa, Magnaporthe grisea 70-15
MLIFKDIVSGNEMFSDVYDPKLVDDVVYEVDCKMITVDAVNVGADATVPDTGANASAEDAEEALEDGPTKVNDIIYSFRLQSSSFDKKSYLSHLKGFFKAVKEHKKSQGASEEDVKAWEKKAGDYVKNKLLPNFKDFEFYIGEEFNPDGMVALLNYREDGITPFFTFWKDGLTEMKC

SEQ ID NO: 22775 - protein, 258 aa, Magnaporthe grisea 70-15
MVQSGNAAYGVVPFENSTHGVVTFTLDSLGDRAGEFADVSVCGEVYLDVQHFLLGRRDPTADDPNSLAHIRHVYSHPQAFGQTQGFTSTRLAHAELVDVSSTSRGAEMAAADASRTSAAVASEMAAAATGLDILARSIQDRGDNTTRFLVLRRGRPSVARQDASFAVAAAAATKSLVSFTVPHRCPGALAEVLQCFQRHGLDLTSINSLPSLIQPFQYLFFVEFEAADRAESSIAVVLEDVARVAQSSRWLGSWGSKR

SEQ ID NO: 22776 - protein, 163 aa, Magnaporthe grisea 70-15
MSYYFAIIGTQDNPLFEYEFGTSKQGGDGMPRFAEASRHMNQFILHSSLDIVEEAQWNTGQMYLKCVDKFLNSYVSCFVTGGNVKFLLLHQPVVVGPQTTAATRNSIAANPTSVATEEAIKSFFMEVYENWVKAIMSPFYKVNMEVRSPIFRARVAAAGKKYL

SEQ ID NO: 22777 - protein, 252 aa, Magnaporthe grisea 70-15
MSATTNNPGAHYDDKGKKTFVPLENNPAVFNDLVHRLGLSSELGFYDVYSIDEPDLLAFVPRPVHALIFIVPAPVYYRVREHDGSEEITYDKAGEQEPVMWFEQTIGHACGLYSLIHAVANGSARQHIKRDSLIDKILAEALPLKRAQRADILYNSKALEDAHMSCAVGGDSIVPEATEPVGYHFITFAKGKDGHLWELEGSWDPIDRGVLDDSDDMLSEKALKLGIRKFLHECQATGVSGFVKHQHWLLKI

SEQ ID NO: 22778 - protein, 474 aa, Magnaporthe grisea 70-15
MRLIASLALAASLASSITNGSTIPRRASGTPAAPRVIGLETERQHIPNPLERDRLRRRAAVMATLDNEQTLYFVNVSIGTPPQKLRLHLDTGSSDLWVNTPDSKLCSVSSQPCRFAGTFSANSSSTYQYINSVFNISYVDGSGANGDYVSDMVTVGNTKIDRLQFGIGYTSSSAQGILGVGYEANEVQVGRAQLKPYRNLPSRMVEEGLIASNAYSLYLNDLQSNKGSILFGGIDTEQYTGTLQTVPIQPNGGRMAEFLITLTSVSLTSASIGGDKLALAVLLDSGSSLTYLPDDIVKNMYSAVGAQYDSNEGAAYVPCSLARDQANSLTFSFSGIPIVVPMNELVLDLVTSNGRRPSFRNGVPACLFGVAPAGKGTNVLGDTFLRSAYVVYDLENNAISLAQTSFNATKSNVKEIGKGSNPVPGAVAVSQPVAATSGLSQNGGNRSGSGAIARAVPTLLLVGGIFSGSLLTLF

SEQ ID NO: 22779 - protein, 409 aa, Magnaporthe grisea 70-15
MTPSATNGDAAAASSRFHASSTKSAIAAENEYAAHNYHPIPVVFARAQGVNVWDPEGKHYLDLLSAYSAVNQGHCHPELIKALAEQAGRLTLSSRAFYNDVFPVWAAKVRDLFGYDMVLPMNTGAEAVETAIKIARKWAYKVKGVPQGKAHVFSVADNFHGRTIRYNNISDLEIVLEAHGAETAAFIVEPIQGEAGVVVPDDDYLAKVHALCKKHNVLFICDEIQTGIARTGKMLCCNWAGIKPDIVTLGKAISGGMYPVSCVLADKDVMMVVEPGTHGSTYGGNPLGCAVSIRALELVEEGKLADQADHLGRIFREGVEAFKSPIVQQVRGKGLLNAVVIDESAAGGRTAWDLCMLLKSKGLLAKPTHGNIIRFAPPLIITEEELKKALSIIGEALTELPTAEKGDGH

SEQ ID NO: 22780 - protein, 466 aa, Magnaporthe grisea 70-15
MASKASRWAVSQEDVAKAKQEREAKRRAKAAKAAARKAQEDTVAQSQLQSQPPAAENGPPAKRRRVTPAPDAAQNDDDDDGGRGTTNEHRLLRLPGPPFGKCRSVENYDKLNDIEEGAYGWVARAKELATGKIVALKRLKIDPKDRSGLPVTGLREIQILKDCSHRNVVEMHEVVVGDDTSKFENIFLVLEFLEHDLKSVLEDMPEPFLSSEVKTVLLQLAAGVDYLHENFILHRDLKTSNLLLNNRGQLKIADFGMARYVGDPPPKLTQLVVTLWYRAPELLLGTIKYGQAVDMWSVGCIFGELLTREPLLQGKNEVDELTKIFELCGVPTEESWPGFRRLPNARSLRLPKNPQAAGSVIRARFPLLTAAGSGLLSGLLSLDPERRITAKEMLAHDYFKQDPRPKHESMFPTFPSKAGQERRRRRDTPNAPIRGLAADLGDVDFTGIFARREREEKGAGFQLRMI

SEQ ID NO: 22781 - protein, 508 aa, Magnaporthe grisea 70-15
MGSTSEARTSSSAGASQPSSIRSVDVSAKSSPTLAPQNGHHNGVPNSAEQVLKPVEKTSVKERLTRMFSTKDTQRSSNLAPPSGDKSAPVSPGLAPPVRNQPPSRKGSTTDKASEKTAAASAAKAAKSSNGTAHQQQRFLVNPDAQGGHEHHLKSSRRQEKLSDMFRSMLGGGKRAEQQDHDLSLVSGWVDTLKQEKDKDKDVGQAGEKRGGPNASVTLVEKYGKCQEVVGRGAFGIVRISHKKMDNGAGERLFAVKEFRRRPEENEKKYSKRLTAEFCISSSLRHPNVIHTLDLLQDAKGDYCEVMEFCPGGDLYTLVLAAGKLEVQEADCFFKQMMRGVEYMHEMGVAHRDLKPENLLLTTHGALKITDFGNGECFRMAWENDAHMVSGLCGSGPYIAPEEYTSKEFDARAVDVWACGVIYMAMRTGRHLWRIAKKDEDEFYARYLEGRRDEEGYGPIESLHRARCRNVIYSILDPNPSRRITASQVLKSEWGREIKLCKAGEEGL

SEQ ID NO: 22782 - protein, 177 aa, Magnaporthe grisea 70-15
MKAYFYDDLPGDQREPHDSGKAVDTDGLASIGVLYFHLPDVSSVDSLAASRGYRNRDEITVSPEKMGDAYEDKVKSFFSEHLHEDEEIRYIRDGHGYFDVRDRADRWVRIHLDKGDLIILPAGIYHRFTTDDSNYIQAMRLFKDEPKWTPLNRVPELEDNEHRKKYVDEFLEGCSRS

SEQ ID NO: 22783 - protein, 375 aa, Magnaporthe grisea 70-15
MFRHGIRRFTTSSIRAAVAAAAEPTQHTINVSRAQGVAKGLTGAIGNTPLIRLNKLSEETGCEILGKAEFMNPGGSVKDRAALYVVKDAEERGLLRPGGTVVEGTAGNTGIGLAHVCRSKGYKLVIYMPNTQSQGKIDLLRLLGAEVYPVPAVAFDNPQNYNHQARRHAERLDNAVWTNQFDNTANRRAHIETTGPEIWAQTDGKVDAFTCATGTAGTLAGVTRFLKDASGGRVKSFLADPPGSVLHSYIVSGGKLIERTGSSITEGIGQGRITDNLQPDLALLDGALHISDEKSIEMVYRCLDEEGLYLGASSSLNVVAAKEVAEKLGKGHTVVTMLCDGAYRYADRLFSRKWLEDKKLLSAIPKHLEKYIVLP

SEQ ID NO: 22784 - protein, 360 aa, Magnaporthe grisea 70-15
MGYPETFEGFCVDSPKTWNKFSKQELKPKPFEDYDIDVEIAACGVCGSDIHTLTGGWGDFQGPLCVGHEVVGRAVRVGSKVRSEIKEGDRVGVGAQVWACLKCKVCESKNENYCPHMVDTYNAKYEDGSSAHGGYASHIRAHEYFTFKIPDGLETEIAAPLLCAGITVYSPLFRAGVGPGKKVAVVGIGGLGHLGVQFSKALGAETYAITHSKNKVEDAKKLGAKEVIVSSDKDWHKPYAFTFDFILNAADALDQFDLPAYMSTLNIEGQFHTVGISDKPVPQLTAFAFAPNAAKLTGSHLGNHQEMDAMLKLAAEKNVKPWVETIDVSEEGCKKAVEGVKDNKVRYRYTLTGFDKAFSR

SEQ ID NO: 22785 - protein, 315 aa, Magnaporthe grisea 70-15
MFGFFETKFNPTKDIPDLSGKVILVTGGNIGLGQSSVLELARHNPKHIFLAARNEEKARKAIESVSWELGTDKASVVSFLPLDLSSFDSIRKAAETVNSKTDELHILLNNAGIMMTPATTTKEGYEEQFGTNHMGHALLTRLLLPVLEKTAQGGKVDVRIVNLSSAGEGLAPTNAFDDLSRYKSPMEDVASHTRYGVSKLANIYHAQMLARKYPSIKAVSVHPGVVNTNLTRGLKETYPWIVPYVAPIAGALFFKTPAEGAKNQLWASTNEKVISGEFYWPVGLLGKGSEKSKDTEAAEKLWDWTEKELDAYLKQ

SEQ ID NO: 22786 - protein, 363 aa, Magnaporthe grisea 70-15
MTSHPEWDQQTTGTEVVKAFADAIKGKNGMAAKNATNNPEVTCAAKRGIGSATALAVASQAPNHLILASRTASKLEEVIADINQKYPGVKAVPVRLDLGSIDSIRDAASKIESLLVGEEINVLINNAGVTDKTRAPITTPDGTRLDKQFFVNHIGTFLLTNLLTPLLQKAAAGSPSGATRVVNVSSHGHRISPIRFSDYALDKYGSDEAIPEAERTHPETPAFLLKGMDDEGFPGFVAYGQSKTANILHATELSRRLKKSGVVAFSIHPGFIETDLDRSLDKEFSDALKAMAANGFKTLDGGAATTLVAAFDPALGQVDVGVEVTGYLSDCQLSEQLVRDHAKDPAIARRLWEETERMLQISK

SEQ ID NO: 22787 - protein, 500 aa, Magnaporthe grisea 70-15
MSRYLTRRLAQTTASLRLSSGRRCYSAKASFDWKDPLNSKSLLTEEEVAISETAERYCQEKLAPRVLGTLRVRFLDLVIVSRAILSEMGELGLLGATISGHGCAGVSTVAGALITRAVERVDSGYRSGMSVQSSLVMGGIDYWGSTEQKERFLPQMAAGKLLGAFGLTEPNHGSDPASMETVARPHPTKKGFYSLSGSKTWITNSPIADILLVWAKLADGEGPSKIRGFLVERKNCPPGTLETPAIKNKTGLRASLTGMIHLDNCPIPEENMFPTVTGLKGPFTCLNSARFGIAMGVMGALEDCIAATREYALERSQFGRPLASFQLVQKKLADAATDAAYGSLAAIQVGRLIDEGKSVPDMISMVKRENCDRALRNARTLQEVLGGNAVSDEYRIGRHVANLFVTQTYEGQSDIHSLILGRAVTGIQALLRWVVIGDGSLASFVFHRDVGSESPLRVKPHAQPYCQFYYVGDCRALHLTKKEMCFAQSRQRVAQPPQLG

SEQ ID NO: 22788 - protein, 395 aa, Magnaporthe grisea 70-15
MAIAQEQELVLITGATGHVGSTTLAHLIRAGYNVRAVVRSEAKSAQLLARPSIQRAIKHSRRWSNRYRNQLTTTTSTGQLSFVVVPDITAPGAYDDAVVGATLVVHIASPLVTADTVPLSKHEEYFLRPAVRGTLGLLEAARAAGTVRRVVITSSIVSLVPVDRMEGNLSPEEARSLPPVQPTDRVRDADGPYTSEFAAYHGSKVASLAHAEEWVARECPGFDVVYLHPSFVLGHNDAATTPAQALKGTNAVVLAMLLGQRFGPYAGATVHVEDVARAHVAALAVDRVPGNQSYILSGPRPTTWNDAKEIVERRFPEAIKSRMLVTRGSVDTTYLPFDVSLTEETFGFEFTSFEEQVVSTVGQFIELRMQQKAALSRKNAAVRARDTLPSVRANA

SEQ ID NO: 22789 - protein, 155 aa, Magnaporthe grisea 70-15
MAVATSDAQLFEGVFKVTEVNQQKYDRVARIWARSDASTDLMDMTLDINTELFPMSEGEVFRVVLATSLSLDGSKDDDKAGWRDATKLGGPATLADSFDYVCHGKIYKFEDSEDGDNIKAYISFGGLLMCLNGPYKKLTPLRVDYIYLLIKGNKD

SEQ ID NO: 22790 - protein, 416 aa, Magnaporthe grisea 70-15
MSWKKSERLMDTIRHYAKFPATGVSLRQMVQFGEKPSVGKYQSPGRTLFRASQFLAEELPIRLAHRVHELDTLPDGLNEMPSVKKVLDWYAQSFELLSEATPNPSIAEGQYASQAVTSQNGNGWTKKQHAARRYFAMVDDYGDWPPELQLYNQRFSQTLNKIKRRHDGVVTTMAQGILEYKRQRQRMQIDNNMQSFLDRFYMSRIGIRMLIGQHIALTDQSHYRDPTYVGIICTKTNVRDLAQEAIENARFVCEDHYGLFEAPKIQLVCNPNINFMYVPGHLSHMLFETLKNSLRAVVETHGQDKQEFPVTKVIVAEGKEDITIKITDEGGGIPRSAIPLVWTYMYTTVDSTPNLDPDFDKSDFKAPMAGFGYGLPISRLYARYFGGDLKLISMEGYGTDVYLHLNRLSSSSEPLQ

SEQ ID NO: 22791 - protein, 193 aa, Magnaporthe grisea 70-15
MAEIRRKLVIVGDGACGKTCLLIVFSKGTFPEVYVPTVFENYVADVEVDGKHVELALWDTAGQEDYDRLRPLSYPDSHVILICFAIDSPDSLDNVQEKWISEVLHFCSGLPIILVGCKKDLRYDQKTIEELRKTSQKPVSPEDGEEIKKKIGAYKYLECSAKTNEGVREVFEHATRAALLSRHKTKKKKCLIL

SEQ ID NO: 22792 - protein, 2118 aa, Magnaporthe grisea 70-15
MGLTADFDDRQTHIEAESNEYHPYEYQTENNSSWAGALPVKQGLYDPDLEKDACGVGFACHIKGKPSHKIVSDARNLLCNMTHRGAVGSDARDGDGAGVMTSIPHKFFIKNFEREVDIKLPPLGQYAVGNLFFKPDQETLHESKRQLEDIAESLGLRVLGWREPPVDSTLLGPAAKSREPIIMQPFVVLTSAYGAGNAPETTDPEKFDERLFERQLYVLRKRATHTIGLQNWFYLCSLSNKNIVYKGQLAPVQVYEYYHDLVNADYEAHFALVHSRFSTNTFPSWDRAQPLRWAAHNGEINTLRGNKNWMRAREGVMQSDIFGDELELLYPIVEDGGSDSAAFDNVLELLTINGVLSLPEAVMLMVPEAWQGNDHMDPKKAAFYEWAACQMEAWDGPALFTFADGRFCGANLDRNGLRPCRFYVMDDDRIICASEVGTIPVDPERVIQKGRLQPGKMLLVDTVAGRIIDDSELKAAVSSRQDFRSWLDKELISLPTLVESVAQDKTVQLEAKPDATALQEDPLLHAFGYTFEQVSLLLAPMAQDEKEALGSMGNDSPLACLSQAPHLLYEYFRQLFAQVTNPPIDPIRESVVMSLECYVGPQGNLLEMDASQCGRLLLPSPILSIPEFNAIKNMPKLHPEWTVKVIDITFPKKEGVEGYMRHLDYICNETTDAIEKRNRVIVLSDRNTSADRVAVSALLASGMVHHHLVSNKWRSMAALVVETAEAREVHHMCVLLGYGADAVNPYLAMECILKLNREKLIKKQLTDDMLIYNYKHSCDGGILKVMSKMGISTLASYKGAQIFEALGVDDSVVERCFRGTASRIKGVTFETIAEDAFRFHERGFPSRHTVAVPGLPESGEYHWRDGGEPHINDPTSIANIQDAVRTKNDKSYEAYSRSEYEQIKACTLRGMLDFSFEEATPVPIDQVEPWTEIVRRFCTGAMSYGSISMESHSTLAVAMNRLGGKSNTGEGGEDPERSQRMPNGDTMRSAIKQVASGRFGVTSAYLADSDELQIKMAQGAKPGEGGELPGHKVSKSIARTRHSTPGVGLISPPPHHDIYSIEDLKQLIYDLKCSSPRSRVSVKLVSETGVGIVASGVAKAKADHILISGHDGGTGASRWTGIKYAGLPWELGLAETHQTLVLNDLRGRVVVQTDGQLRTGRDVAIACLLGAEEWGFATTPLIAMGCIMMRKCHLNTCPVGIATQDPELRKKFKGTPEHVINFFYYIANELRAIMAKLGFRTINEMVGHAEMLKVRDDLRTNKTENIDLSLILTPAHKLRPGVATFNVRKQDHRLYVRMDNKLISEAELTLDKGLPSRIECDVVNTDRALGTSLSYQISKKYGEAGLPMDTVHVNIKGSAGQSFGAFLAPGVTLELEGDANDYVGKGLSGGRLVIYPPRSAVFKAEENVLIGNTCLYGATSGSCFFRGVAAERFAVRNSGATAVVEGVGDHGCEYMTGGRVVVLGSTGRNFAAGMSGGIAYILDIHHDFMSKLNMEMVEASGLEDPEEIAYVRGLIEDHHHYTGSELAARILVDFNRALPRFIKVLPVDYKRVLQEEAAKAAEAKRAEYSLPVLPSHQHKKEEKAAKLQDIEETIGDAAADKKKALKLDKTKGFMKYHRQNEKYRSSKTRTKDWAEISNRLDEDQLKYQTARCMDCGVPFCQSDSGCPISNIIPKWNELVFSGQWRDALNRLLMTNNFPEFTGRVCPAPCEGACVLGINEDAVGIKSIECAIIDRGFEKGWMVPQPPKVRTGKTVAIIGSGPAGLAAADQLNKAGHLVTVYERSDRLGGLLMYGIPNMKLDKRIVERRTNFMAAEGIQFKTGVDVGNGDVTLSSLKATHDAVVICTGATVARDLPIKGRNLEGVHFAMEFLHKNTKSLLDSELADGSYISAKDKNVVVIGGGDTGNDCIGTSVRHGAKSVINFELLPQPPPERANDNPWPQWPRIYRVDYGHSEVRQHMGKDPREYCIMSEEFVDDGSGKVKGINTVRVEWTKSASGGWDMKKVEGSQQFFPADLVLLSMGFLGPEARVLGDDIEKDARKNVKTAPGKYATNMEGVFAAGDCRRGQSLIVWGINEGRQAAREIDLYLEKYTSLPVTGGIVKRTAQEIFSAVKPVAPVAA

SEQ ID NO: 22793 - protein, 200 aa, Magnaporthe grisea 70-15
MKLLVSLSLLASAAVTVLAADELGIEVTQAVNCERKTKSVSGPDVPQQQTEDVNGDMVHMHYKGTLQSTGDKFDASYDRGTPLAFPLGTGRVIKGWDQGLLDMCIGEKRTLTIPPSLGYGDGGIGPIPGGATLIFETELVSIDGVETPEKIDYVSKAEEAASKATEKVAEKVADKIKEAAEVVKTVVADSDDAGQEHNEL

SEQ ID NO: 22794 - protein, 1184 aa, Magnaporthe grisea 70-15
MPNEGRTNQQGDARSKDEQRAFSTDTSKAMSSSRRSPSPLSSFAPPRRPDSRPRPPREQQQPHPPLPRDNLGRGRSIERPLEPFESRSQRPEPSNNSTAQGSAEGPRQGPRQNRRSRHRSRDRPRRPSRHRSPPRPPQEPRRGFAPDSIFDRPARSGHLDQPDTAKEKERDLPHRNTAAREPSRLASSPASTSKRQRSPGPPVADQDHSAKRPRRGPSPQADEPYHFDSRAAPDKTGPGREERPQRPFSPGRPRSRSPGYGRDFDRREKRKKKKKKNKNRRDRSRSPNRDRDEFGGPAPSGRKPLPQPGRESGGRRRSRSPLAPDRPRSFSRGGSPHSQPHGAEHPPFSPSQQVPPRGRGHNPSRDFDIPPERRHYDGRATPPPPEASRSRKKGRGREERHSRKSQAPRVSGANSVEVNMSARGSGYRGGYGPGGGYQMQAPYSQGPPTGPRRFSHSSGHATPSSFHGTPPPQSPYGGSQGWGGQQQYQSPSYAHQYPPNGGYTPNGPHNPGNFTPTGPHGQYHQSPSYAPPSGPNSQYSYPQGPARGGHRGGFRGGNAFNQVGRAGYHGNSFKSTSHNGSVHGGSVHGGSVHGGSVHGGSGHASPAATSNNGDSGIQQAHGHPNEQAKDDENPFRPSKDLQVEDNTQSGHGEDNSQPQQDQPQITVPQTERQPPSGPSNPKIKFQFKSSSKVPATIPKPEISSKFNALPPTQPKAQQQQQRQEAINKERNLPQDVPTGPASTRSRHDRGPRPPHDAPRQPSGQQPLPQPRFRMVKKTMRRPIRKEGLPTEMANSDSVYYRKPGNESVVGAGTYGKVFKAINVYTNNLVALKRIRMEGERDGFPVTAVREVKLLQSLRHINIVKLQEVMVEKNDCFMVFEYMSHDLTGLLNHPSFKLEAPQKKDLARQLFDSLDYLHRRGVLHRDIKAANILVSNDGILKLADFGLARFYAKHHQLDYTNRVITIWYRSPELLLGETRYGPAVDIWSAACVMVEILTQYAIFPGEGGEISQLDKIWAVLGTPSRSEWPGLLEMPWFELLRPAFKRPNNFAKLYQHRVTPAAFDLLEAMFRFDPAKRPSAAEILEHPYFTEEEPAPRQAVELATIEGDWHEFESKQLRRKNEAKEKEARRAARAEKEKEAAGAGGSEKKRSHDQTAVASEQSQPDAKRQNVDGRPPAQEKASDAG

SEQ ID NO: 22795 - protein, 1039 aa, Magnaporthe grisea 70-15
MAEIKIDGKLFQERASHFVNAWKADKRSGDALFGGASSIVVMMGKVEETPEYHKNNAMHVSTPQFWLLGYEFPTTLMLFTVDTLYILTTAKKAKHLDQIKGGRYPVEVLVRGKDAAENEKAFVKIAEHIKEAGNKVGVLTKDASKGPFVEEWKKVYTEHCKDVEEVDIAQALSSAAFSTKDEAELRAMRTASKACVALMHPYFLDEMSDILDQEKKVKHSVLAEKVEKKLDDDKFWKTVTLPNKQKLPSDFDPEQLDWILGPNVQSGGKYDLRWQTEANNDNLHPGIIVSALGLRYKSYCSSVARTFLVDPNKSQESNYKILHGAHQLILKEVRDGAVVKDVYQKALAYVKSKKPELEKHFLKNVGCGIGLEHRDPTMILNAKNTRALKDGMTLCIMTGLQDIENPNPQDKNSKVYSLVIMDTVRVTASEPVVFTGDAPCDADASSFFFKDEETAQPAPKKEKKESRVGAVATKNITSTRLRSERSTQVDEDAEKRRREHQKELAAKKQKEGLARFAESTNDQNGTEVKKFKRFESYKRDNQLPPKVKDLAVIVDQKNATVIVPIMGRPVPFHINTIKNASKSDEGEFSFLRINFLSPGQGVGRKDDQPFEDATAHFVRSLTFKSLDGDRYTEIANQIANMKKESAKKEQEKKDMEDVVEQEKLVEIRNRRPAVLDNVFIRPAMEGKRVPGKVEIHQNGIRYQSPLAAQQRVDVLFSNVRHLFFQPCQHELIVIIHLHLKDPILIGNKKKTKDIQFYREATDIQFDETGNRKRKYRYGDEDEFEAEQEERRRRAELDRLFKSFAEKIADAGKSENLEVDMPLRELGFNGVPFRSNVYIQPTTECLIQITEPPFLVVTLDDIEIAHLERVQFGLKNFDLVFVFKDFTRPPVHINTIPVESLEDVKEYLNQSDIAYSEGPLNLNWPTIMKTVTADTHEFFEGGGWSFLQADSDDEGDGEEEEESAFEVSESELEEASESSEEDSEFDSNASDEASDEDASEEEEGEDWDELERKAKRKDRESALDDEEEERGNSKKKQRKR

SEQ ID NO: 22796 - protein, 371 aa, Magnaporthe grisea 70-15
MVKETKLYDALGIKPDATQDDIKKGYRKQALKWHPDKNKNNTDAAEKFKEVSQAYEILSDPEKRKTYDQYGLEFLLRGGVPMDTDGGNPFAGGAGGMPGGFQNFGFGGPGGGGTFRFSTNGSGFSFSNPDSVFSDFFRQASGGGGGGMGGINPEDLEDILGGGARSSRGGPRVRSSFGDSVPGGGARSQRQPTPEITTVERPLPVTLEEMFNGTTKKMKIKRKMFDDSGKRTTTDTVLEVPIKPGLKKGSKIRFKGVGDQEEGGQQDLVFIVEEKKHALYTREGDDVVHDVDLELKEALTGWKRTITTIDGKQLQIDKAGPTQPGSRDTYPGLGMPISKKPGQRGNFVVKYNVKFPTYLTPEQKTKLKEIL

SEQ ID NO: 22797 - protein, 469 aa, Magnaporthe grisea 70-15
MVLRACFDVKRIAVIGAGPCGLAAAKYLVAQKAFSEIVVFEQAAEVGGVWNYSKTPSSTLHVPQTNPLCAPDPPVFPDKEGPAMFPSPMYDLLHTNIPRTIMGFKDLELSAGVAFPHRDEVQAYLVKYSQDVRHLIKFSTIVKDVRLRQGTEIDQWDVRTESSTGGNPQMQTFDAVVVASGHYSTTYMPRIPNIEDFHKTHPAVITHSKTYRSPSIYTGKKVIVVGNSASGVDIAAQIQRVAGKVFLSVREATASDSLAHIGAEETPPISEFLVKEKGVQFEDGRVEKDIDSVVFCTGYLFAFPFLESLATPLLTDGRRVHGLYKDFLHIKHPTLVFPGLPIKVIPFPFSESQAAIYARLWANALPLPSEKEMSDWEKSAEEQRGPAFHVYPKKGDVEYLREMHAWASKAESGKEPPLWTDEQVWQREIYAQAKLEFEKTGRTAKTLAELGFHYKAPSDVVEEAAQDVL

SEQ ID NO: 22798 - protein, 1082 aa, Magnaporthe grisea 70-15
MIQKYGGHAVKFSFSNSPLDNIFGLRFAWEFYRHGRRDEYLKFTHRSFAQSGAGRANPYTYEVNLGGVRTIWTADPENIKAMLGSQFEDYGRGKAFQSRWHDLLGTGIFNADGREWHDSRHRLRPLFNRQRVSNLDSFERQIQIMINRHLGGGRTVDLKDVISRFALDAIGDYAMGFQVNALADRKNDFLDALERIKTIQNIKECAGPLSWLVPTPGFKRDLKVLDDFMEPLIEHAASLPQSVLDEMEKTDHGWTYVKACASVSRDRHFLKYELMSVILAGRDTVSGTLVWTFLELVKRPDLMADLRREIENTVGIGRDAPRPTHDDLRSMRLVKNTLNETLRLYPTVSLNLRTALRDTSLPRGNDHDGNKPVGLAEGTPVIFSSHILQLSPETYEQSPPGTSPPHVFDPYRWEEWKPKPWTYIPFGGGPRICIGQEFALAEMAFLLVRLLQNYSRLEMRCEMRGNSDEGWERPNGSASIVEQFMMEKGRVRISGDVTLSPRDKDSQLVKIISTKPTMIVTIPVLLATYILYWTVRLVKNILRANATGLPVRWTPVAPTNPFWIVLGKPTSRVLRAILPSFLSNWTYFSTFDWHWLDRLYLDFEVHEKNGDTFLHATPSGLMLHTRDPQVAQQILHTCPKPDDVAKSLELCGPNLVSSSEVDWPRHRKVTVSTLSDRNNRLVWSETVRQTLNVLQSYQPGHGEIIDPEGDIRRIYLNMFSAVCFGRPLDAEKEPGETTDGKLPGGHKRSYRYCLETSLRDIFILHTVPSWIKYLPPALVPHKISEFFAASREMMQYLDEMIRRCQDEAQEGGEESKSGDNLLRITVRSGLQSNTKEPQGRSYLSKEEVRGNLLIYSLAGHESNAHTLTYALYLLAACPDVQDWLAEELAAITLLDGQLSAEETYFGIMAKLPRTLAVMYETLRLYPSIIFLPKTTASRSVSIDLGHVEGQSKAIIPPNTNIWVNMCGMQVLPEVWGDDARTFRPSRWINSSGQLAAPSLVAGSAYVAWGGGKRVCPGQRFSQAAFAASVVALLTGGKRVHVVPREGEEEGMARRRVLEVLDDSFVGTTIHMRRAGDVKLVVA

SEQ ID NO: 22799 - protein, 223 aa, Magnaporthe grisea 70-15
MTEEEIQQAIRDYATAAENAIEAGFDGVEIHAANGYLIDQFLQDTCNERTDAWGGSVEKRARFALEVTRAVVQAVGADRTGIRLSPYGTFQGMGMADPAPTFGYVVDQLRPLKLAFVHFVESEDGDHRSVDWLVKKVGGPVLVANGFTPESAKAAVDEKYKDSDVVVAFGRLFIPNPDLVFRIQNGVPVEPIDPTGDFYEAKTPKRFLDFPFSSEYQASIKAN

SEQ ID NO: 22800 - protein, 313 aa, Magnaporthe grisea 70-15
MSVPSFITAPEFEGGPPQGLSIPFRLRWSKTHPPKEPIVTFKGRTVLVTGANTGLGFEAAVKYAAFGADKIILAVRSIEKGEEAKKRIVERTGRDATDISVLKLDLGEYSSVKDFVSALHEVTPTLDVALLNAGLGNPTYEKSSAGWEMAVQVNVLSTALLAMLLLPLLRSSAAASGAKSHLTFVNSFAHTLVPRDFPLIEGSILKTATDESSWNASSSYNIVKLLAMASVQGFARMEAGEDQQRVIVNSVCPDLCETDLGRKFTGFISSIGKAIFYYLFALSAEEGARCLIGATALGPESHGRFWHHDFLYP

SEQ ID NO: 22801 - protein, 315 aa, Magnaporthe grisea 70-15
MTAFGSETTAEEVVSAFSSNVKGRTFLITGASANGLGAYMATSLARASPQALILIARSEVKVAPVIEEIASIDPAIRAIFVPVDLTDQESVRAAAATILDDRDMTKIDVVINCAGIMYVEEFTTDAKGNELQFSANHVGHFLLTNLLMPKILAAGEGARIVNITSHGHQLSDVWWSDPTFNKGKDYHGWSGYGQSKTANILFSVELARRLKDRGVVSLAGTGLFQHVPMERLDEGDMISRKNTGLPFGLDLPWKTSSQGSSSGLAAALDPELAAHSGSYIQNCQVGTPRQYALDGEKAKKLWIMTEELVGQKFDL

SEQ ID NO: 22802 - protein, 423 aa, Magnaporthe grisea 70-15
MAITKIHARSVYDSRGNPTVEVDVVTDTGLNRAIVPSGASTGQHEACELRDGDKSKWGGKGVTKAVENVNNIIGPALIKENIDVKDQSKVDEFLIQLDGTPNKTKLGANAILGVSLAVAKAGAAAKKPYVLPVPFMNVLNGGSHAGGRLAFQEFMIVPSAAPSFTEAMRQGAEVYQQLKGLAKKKYGQSAGNVGDEGGVAPDIQSAEEALELITAAIEAAGYTGKMNIAMDVASTEFYKEDEKKYDLDFKNPDSDKSKWITYEELAAMYSDLCKKYPIVSIEDPFAEDDWEAWSYFYKTQDIQIVADDLTVTNPLRIKKAIDQKAANALLLKVNQIGTLTESIQAAKDSFADGWGVMVSHRSGETEDVTIADIAVGLRAGQIKTGAPARSERLAKLNQILRIEEELGSNAVFAGESFRKAINM

SEQ ID NO: 22803 - protein, 411 aa, Magnaporthe grisea 70-15
MSTSGKKATATALAQKYAPQIANKTVLVTGVSPNSLGATFVTAIAVASPALLILAGRNAAKVEETTKAIQAAAPHVPVRFLNLDLADRESVRKAAGEVLSWQDVPGIDVLVNNACLIGSEYKLIDGFEAHFVVNYLHPFLFTNLLLPKVIAVKGRVVNVASDCHRWHHIRFSDLNFDVSVSWKISQRSAARLQPRQNGKIYNMWQAYGQSKTANMLFSLALARRLGGRGIVTNSVHPGIIQTNAASHLDPAEILRLIAAEEVERQCGLANQAFLSYKTVDEGTATHVYAAFEPGLKDHNGAYLLDSHVADPVEDPVAPWGTSEADAEKLWRLITRRIPPSKSHIKGGKSKHLEANYYDQRLAPLLKRPDRSHPPDDFCREIPPAAPKQDKKIVYINTHNAKRINLVNLNEA

SEQ ID NO: 22804 - protein, 254 aa, Solanum chacoense
MGRTFFVGGNWKCNGTSEEIKKIVATLNAGQVPSQDVVEVVVSPPYVFLPLVKNELRSDFHVAAQNCWVKKGGAFTGEVSADMLVNLGIPWVILGHSERRAILGESNEFVGDKVAYALSQGLRVIACVGETLEQRESGSTMDVVAAQTKAIAERVKDWSNVVVAYEPVWAIGTGKVATPAQAQEVHAELRKWLQANVSAEVAASTRIIYGGSVSGANCKELAGQPDVDGFLVGGASLKPEFIDIIKAAEVKKGA

SEQ ID NO: 22805 - protein, 373 aa, Zea mays
MDSSGGGGGGAQIKGMATHGGRYVLYNVYGNLFEVSSKYAPPIRPIGRGAYGIVCAAVNSQSGEEVAIKKVGNAFDNHIDAKRTLREIKLLRHMDHENILALKDVTRPPTRENFNDVYIVTELMDTDLHQIVRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSPGAVDLLERMLVFDPSRRITVDEALHHPYLASLHEINDEPTCPAPFSFDFEQPSFTEAHIKELIWRESLAFNPEPPY

SEQ ID NO: 22806 - protein, 318 aa, Carica papaya
MENFPVIDLSKLNGEERASTMELIHDACENWGFFELVNHGISHDLMDTVERLTKEHYKKCMEQRFKEMVESNGLEAVQSEINDMDWESTFFLRHLPASNMHEIPDLEDDYRKAMKEFAVGLQKLAEQMLDLLCENLGLEKGYLKKVFYGSKGPNFGTKVSNYPPCPKPDLIKGLRAHTDAGGIILLFQDDKVSGLQLLKDDQWVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKAMESTVTPGAIATV

SEQ ID NO: 22807 - protein, 475 aa, Benitotania elimbata
MSPQTETKAGVGFKAGVKDYRLNYYTPDYQTKETDILAAFRMTPQPGVPAEEAGAAVAAESSTGTWTTVWTDGLTSLDRYKGRCYDLEAVTGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQFARELGMPIVMHDYLTAGFTANTSLAHYCRDNGLLLHIHRAMHAVIDRQKIHGMHFRVLAKALRLSGGDHVHAGTVVGKLEGEREVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELSAACEVWKEIKFEFDTIDTI

SEQ ID NO: 22808 - protein, 475 aa, Bryobrothera crenulata
MSPQTETKAGVGFKAGVKDYRLNYYTPDYQTKETDILAAFRMTPQPGVPAEEAGAAVAAESSTGTWTTVWTDGLTSLDRYKGRCYDLEPVAGEDNQYIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYLNATAGTCEEMMKRAQCARELGMPIVMHDYLTGGFTANTSLAHYCRDNGLLLHIHRAMHAVIDRQKNHGMHFRVLAKALRLSGGDHVHAGTVVGKLEGERQVTLGFVDLLRDDYIEKDRARGIYFTQDWVSLPGVLPVASGGIHVWHMPALTEIFGDDSVLQFGGGTLGHPWGNAPGAVANRVAVEACVQARNEGRDLAREGNEIIREAAKWSPELAAACEVWKEIKFEFETIDTI

SEQ ID NO: 22809 - protein, 475 aa, Adelothecium bogotense
MSPQTETKAGVGFKAGVKDYRLNYYTPDYQTKETDILAAFRMTPQPGVPAEEAGAAVAAESSTGTWTTVWTDGLTSLDRYKGRCYDLEAVTGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQFARELGMPIVMHDYLTGGFTANTSLAHYCRDNGLLLHIHRAMHAVIDRQKIHGMHFRVLAKALRLSGGDHVHSGTVVGKLEGEREVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREAAKWSPELGAACEVWKEIKFEFDTIDTL

SEQ ID NO: 22810 - protein, 163 aa, Streptomyces rishiriensis
MCPAGPTASDGSDEAVMSEPTKPEVDVPEGDAPTELTIRDLIVGDGVEVKPGMVVRVHYVGVTFESGKEFDASWDRGQPFKFAVGSGKVIKGWDRGVRGMNVGGRREIIVPPRLGYGNQSPSPLIPPSSTLVFVVDLLDAYSSATGWSNAQRGHGVIPGRAEP

SEQ ID NO: 22811 - protein, 465 aa, Ephedra tweediana
DGFKAGVKDYRLTYYTPEYQTKDTDILAAFRVTPQPGVPPEEAGWAVAAESSTGTWTTVWTDGLTSLDRYKGRCCDIEPVPGEDNQYFAYVAYPLDLFEEGSVTNMFTSIVGNVFGFKALRALRLEDLRIPTAYIQTFQGPPHGIQVERDKLNKYGRPLLGCTIKPKLGLSAKNYGRAVYECLRGGLDFTKDDENVNSRAFMRWRDRFVFCAEAIYKAQAETGEIKGHYLNATSGTCEEMIKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSMPGVLPVASGGIHVWHMPALTEIFGDDAVLQFGGGTLGHPWGNAPGAVANRVALEACVQARNEGRDLAREGNEVIREACKWSPELAAACEVWKEIKFEFATVDTL

SEQ ID NO: 22812 - protein, 465 aa, Erythroxylum confusum
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPKAYSKTFQGPPHGIQLERDKLNKYGRPLLGCTIKPKLGLSAKNYGRAVYECLRGGLDFTKDDENVNSQPFMRWRDRFLFCAEAVYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVVLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 22813 - protein, 340 aa, Solanum tuberosum
MEVISTHTNGSTITITTNGHHNNGKSDHRNGGTIHDNGNKLLLGNSNSIKPGWFSEFSALWPGEAFSVKIEKLLFQGKSDYQDVMLFESATYGKVLTLDGAIQHTENGGFPYTEMIVHLPLGSIPTPKKVLIIGGGIGFTLFEVLRYSTIEKIDIVEIDDVVVDVSRKFFPYLAANFNDPRVTLVLGDGAAFVKAAQAGYYDAIIVDSSDPIGPAKDLFERPFFEAVAKALRPGGVICTQAESIWLHMHIIKQIIANCRLVFKGSVNYAWTTVPTYPTGVIGYMLCSTEGPEVDFKNPVNPIDKDTTHVKSKLEPLKFYNTDIHKAAFILPSFARSLIES

SEQ ID NO: 22814 - protein, 154 aa, Hordeum vulgare subsp. vulgare
MAKPGLLLCLLVVAAALLLVASAKKSGDVSALQIGVKYKPESCSISAHKGDRVKVHYRGTLTDGTVFDSSYERGDPIEFELGTGQVIKGWDQGILGMCIGEKRKLKIPSKLGYGDQGSPPTIPGGATLIFDTELVAVNGEPSSKSDEDVADSDL

SEQ ID NO: 22815 - protein, 226 aa, Hordeum vulgare subsp. vulgare
SLQAFIVHHPNGVAFYGVVLDGPGGSVATVTEYMANGSLRQALQRHEKIFDRRRRLLIVMDVAFGMEYLHGKNIVHFDLKSNNLLVNLRDPQRPICKVGDLGLSKVKCQTLISGGVRGTLPLMAPELLNGSSNLVSEKVDVFSFGIVMWELLTGEEPYADLHYGAIIGGIVNNTLRPLVPESCDPQWRSLMEQCWSAEPTERPSFTEVVKRLRAMATSPTKPLLQK

SEQ ID NO: 22816 - protein, 498 aa, Aspergillus kawachii
MVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 22817 - protein, 159 aa, Pseudomonas putida
SFRLDLDKLATRYRELAREVHPDRFADASEREQRVALEKSAALNDAYQTLRSAPRRARYLLAISGHEVPQEVTVHDPDFLLQQMQWREELEELQDEADLDGVGVFKKRLKAAQDTLNEDFAACWDAPGERDKAERLMRRMQFLDKLAQEVRQLEERLDD

SEQ ID NO: 22818 - protein, 512 aa, Debaryomyces occidentalis
MRFSTEGFTSKVVAAILAFSPLVSAQPIIFDKRDVGSSADKWKDQSIYQICTDRFARSDGSTTADCLVSDRKYCGGSYKGIIDKLDYIQGMGFTAIWISPVVEQIPDNTAYGYAYHGYWMKNIDLLNTNFGTADELKQLASELHSRSMLLMVDVVYNHYAWNGDGSSVDYSSFTPFNQQSYFHDYCLITNYNDQTNVEDCWEGDTEVSLPDLSTEDNEVIGVFQTWVSDFVQNYSIDGLRIDSAKHVDTASLTKFEDASGVYNLGEVYQGDPTYTCPYQSYMKGVTNYPLYYPVYRFFSDTSATSSELTSMISTLQSSCSDVSLLGNFIENHDQVRFPSVTSDTSLIKNAMAFIILGDGIPIIYYGQEQGLNGGSDPANREALWLSGYNTDSEYYELISKLNQIRNQAIKKDSAYSTYKSSVVSSSDHYIATRKGSDANQLISIFNNLGSNGSQDITVSNTGYSSGDKVIDIISCNDVSAGDFGSLSVSISGGMPQVYAPSSVLSGSGICNQ

SEQ ID NO: 22819 - protein, 116 aa, Streptococcus pneumoniae
WLAVNPNYEMINVQEALANPDSIFYTYQKLVQIRKENSWLIRADFELLDTADKVFAYIRKDGDRRFLVVANLSNEEQDLTVEGKVKSVLIENTLAQEVFEKQILVPWDAFCVEMTD

SEQ ID NO: 22820 - protein, 321 aa, Rhodococcus sp. X309
AAAGGKIDATADANKLALDVIGLAGFGYDFASFDGDEHPFVGAMSRVLEHVNRTSNDIPFLRKLRGNGADLQYEKDIAFVRTVVDDVITERQAKPGEHQDDLLDLMLNNIDDETGEKLDPVNIRNQVLTFLVAGNETTAGAIAFALYFLSRHPEIADAARAEVADITGGETPAFEDVARMRYLRRVVDETLRLWPSAPGYFRKVRTDTTLGGRYAMPKGSWVFVLLPQLHRDPVWGENPDSFDPDRFKPENVKKRPAHAYRPFGTGPRSCIGRQFALHEAVLSLATILQRYSFQSDPEYKLDVREALTLKPVGLELSLQRL

SEQ ID NO: 22821 - protein, 205 aa, Fucus distichus
MSRNDSPFDMQIKLLMIGDTGVGKTCLLLRYANDSFSQTFITTIGIDFKIKNIDLDSKRIKLQIWDTAGQERFRTITTSYFRGAQGILLVYDVTDKKSFNSIRNWVAQIQQHADVAVNKILIGNKCDMDEDREVSKEEGANLAAEYGIQFFETSAKNDINVEKGFITIAREVKDRLMADGPGGGGGHGRTVDINGQASKKKTGCC

SEQ ID NO: 22822 - protein, 328 aa, Phaseolus vulgaris
MRPRSRVERATSAKILCHHFSLADIRKSTNNFDHKRLIDHEGFGVELYKGCLQYDGSDYTVTIKRFNKDAHERGEQWNQFKNEIELLCQLRHPNIISLTGFCNHEKEKIVVLEYMPNGSLYSHLQRGELSWKKRLEICIGAARGLHYLHAGAKRTIIHRDINPLNILLDANMEPKLSNFGISLQGQRFMSKPKPIKVDTIAGAIGYLAQECFKNSIVSDKTDVYSFGIVLLQVACGKNNYFSMREIDGFLESVEENIDMDIKGKIAPECWKVFIDIIQRCVDYEAEERPTMGEVEVQLEYALSLQEQADITNIHHHYILLAKTIINDY

SEQ ID NO: 22823 - protein, 343 aa, Phaseolus vulgaris
MFPKCLGFCGWKHTSSSQQQHPTLIHELCQQFSLTDLKKSTNNFHHTRLIGYSSFGKLYKGCLQHDDGSEYSVTIKPLYGEDNIEGNNQFNKEVELLCQLHHPNCVSLIGFCNHKKEKILVYEYMSNGSLDQYIQGRFREALSWRKRIEICIGVARGLHYLHAGAKRTIFHRDVCLSNILLDDQMEPKLAGFGRSIQGARFMSKPKTIPIDDDTWGSYGYHPMQHFRDTIVTDKCDVFTFGMLLLEIVWGRRYFAMKEIDGFLEKPVEENIDMDIKGKIAPECWKVFIDIIQRCVNSAADERPTMGEVEVQLEYALSLQEQADSTNIHGDYILLSKTIVNLKP

SEQ ID NO: 22824 - protein, 359 aa, Phaseolus vulgaris
MTSQTIEEQHSSMCMPTTNTTSSQRQFPTLIEELCHQFSLTDLRKATNNFDQKRVIGSGLFSEVYKGCLQHDGASDYTVAIKRFDYQGWAAFNKEIELLCQLRHPRCVSLIGFCNHENEKILVYEYMSNGSLDKHLQEGQLSWKKRLEICIGVARGLHYLHTGAKRSIFHCILGPGTVLLDDQMEPKLAGFGASEQGSRFMSKQKQINVDRVLGCRGYTATDYLMDGIITAKWDVFSFGFLLLEVVCRRMFYLITLTKKECLENPVEERIDPIIKGKIAPDCWQVFVDMMVTCLKYEPDERPTIGEVEVQLEHALSMQEQADITNSNSEYTLLSKTIISLGSEEILTLEENPILNPNTL

SEQ ID NO: 22825 - protein, 398 aa, Phaseolus vulgaris
MPREYLKDCVVTDKYDVYSFAIKLMENPIEESIDPNIQGKIAPPCWQVFIDIIHRCIKYESDERPTMGEVERRFPTLIEELCHQYSLTDIRKATNNFDQKRVIGSGLFSKVYKGCLQHDGASDYTVAIKRFDNQGREAFNKEIELLCQLRHPRCVSLIGFCNHQNEKILVYEYMSNGSLDKHLQDGELSWKKRLEICIGVARGLHYLHTGAKRSIFHCILGPSTILLDDHMEPKLAGFGVSVQGSRFMLKQKQINVDRVLGTWGYTTTDYVMDGTITAKWDAFSFGFLLLEVVCRGMFYLISLTEKECLENPVEEGLDPIIKGKIAPDCWQVFVDMMVTCLKYEPDERPTIGEVEVQLEHALSMQEQADITNSNSEYTLLSKTIISLGVKQFDTEKIL

SEQ ID NO: 22826 - protein, 344 aa, Phaseolus vulgaris
MFLKCLGNKSSSKKPYLTVIEELCHQFSLAELRKSTNNFDRKRLIGRGGFGEVYKGYLQHYAASNYVVAVKRFSVEHSEVFKNEIELLCQLRHPNCVSLIGFCNHKKEKILVYEYMSNESLDRHLQRGELSWNQRLEICIGAARGLHYLHAGAKRTIIHRIVKPRNILLDDNMQPKLTGFCISVKGSRFMSKPKPIKVNVVAGTPGYMARELFTDDAITEKSDVYSFGMVLLEVVCGRKYVTMPIEREFLEKPLEEKVDASIKGKIAPKCWEIFIDITKRCVMYEPDERPTMGEVEVQLEHALSLQEQADITNTNGDYILFSTTVIHPGAELVYSTENSDTEEI

SEQ ID NO: 22827 - protein, 398 aa, Botryotinia fuckeliana
MKGAFLAAASLLGSVSAGVHKMPLKKVSLSEQLATANMQEHAKHLGQKYMGVRPESHASEMFKETSVHDAGDHTVPVSNFLNAQYFSEITIGTPPQSFKVVLDTGSSNLWVPSSQCGSIACYLHTKYDSSSSSTYKQNGTSFEIRYGSGSLSGFTSKDVMTIGDLKIKDQVFAEATEEPGLAFAFGRFDGILGLGYDTISVNSIVPPFYSMVDQGLLDEPVFAFYLGSNDESDPSEAIFGGVNKDHYDGKITEIPLRRKAYWEVDLDSIAFGDSEAELENTGVILDTGTSLIALPADLAGLLNAEIGAKKGWNGQYTVDCAKRDSLPELTFTLSGHKFPIGPYDYILEVQGSCISAIMGMDFPEPVGPLAILGDAFLRRYYSIYDLGKNTVGLAKAKA

SEQ ID NO: 22828 - protein, 141 aa, Ricinus communis
HVNPAVTFGAFVGGNITLLRGILYWFAQLLGSTVACLLLKFSTGGLTTSAFALSSGVGVWNAFVFEIVMTFGLVYTVYATAVDPKKGSLGTIAPIAIGFIVGANILAGGAFDGASMNPAVSFGPALVSWSWENHWVYWVGP

SEQ ID NO: 22829 - protein, 251 aa, Ricinus communis
MPIRNIAVGHPHEATQPDALKAALAEFISTLIFVFAGEGSGMAFNKLTNNGVATPSGLVAAAIAHAFALFVAVSVGANISGGHVNPAVTFGAFVGGNITLLRGILYWFAQLLGSTVACLLLKFSTGGLTTSAFALSSGVGVWNAFVFEIVMTFGLVYTVYATAVDPKKGSLGTIAPIAIGFIVGANILAGGAFDGASMNPAVSFGPALVSWSWENHWVYWAGPLVGGGLAGLVYEFFFIHSTHEQLPTTDY

SEQ ID NO: 22830 - protein, 280 aa, Ricinus communis
MAKDVGEETQTSHGKDYVDPPPAPLVDMAELKLWSFYRALIAEFIATLLFLYITVATVIGYKKQTDPCGGVGILGIAWAFGGMIFILVYCTAGISGGHINPAVTFGLFLARKVSLIRAVAYMVAQCLGAICGVGLVKAFMKNPYNRLGGGANSVASGYSNGTALGAEIIGTFVLVYTVFSATDPKRSARDSHVPVLAPLPIGFAVFMVHLATIPITGTGINPARSFGAAVIYNNDKVWDDHWIFWVGPFVGALAAAAYHQYVLRAAGIKALGSFRSNPTN

SEQ ID NO: 22831 - protein, 396 aa, Yarrowia lipolytica
MTFHSLVNKVSGQPPSYNKKADYKFGKTLGSRYFGIVKYAKQHSTGEEVAVKIIVKKNLKGNDHVVIEELSLLKECHHPHIIAFKDWFESKEKFYIVTQLATGGELFDRICDYGKFTEKDARQSVKDILEAVDYLHSKDIVHRDLKPENLLFVTPDPHASLVLTDFGIAKHLKSPDEVLHSMAGSFGYAAPEVLKGTGHGKPCDIWSLGVITFTILSGYSPFRSETVRDFLEEIEGPNALVFHKKYWQDVSEDAKDFIKSCLALDPALRPTSAELLKHEWITGDTTKSIDLLPNIREGFNARSKFRQAIEAVRLHNRIKSLNMVDSDDEDEEEEAVADTEKPSLLSVASSMRPRAHSRSKSGTGAAAFQEVVLAAKRNKELLEKEKASKQDAAEEK

SEQ ID NO: 22832 - protein, 483 aa, Burkholderia sp. RP007
MDTQLIIDNADVPATAAATFERRSPTTGELVTRAAAASVADAIAAADSAAAAYRSWSTTGPTERRRILLKAADLLEARTPEFSRVMALEVGASDLWAGVNVMLAANLFREAAALTTQIQGETIPTDKAGVLSMTVRQPVGVILSIAPWNGPVVLAARAIAYPLVCGNTVVFRASELSPKTHMLIVDVLRDAGLPPGVLNAVTNAPQDAPEVVDALIAHPAVRRINFTGSTRVGRVIAEKAARHLKRCLLELGGKAPLVVLDDADIDEAVKAAVFGAFLYQGQICMSTERIVVDEKIADTFVARFAARARELPVGDPATCGGCVVGPMIVRESGDRINAMINDAVNQGANVVAGGFADGAVMPATIVDRVTPAMRIYDEETFGPITTVVRAKDADDAVRIANDTAYGLSSAVFGRDVTRALSVAMRIEAGSCHINGSTVQNEAQAPYGGTKASGYGRFDGRAVIDEFTELKWITIEPTPQSYPF

SEQ ID NO: 22833 - protein, 123 aa, Fagus sylvatica
LMSLLLLSGRLVRERIGPAMLSAVQSQMGAVETNFDEIPNIFDTGSAKGLPGDSVEKIPKIIITTNNNVDASGDRVSCSVCLQDFQLGETVRSLPHCHHIFHLPCIDKWLLRHGSCPLCRRDL

SEQ ID NO: 22834 - protein, 395 aa, Thermoproteus tenax
MAKFHIATADDIISRRATDIYFIRTVETLKAAGLDDAVVRAEFHVASLPEGYKWAVFAGLKEALYALEGKPVTVYALPEGTLFGENQPLMVIEGRYVDFAVFETTVLGILRHYSSIATKAARVKKAAGDKSCLFFGARVLHPAVQPMADRAAYIGGCDGVAGVLGAELMGKQAVGTMPHALMIIFRALKGDHTEAWVWFDAAAPPQVPRIVLADTFLDEREEAVLAVKRLGERLWGVRLDTPGSRRGNMRRIVEEVRWTLELMGRRDVKIVVSGGLDEEAVAELADIVDAFGVGTSIAFPPSVDISMDIVEVKVGGAWTPITKRGKLPGFKQLYDCGGLKRVVRPWGEPPPKCADGSEGRPLIKKYMEDGKIVESIPSEDEIRRYVLRQLESAEL

SEQ ID NO: 22835 - protein, 196 aa, Fucus distichus
MQNIKCVVVGDGAVGKTCLLISYTTNAFPGEYIPTVFDNYSANVMVDGKPINLGLWDTAGQEDYDRLRPLSYPQTDVFLVCFSVVDPTSFHNVKLKWIPELQHHAPGIPFILVGTKLDLRDDQDAIKRLAERRQTPISFSEAQGLSSDLEAYRYLECSALTQHGLKQVFDGAIRCVLEQNQRKMKKKKGKKGCVIS

SEQ ID NO: 22836 - protein, 198 aa, Pasteurella multocida
MIDFDGYRPNVGIVICNSKGQVLWAKRYGQNSWQFPQGGINDNESAEQAMYRELFEEVGLSPKDVKILYISKHWLRYKLPKRLLRYDSKPVCIGQKQRWFLLQLVSDEKNINMQSSKSPEFDGWRWVSFWYPVRQVVSFKKEVYRKAMKEFASVLFDGAKENLLSSKSNESDLKTHHTTKKSTFLTKHSKKHFHKSRG

SEQ ID NO: 22837 - protein, 315 aa, Corynebacterium diphtheriae NCTC 13129
MRAIYVQDDATLAVHDAPTPTLQPGEVLVQVKAAGVNRADLLQAAGHYPPPPGESEIIGLECAGVIVDAGTTSRNVGDKVACLLAGGGYAEYVAVPEGQLMPIPEGYSFAEAAAVVEVAATVWSNIGMLTGLKPEHMFLIHGGAGGIGTFAIQLAKHVGATVAVTAGSKEKLETCRELGADILINYREEDFAEVLKNKCDRILDIMGAKYLDQNVRALAMDGHQVTIGMQGGVKGELNIGRLLSKRGTISATALRARDREDKARIVASTVENVWPLLADGTIRHHIHATLPLEQAQRAHEMLKNGEVTGKLVLEV

SEQ ID NO: 22838 - protein, 456 aa, Corynebacterium diphtheriae NCTC 13129
MFAWLQAPGPAAPLSAEQVDRTYPRMRLQVFMGIFLGYAGFYLIRNNISAIAPLLIDESGAIDKPAIGIIGNAVLVSYGLSKFFSAMVSDRSNARYFLPLGLALSALMNLVVAFVPWVSASVGVFATVMFLNGWFQGMGYPPCGRIVVQWFSTSERGWKGSLWNTSHNLGAFGLPVLVGIGLSMTGENWRAAYWLPALVALVVALVAFLLIRDNPQSVGLPPIDDYRNDPAKVAEDTGEKISTKDLVFKHILHSRIIMLLAIANVFVYALRYGVLHWITTYLSEQHHMSIGSGLIGFAAFELAGFIGTVLCGWLSDNVFKGNRSAAISLFTLGAGLSIAAYWLAPVGTPFWLMVIFVAFIGGFIYGPVGLIGLQALDLSPRNVAGTAAGFTGLFGYLLGATLASTGVGFLVKFAGWNVTFIVFLVFTVLILVIFQVIWREEKKLMQERALKLEQGV

SEQ ID NO: 22839 - protein, 2578 aa, Corynebacterium diphtheriae NCTC 13129
MRDSALPRYFRALVAVISAISLVGVGLHATQPTARADEELAPAVVAGTFQKNLGCSKEWEESCDKTRMKRKGNLYATTLKIPEGDWKFKVVLNGDWGTSYGAPGFDENNIPLKLTKDTELEFSFDPLSHRIGLKPVGLDDEKLKTYDDSKDKDIVGAPFKHSAAGKNFYFVLTDRFQNGNPENDRGGAKDGDKNDHGFDPTDKAYYHGGDIEGLIKQLDYIKNLGTTALWLTPSFKNRAVQCGHDPKDCSSGYHGYWITDFTQIDPHLGSNDDLKRLIEEAHNKGIKVYFDIVANHTADLIQLAGGNQYISEDQQKYKDVDGKEFLLKDYAGKKEFPELNDFSFPYKPIRKPEDNIIVPKELNDVHLYHNRGNNTWEGESVIHGDFEGLDDLMTEHPKVVSHMIEAYNKWAGFGLDGFRIDSVKHVNMEFWKEWTEAVKKHAKESRAGEKEDFFMFGEVFNGTAESLSPFVRDTQMDAALDFAFHYKALDFAKGQSTQGLHDLFYSDDWYTTTRSDATNLPTFLGNHDVGRIGYLLRDNDDKVQRDVLAHQLMFLTRGQPVVYYGDEQGFAGTGDGKDKQARQDMFGTQVDEFKNEQDIYGKQLGSDNHFKESGELYGKIKQLAELRTANKALATGAQIERWETPGPGIYAFSRVDRDEKQEYLVALNNSHLEQTATPAPLTPNASFTKIYGEGPDKISPNLDGTVNLKLPRLSAVVYKVESNQKVSGAVDGTGLSVKGQALKDNAPIMTNIGGKAWSETSFAWRELGTEEWKKLGTDTGQNARVFHDVRDLKPGTIVEYRTVTVDADNNKTASTGWGVVGVDLGVDTAALLAPSAVVAGDFTKDLGCTGGDQGNWDPACAKTELKSVGGTDWHTVKLNLKAGEHQYKIAVAGSWNENYGQEKDGDRPNDRGYHNGKNVKFNLDREQEVQFFYNPVTNEFFNSVEHGVITLPGTMGGALNCPKNDQKSDEHGNWGPACLATLMTKTGDHIYEFSSPKVPTPGNYDVKVAYGLEWGNDWGPDGHKTQRNYDVKITDSGILHYRWDENKHELTWNITERSSLDLQDTFAHWLDDRTIAVPRSQLRDASPSDVEGLLVSVSDGKPSIKSGKGASSQADAKIEEQKLHYVGQIGGDLLARNPHLDGMVTFRFKDEVQKDKARELLQGGLGFAVVKKKEQEPVSFTGVQIPGVLDAHYAADARDAQLGVHWKGDKPTVSLWAPTAKNVKLKLFGEEGSLGNGEDHKMDYDKTTGVWSVEGKPDWKNHAYQFEVEVYAPSTHKVEHNLTTDPYSVGLSMDSKYSVMLNLNDPELKPADWGKAMDPIDPVDRMIYELHVRDFSASDKSMDQQYRGKYKAFTQSGSKSVMHLKELADAGLNSVHLLPTNDIATIPEDPAKAKTPAITSTGAADTQQQEAVAAVQKEDAFNWGYDPYHYMAPEGSYATKPDAKTRVKEYREMVKALNGMGLHVVSDQVYNHAFQGQQDEKSVLDKVVPGYYHRLMLDGKIANSTCCANLATEHVMMEKLMTDSVKSWAKNYHIDGFRFDLMGHHSAANMINVQTELSELTVEKDDIDGSSIYLYGEGWNFGEVENNQRFIQATQENLAGTGIGTFNDGLRNGVHGHEGRTQGFGTGLAMEGNGTDQKDQGHLRHLTDIVRVGMAGNLQDFKFNSKDGYKRGGDIWLDGKRIGYGLMPQDTVNYVDAHDNQTLYDLSVLQLPQSLSMDDRVRMNTVQLATVALGQSPAFWHAGTEIMRSKSLDRDSYNSGDHFNKLDLSMQEHNFGVGLPIAEKNDKQWELYKGFLNDEHLKAKPEDLKKANDMAKELMTLRKDNPLMRLGDVDQIQEKVTFPANGPDAQPGLIVMNIDDTKGEDRDAKRDGILIVINSSPKQIEQTINELEGLDFTLEKTLAEGVDKETQKGSTWNKAEKKLTIPARTVAVFERTQNEAAHHDPQYPETKVFKDATEDVKVEGPKDMPETAKYSIDPAVDGVSVDEKTGALTVKPTAIKEDGLVVTVTVKYSDGSEDRAVAKFVTDTSIASMYDPTYEETKAESADKKVTIKKPMSGEKSLPEDAHFTLEGESAKKATIDGFTGEITVEPLKDERRLELDVKVTYADESVDMVKAVVVAGDTLADQHDPKYADTQMEKGTKTVIAAPEGMPENIKYELAEPQDGVTVRDDGSIEVTTDAESLDIKVKVTYSDKSTDTAVAHVTTVAQTEQSVEVTPGTQTLVDVPGNGDVTVTVPQNSGLKAEVAGNLVTLTSDGSVEGHVTVTYQVKDADGKTTTGKINVQVAKLAEASWPKSASVAAGDSTVITPEGVDTLPYGTTLSVGSLPEWATFDQTTGQLTLTADEDATDESTTATITVAYPDGLTKQYSVALSVGAATETTADQHDPQWESVVVNGDSVTSHGVDVPADAEVSVDKLPEGWTATVTGSDVEITPAAGSPAGHVIALPVTVRYADGTTDTAVINVLTQPDWSTSNKAPKADSGMFYQAGPGAPAWVRVNNDGSMTWADNAPEGTHEIPVIVTKDGVHYLVTASVNAPKKVVLDTEGSSSILGVVVAILAAGGIMALFALLFNCTWFKNCR

SEQ ID NO: 22840 - protein, 469 aa, Corynebacterium diphtheriae NCTC 13129
MTEHYDVVVLGAGPGGYVAAIRAAQLGKKVAVVEKQYWGGVCLNVGCIPSKALLKNAEVAHIFNHEAKTFGISGDVSFDFGAAHKRSRQVSSGIVKGVHYLMKKNKITEIDGLGSFKDAKTIEITEGNDAGKVVTFDDCIIATGSVVRSLPGVTIGGNIVSFEEQILKEEAPKSMVIVGAGAIGMEFAYVLVNYGVDITIVEFMDRVLPNEDADVSKEIAKQYKKLGVKLLTGYKTTAITDNGDNVTVEVESKDGSKKDSLTVERCMVSIGFAPRVEGYGLENTGVKLTERGAIEIDDFMRTNVDHIYAIGDVTAKLQLAHVAEAQGVVAAEVIAGAETQELGDYMMMPRATFCNPQVASFGYTEEQAKAKFEGREIKTATFPFSANGKAAGLAETAGFVKIVADAEFGEIVGAHMVGANVSELLPELTLAQRFDLTCEEIGRNVHTHPTLSEAMKEAAEGIMGHMINL

SEQ ID NO: 22841 - protein, 261 aa, Corynebacterium diphtheriae NCTC 13129
MLALLRFVANLTSMTTGKLILLRHGQSEWNASNQFTGWVDVNLTEKGEAEAKRGGELLKAQGVLPSVVYTSLLRRAIRTANIALNAADRHWIPVVRDWRLNERHYGALQGLNKAETKEKYGDEQFMAWRRSYGTPPPELEDSSEFSQANDPRYANLDVVPRTECLKDVVERFVPYFKEEILPRVKNGETVLIAAHGNSLRALVKHLDNISDADIAELNIPTGIPLVYELDEAGTVLNPGGTYLDPEAAAAGAAAVAAQGAK

SEQ ID NO: 22842 - protein, 430 aa, Corynebacterium diphtheriae NCTC 13129
MTSTQRSQELFARAQQFTPGGVNSPVRAFGSVGGHARFIQSAKGSKLYDVDGNEYVDLVCSWGPMLLGNAHPEIVEAVQKAATNGLSFGAPTEAEVKIAEMIVDRTSVEEVRMVNSGTEATMSAVRLARGFTGRPKVIKFDGCYHGHVDALLASAGSGVATFALPDSPGVTGASAADTIVVPYNDSEAVRAAFEAHPDQIACVIAEAAAGNMGTVAPQDNFNAKLKEVAHEHGALLILDEVMTGFRTSYNGWYGVDGVAGDLTTFGKVISGGLPAAAFGGRADIMRYLAPEGPVYQAGTLSGNPVAMAAGMKSLELATPEVYDMVRANADRLAGLLHEALDREGVAHHIQRAATMLSVRFAEGEGHNFDDMKAADTFRFPAFFHALLDNGIYASPSVFETWFVSAALTDDDFDKIEKALRPAAQAAGKAK

SEQ ID NO: 22843 - protein, 238 aa, Corynebacterium diphtheriae NCTC 13129
MTALIAATGVKKSFGKGSQKVTVLKGIDLTILPGESVAIVGKSGSGKSTLLYCLSGLLAPDEGSIYLANQNITATSPRKVAEIRRNHASFIFQDLNLISSLTVADNIRLPSKLAGRNPKKHEIDSVLEKVGLSGAGNKYPNQLSGGQQQRVAIARSLVRSPQILFADEPTGALDVTTSAIILKLLQETVTKRTSLVMVTHDLDIAASADRVVVLKEGNTGQILHHTTPTNIFDAMHKS

SEQ ID NO: 22844 - protein, 432 aa, Corynebacterium diphtheriae NCTC 13129
MSHPPIHGENASSPELEPTPQGANSVLIFSTVSFTMMFAVWLMFGILGTPIQKEFGLSDTQLSWILAVAILNGSMWRLPAGILADKIGGRKVMLGITLFSAVASLGVAFSQNYTMTLVLAFLVGFCGNSFTAGAAWASAWFPKHKQGFALGVFGAGNVGASVTKFIGPVIIASTAGATYFGFIPAGWRLIPIIYSVTLVIVAILMMIYTPKVDRFGSSGRSLAEMLLPLKQVRVWRFSLYYVVVFGAYVALSATLPKYYISNYDVSLAAAGLLTAIFIFPASLLRPVGGWFSDRYGARRAMYGTFFVMGTAAGLLCLPSNIINIFVFTLLIFSLGCAMGVGKAAVYKHIPEYFPHDVGAVGGLVGMLGGLGGFFLPPLFAYTKAWTGWSTSPFIVLLILVAVSALWMHVTVHRMLHSHVPELKHHMEVPATQ

SEQ ID NO: 22845 - protein, 181 aa, Corynebacterium diphtheriae NCTC 13129
MRLVLLGPPGAGKGTQAAILSEKLRIPHISTGDLFRANIGEGTPLGKEAKSYIDAGKLVPTDVTARMVKARLQKDDAEVGFLLDGFPRTVEQAEILKEMLKGFGVELNGVINYEVAEDVVVERMLARGRADDNEDTIRTRLQVYRDETAPLIRHYGDDIITIKAEGSIEDINARTLGALGK

SEQ ID NO: 22846 - protein, 506 aa, Corynebacterium diphtheriae NCTC 13129
MTQQRVSTGGDDPNKVALVGLTFDDVLLLPDASEVIPSEVSTSTQLTRNISLNIPVVSAAMDTVTESRMAIAMAREGGMGILHRNLSIEEQAAHVETVKRSESGMVTDPVTCSPDMSISEVDALCARFRISGIPVVDSEGKLLGICTNRDMRFEQNFDRKVSEVMTPMPLVVAEEGVTKEQALSLLSTNKVEKLPIVDKQGKLVGLITVKDFVKTEQYPNASKDATGRLLVGAGIGVGEESWTRAGSLVDAGVDVLVVDSAHAHSKGVLDMVSRVKQEWGDRVDVIGGNLATRSAAKAMIEAGADAIKVGIGPGSICTTRVVAGVGAPQITAIMEASVPAHAAGVPIIADGGMQFSGDIAKALAAGASTVMLGSMLAGTAEAPGDIVVVGGKQYKRYRGMGSMGAMQGRGLSGEKRSYSKDRYFQADVRSEDKLVPEGIEGRVPFRGSIDAITHQLVGGLRAAMGYTGSATINDLWNARFVQITSAGLKESHPHHIQQTVEAPNYH

SEQ ID NO: 22847 - protein, 438 aa, Corynebacterium diphtheriae NCTC 13129
MPTKYDNSNANKWGFETRSIHAGQSVDSDTSARNLPIYLTSSYVFNDAEHAANRFNLSDAGPVYSRLTNPTVAAVEERLANLEGGVHAVLFASGMAAETAAILNIARAGSHIVSSPRIYGGTETLFAVTLARLGIETTFVENPDDPASWEAAVQDNTVALYGETFANPQADVLDIPAIAEVAHKHQVPLIVDNTLATAALVRPLELGADVVVASLTKFYTGNGSGLGGVLIDGGNFDWTVTRNGEPIFPDFVTPDPAYHGLKYSDLGAPAFGLKARVGLLRDTGAAPSPLNAWITAQGLDTLSLRVQRHNENALAVAQFLANHEKVAKVNYAGLPDSPWYPVKEKLGFDYTGSVLSFDVKGGKNEAWRFIDALKLHSNLANVGDVRSLVVHPATTTHSQSEESALLAAGINQATIRLSVGIESIDDIIADLTAGFDAI

SEQ ID NO: 22848 - protein, 490 aa, Corynebacterium diphtheriae NCTC 13129
MGCLRYTWALDSSNRHTHTGGTVTRIVIIGGGPAGYEAALAGAKYGAEITIIEDRGLGGAAVINDCVPSKSFIAGANIKTDLRRADDMGLNKGIGEAHLLIDALNNRVQALAYEQSSDIRASMDAHGVRVIDGRGSFDDYNPKQTVHYIKVDRADGTTETIECDLVLIATGATPRILPDAQPDGERILTWRQIYGLTELPEHLIVVGSGVTGAEFVSAFAELGVKVTMVASRDRILPHDDADAADVLETVLAERGVALEKHARVDSVIRTEDGGVCVKTSDGREIFGSHALMTVGSVPNTKDLGLEKIGIATTRSGHICVDRVSRTNVAGVYAGGDCTDLFPLASVAAMQGRIAMYHALGEGVKPIRMKTVATAVFTRPEIAAVGVTQKQIESGEVIARTVMLPLQTNPRAKMRSLRHGFVKMFCRKNSGIVIGGVVVAPTASELILPIAVAVTNQLTVSDLAESFAVYPSLSGSITEAARQLVQHDDLQ

SEQ ID NO: 22849 - protein, 495 aa, Corynebacterium diphtheriae NCTC 13129
MASTAPQSQTSAPTASTSQPRSALDRYFKISERGSSVGTEVRAGVVTFFAMAYIIILNPLILGTGEDINGKVLGIPQVAAATALAAGVATIAFGLIARYPFGIAAGLGINTLVAVTMVATEGLSWEEAMGLVVLDGIIIVLLAISGFRAAVFSAIPKPMIAAMSVGIGMFIALIGLVDAGFVRRIPDAAHTTVPVGLGTGGSISSWPTLVFIMGLLICGFMVVRRVRGGLFLGIVVTTIIAMIVEAITGAGSSVDNPTGGWSLAVPTTPGGLGGLPDLSLIGDISLFGAFTRVGALGATLLLFTLVLANFFDAMGTMTALGKQAELVDDSGVLPDMKKALIVEGTGAIIGGAASASSNTVYVDSAAGIADGARTGLANVVTGVLFLLAMFLTPLYEIVPIEAAAPVLVVVGALMIGQVRDIDFTDFHIALPAFLTIVIMPFTYSIANGIGVGFISFTLLAVFAGKIKQIHWIMWLISALFVVYFAMDPILNAIGS

SEQ ID NO: 22850 - protein, 119 aa, Corynebacterium diphtheriae NCTC 13129
MEKPQIQVPEGPAPEDIVIVDLIEGDGAEAQPGGLVEVHYVGVDFENGQEFDSSWDRGQSIEFPLSGLIAGWQEGIPGMKVGGRRQLTIPPEAAYGPAGGGHPLSGRTLVFVIDLLNVG

SEQ ID NO: 22851 - protein, 494 aa, Corynebacterium diphtheriae NCTC 13129
MTHTTQTLDDRIHELLQRIPTELFIAGQFQPAHNGATLSVTNPSDGSELATVASASEKEARAALDAAEKAQPTWAATPARERSEILRRAYDLVIEHKDDLAMIQSLELGRALPDSEAEVTYAAEFFRWFAEEAVRIRGDYRHNPTGNARIITHQQPVGPCLAITPWNFPLAMGARKLAPALAAGCTMILKPASKTPLTMLYLAQLLAEAGVPHGVVSVLPTANASVVSDLLHDARIRKLTFTGSTAVGQKLAAMAAEHSAAVSLELGGNAPYIVLDDADIDTAAQAVAVAKMRGAGQVCIAANRFLVHSSIAEEFTQRVVNIMRGFTQGPATAPGVDFGALSGDDQVSTVTTLVDDALSRGATKLLGDLPKGLPEHGSYYPATVLVDVPEDADIHCEEIFGPVVVISTFDDDDEAVARANDTKFGLAAYVFGSDLQRVLNVAERVDAGMIAVNKGALSDPAAPFGGVKESGLGREGGFEGIGEFLETKLISLPL

SEQ ID NO: 22852 - protein, 425 aa, Corynebacterium diphtheriae NCTC 13129
MADIMHVFAREILDSRGNPTVEAEVFLDDGSHGVAGVPSGASTGVHEAHELRDGGERYLGKGVLNAVNNVNEEIADAIAGAEADDQRLIDQAMIALDGTENKSRLGANAILGVSIAVAKAAAESAGLPLYRYIGGPNAHVLPVPMMNIVNGGAHADSGVDVQEFMIAPIGAESFSEALRMGAEVYHSLKSVIKSKGLSTGLGDEGGFAPSVESTKAALDLIVEAIEKAGFKPGADIALALDVASSEFYKDGKYHFEGGEHTAEEMAKVYEQLIAEYPIVSIEDPLQEDDWEGYTALTAAIGDKVQIVGDDFFVTNPARLKEGIEKKAANALLVKVNQIGTLTETFDAVDLAHRNGYRTMMSHRSGETEDTTIADLAVALGCGQIKTGAPARSERVAKYNQLLRIEQQLDDAAVYAGRSAFPRFQG

SEQ ID NO: 22853 - protein, 366 aa, Corynebacterium diphtheriae NCTC 13129
MMTRLPLGATLPDFPWDSLADAKKTASSHPDGLINLSVGSPVDEVAPGIRLALAEAAAAPGYPQTIGTQELRAAIVDSLQRRYHATSLGGVLPVVGTKEAIALLPTLLGIRGTVVIPEVAYPTYEVGALMAGATPLRCDAPHELPNDDIDLVFINSPSNPTGRVASVEELRSIVAWAQANDVIVASDECYLGLAWDGEAVSILDPRVNDGNLSNLLAIHSLSKSSNLASYRAGFLAGDEALIAELTEIRKHSGLMVPGPIQAAMVEALRDDDQEALQKLRYARRRALLMRALIDAGFTVEHSEAGLYLWATRGENCRATVDWFASHGILVAPGDFYGPDAHNFVRVALTTTDDNAEKVAARLQKGN

SEQ ID NO: 22854 - protein, 470 aa, Corynebacterium diphtheriae NCTC 13129
MTEHTAPTLTKGLKVRHLTMMGLGSTIGAGLFLGTGVGIKAAGPAVLIAYIIAGFIAVMIMRMLGEMGSVVPASGSFSEYADAGIGHWAGFIQGWVYWLATVAVLGAEITGASGFVASWLGVSPWIPALVFVAFFGLVNLMRVRAFGEFEFWFAFIKVAVLVVFLIIGSLLVLGLLPNHDFVGLSNVRAEGFAPTGLGGIAAALLAVAFGFGGIEVVAIASAESEDPQKSLVNAVRTTITRISIFYLGSVAIIVLLLPYSSLGKAKSAAESPFSQVLAMANIPGVVGVIEVVIVLALLSAFNAQIYASSRMMMSLAERRQAPNIFARVDNRGVPLPAIVLSVVLSVIMVILNYVDTGWLLTFLLNAAGASLLTVWTFIAVSQLKLRRRLEALQGNLAVRMWAFPGLTIATLAILFGLAILMLSDAGARIELLSAIAMVAILFAISLIAVKQPFDKALLPREASYPQNSPS

SEQ ID NO: 22855 - protein, 454 aa, Corynebacterium diphtheriae NCTC 13129
MTQATTETELGTGLKTRHLTMMGLGSAIGAGLFLGTGVGIAAAGPAVLIAYVLAGIFVVFVMQMLGELAAARPASGSFSVYAEQAFGHWAGFSLGWLYWFMLTMVLGAEMTGAAAIMGQWFGIAPWIPALICVIFFAVVNLARVSGFGEFEFWFAFIKVAVIILFLVIGVLLIFGLLPNYDFVGTQHFLGDGFMPNGISGVATGLLAVAFAFGGIEIVTIAAAESEDPKTAIATAVRSVIWRISLFYLGSVLVICFLIPFSSIGGAKSAADSPFTIILGMANIPGVVGFMEAVIVLALLSAFNAQIYATSRIVHSFAERGDAPKIFAATNPSGVPMPAVLLSMFFAFVSVGLQYWNPAGLLNFLLNAVGGCLIVIWVIIAFAYLKLHPELVRNGEITTVRMWGFPWLGWVTIAGFLGLTVLMLTDDASRSQITSVTVVFLLLIVVSFFTKKKSK

SEQ ID NO: 22856 - protein, 413 aa, Corynebacterium diphtheriae NCTC 13129
MSKNAANTDSQSSETQWADVIMNTYGTPPLTITGGNGATLTDSVGKTYIDLLAGIAVNSLGHAHPAIVEAVTEQISNFAHVSNLFGSRPVIDTAARLIRRFAEETTDSTQTAHDTRVFFCNSGTEANEAAFKLARMTGKNRILAAQHGFHGRTMGALAMTGQPDKQMPFYPLPAGVEFYPYGDIDYLRKLVQINSTDVAAIILEPIQGETGVIPAPDGFLSAVRGLCNEFDILMIVDEVQTGIGRTGDFFAFQHETGVIPDVVTMAKGLGGGLPIGACLATGKAKDLLGPGKHGTTFGGNPVSCAAAGAVLRTIDDDFLENVQRKSHKLVKRMSRLPLVESIRGRGLMLGVLLSEPVAKECVKLALEHGLIVNAPSASVLRLTPPLVISDAEIHESIERLSIVLTKIKKKECH

SEQ ID NO: 22857 - protein, 431 aa, Corynebacterium diphtheriae NCTC 13129
MENNSFAQFDRDHIWHPYGPMPATVAPYVVAATNNTDIILDNGTRLIDGMSSWWAAAFGHGNERLKAAAHRQIDVMSHVMFGGLTHVPAIKLARQLCELTDEPLTKVFFSDSGSVAVEVALKMVYQYQLGQGHPERRRMLTWRGGYHGDTFATMSLCDPEGGMHAMWEGRVMDNVFASRPPLWGAASNEISAYIDHLDSLIDSTIAGIIVEPVVQGAGGMRFHAPEILKGIRQLCDQHGILFIADEIATGFGRTGNLFATQAAKVTPDILCVGKSLTGGFMSLAATITTDAVAESISSAAGGGALMHGPTFMGNPLACAVASEALSIIAEGDWKQQVAEIESELKKGLVPLASNPAVRDVRVLGAIGVVEMKEPVDMKRATHAAVNAGVWLRPFGRLVYTMPPFVCTHKQIQKISCAIASIVHTEQERFER

SEQ ID NO: 22858 - protein, 484 aa, Corynebacterium diphtheriae NCTC 13129
MTDQTQLAQIGIVGLAVMGSNLARNFAHKGHTVAVFNRSFEKTQALMDQHGDEGNFIPSATIEEFVASLEKPRRAIIMVQAGPATDAVINQLADAMDEGDIIIDGGNALYTDTIRRESEIAQRGLNFVGAGISGGEEGALNGPSIMPGGPDKSWEALGPLLESIAAQVGGTPCVTHIGPDGAGHFVKMVHNGIEYADMQVIGEAYQLLRYATEMQPSEIADVFKTWNQGDLDSYLIEITSEVLAQVDSETGTPLIDLIVDEAGQKGTGRWTVKAALDLGIATTGIGEAVFARALSGATTQRKAAQGNLPAGTLESLASLNIDKDQFVEDVRRALYASKLVAYAQGFDEIIAGSAEHNWDVDPRDLATIWRGGCIIRAKFLNRIVEAYDANPELPSLLLDPYFKTELESLIDSWRRVVVAATQLGLPVPVFASSLSYYDSLRAERLPAALIQGQRDFFGAHTYRRTDKDGSFHTLWSGDRSEVEA

SEQ ID NO: 22859 - protein, 322 aa, Corynebacterium diphtheriae NCTC 13129
MVDSHEKQRGDTGEVTTEDRSSAIAVLVFPVLMIVGAIIAYQTPETFVGFKPYLNPMLMFIMFAMGLTITLPDLKELARRPWSIALGVVCQFIVMPLSAVAISSILGFDQSLTIGLILLGSVPGGTASNVLAYLAKGDVALSVAMTSVSTLVSPFATPLIMLLLAGESAEVNASGMMVILLKTVLIPVGFGLILRFFAQRFVDTVLPVLPWLSIVVIGIVMMTVVAGAHAKLALVGIVVVLGVAIQNLIGFIAGYWSARAVRQPEASCRTASIEVATQNSGLAASMATQFFTPEAALPGAVATIYANISGAIYAAIVRRKAL

SEQ ID NO: 22860 - protein, 260 aa, Corynebacterium diphtheriae NCTC 13129
MARTPLIAGNWKMNLDHLQAVATVQKLAFALPKEYYEKVDVAVTVPFTDLRSVQTLIEGDKLAITYGAQDVSQHEAGAYTGEISAQMLAKLGCTWVVVGHSERREYHGESSELVAVKAKAALNQGISPIVCVGEPLEIREAGTHVEYVVEQTRASLAGLTADDLAKTVIAYEPVWAIGTGKVASAADAQEVCAAIRNLIIELAGKEVAEGLRILYGGSVKAETVAEIVGQPDVDGGLVGGASLDGEAFAKLAANAATVVD

SEQ ID NO: 22861 - protein, 405 aa, Corynebacterium diphtheriae NCTC 13129
MAIKTLKDLLAEGVEGRHVLVRSDFNVPLNDDREITDAGRITASLPTIKALVDNGARVILMAHLGRPKGEVNEKFSLAPVAEALSEALGQYVALAGDVVGEDAHERANGLNDGDVLLLENVRFDPRETSKEEAERGEFADQLVALTAENGAFVSDGFGVVHRAQASVFDVAQRLPHYAGTLVEKELEVLGNKVASAPERPYAVILGGAKVSDKLGVIEALATKADKLIIGGGMCYTFLAAKGINVQKSLLQEEQINKCKELLEAYADKIVLPVDLVAAAEFASDAENKIVAIDEIPEGWMSLDVGPKTVEKFAEVLATSKTVFWNGPMGVFEFENFSAGTRGVAEAIIAATANGAFSVVGGGDSAAAVRLLGLDEDGFSHISTGGGASLELLEGKNLPGVSVLES

SEQ ID NO: 22862 - protein, 224 aa, Corynebacterium diphtheriae NCTC 13129
MTQTRQCPIIAPSILAADFRKLEEEIQSVNHADWIHVDVMDGHFVPNLSFGADITCAARLSTSQPLDVHLMIENPENWVDSYIKAGAFTVIFHVEATDNPVDLARHIREQGARAGFSLKPSTPIDPYLDMLEEFDEVLIMSVEPGFGGQKFMPEQLEKVRQLRRIIDERNLDVTIEIDGGISESTIRQAAEAGCDAFVAGSAVFGSDDRNAAIDALRERARSRA

SEQ ID NO: 22863 - protein, 248 aa, Corynebacterium diphtheriae NCTC 13129
MAIKVGVLGAQGRVGQAIVAGVTAAYDLELVAEVDRGDSLDVLVQSGAEVIVDFTTPDSVMDNLEFCISHGIHCVVGTTGFTPERLEIVKKWAEEKGNTGVLIAPNFAISAVLTMAFARQAARFFDSAEVVECHHPNKLDAPSGTAIHTAEGIAQARREAGMPTQPDATEQSLDGARGADVGGVKVHAVRMTGMVAHEEVIFGGPGQSLTIRQDSYDRTSFVPGVLVGVRNVAQHLGLTVGLEHYLDI

SEQ ID NO: 22864 - protein, 463 aa, Corynebacterium diphtheriae NCTC 13129
MNNQQPRHYDLIIVGSGSGNSIPGPEFDDKSIAIVEKGKFGGTCLNVGCIPTKMFVYASEIAQVIVDSERFGISASIDSVQWPDIVERVFAHRIDPIAASGEEYRRGDKTPNIDVYDQHARFIAPKTLQIGDGENAPIISGDTIVIATGSRPFIPSYIEESKVTYYTNETIMRMPDLPRSMVVLGGGYIAMEFAHVFSALGVNVTVVNRSPQLLRVLDEDISHRFTEITKTKMDCRLGRTVSSVDQDSNGVTLTLDDGSTATGEVLLVATGRIPNGDQMNLDSAGIDMDGKRIKVDDFGRTTADGVWALGDVSSPYQLKHVANAEMRAVKHNLLHPEDLKSMPHQHVPAGVFTHPQIATVGLTEQEARDAGYSITVKIQNYGDVAYGWAMEDTQHFAKLIADKKTGRLLGAHFIGPQASTLIQQLITVMAFDLDVREVATKQYWIHPALPELTENALLGLDFS

SEQ ID NO: 22865 - protein, 473 aa, Corynebacterium diphtheriae NCTC 13129
MERRTKIVCTLGPAVASREGILGLVKAGMNVARMNMSHGDHADHEKNYQWVREATDETGRAVGILADLQGPKIRLGRFIDGATVWENGEIVRITVDDIEGTHDRVSTTYKNLAKDAKPGDRLLVDDGKVALRCVEVDGNDVVCEVVEGGPVSNNKGVSLPGMDISVPALSEKDIADLRFALNLGVDIIALSFVRSPADVELVHAIMDEEGRRCPVIAKLEKPEAMDALESIVLAFDGIMIARGDLGVECPLEQVPLFQKRAIQIARENAKPVIVATQMLDSMIENLRPTRAEASDVANAVLDGADAVMLSGETSVGIDPANVVRTMSRIVSYAEIDGRVPNLAHIPRTKRGVISYSARDIAERLNAKALVAFTSSGDTAKRVARLHSQLPLLVFTPHQEVRSQLALTWGVETFLTDEVKDTDEMMRTIDEQLLALDTYSEDDMIVLVAGTPPGVQGNTNMIHVHHLGEDLNGL

SEQ ID NO: 22866 - protein, 116 aa, Corynebacterium diphtheriae NCTC 13129
MDDPASYELDPSIAQRVKFNSAGLVPAVVQSTDGEVLMLAWMDAHALAYTIATRKGTYFSRSRNEYWIKGLTSGHTQQVTGLQLDCDGDTVLMTVVQQGGACHTGDRTCFDADVII

SEQ ID NO: 22867 - protein, 478 aa, Corynebacterium diphtheriae NCTC 13129
MAFTSTEDVIKYIKEENVEFLDIRFTDVPGREQRITIPASMFTEEAAEDGFAFDGSSIRGFTTIDESDMNLHPDIATAMVDPFRKAKTLNMKFFVHDPFTREPFSRDPRNVARKAEQYLASTGIADTCFFGAEAEFYVFDKVSYEIEGNRSHYEVDSDNGWWNRGVDQNLDGTHNRGYKTPFKGGYGQCAPYDTLEDLRDEMTLTLRDAGFDIERQHPECGTGSQQEINYRFNTLLHAADDLQTFKYIIKNTAFRNGKTATFMPKPLAGDNGSGMHAHQSLWKDGKPLFHDEVGYAGLSDMARYYIGGILHHAGAVLAFTNPTLNSYHRLVPGFEAPINLVYSQRNRSAAIRIPITGSNPKAKRIEFRAPDPSGNPYFGFAAMMLAGLDGIKNRIEPHAPVDKDLYELPPEEAASIPQAPTSLEASLKALEEDNEFLTDGDVFTDDLIDAYIKLKYDNEIAPVRLRPTPQEFEMYFDC

SEQ ID NO: 22868 - protein, 446 aa, Corynebacterium diphtheriae NCTC 13129
MNSQQEFVLQEIEERDVRFVRLWFTDILGFLKSVAVAPSELESAFEEGIGFDGSAIEGFSRISEADTIALPDPSTFKMLPSLNSDPTMRSARMFCDILNPDGQASNSDPRQVLHKQVQLAADEGFHCVVSPEIEFFLVQNLRTNGLPPVPTDNGGYFDQASQNDAPMFRREAMLALDRMGIPVEFSHHETAPGQQEIDLRHADVLTMADSIITFKHLMKQVAIDNNIGATFMPKPFRDHAGSAMHTHMSLFEGDINAFHDPDDEYGLSVTAKRFIAGIIHHANEISAVTNQWTNSYKRILFGNEAPTAATWGASNRSALIRVPTYRLAKAESRRVEVRSPDSACNPYLAFSVLLGAGLKGIREGYEIPDAAEEDISSLTRRERLAMGYKDLPTSLDQALREMERSELVADILGEHVFEYFLRNKWREWHDYQQQITPWELRNNLDN

SEQ ID NO: 22869 - protein, 437 aa, Corynebacterium diphtheriae NCTC 13129
MTHNQSTALLTDMYELTMLQSALADGTAERQCTFEVFGRRLPNERRYGVVAGTPRVLEAVQNFRFTEAQLASLTFLNDTTLEYLRNYRFAGHIDGYREGELYFPHSPILTVRGTFAECVILETVILSIMNADSAVATAAARMVTAADGRTIIEMGSRRTHEYAAVTATRAAYLAGFSATSNLEAVHRYGIPGSGTAAHAWTLLHVNEDGTPNEKSAFESQVRAQGTGTTLLIDTYDIAQGVRNAIEVAGPELGAVRIDSGDLGVMTRKIRQELDNLGAHNTQIVVSSDLDEYAIAGLRGNPVDVFGVGTSVVTGSGAPTAGMVYKLVEVDGNPVSKRSRGKGMLGGAKRAARTHRASGTAVEELVFPYEHPVPQVGTLTSVELTIPLMRDGVVVEGLPTLEESRAYLAQQLVTIPWEGLALSRDEPVLATRHVGFDQ

SEQ ID NO: 22870 - protein, 311 aa, Corynebacterium diphtheriae NCTC 13129
MAKIYDSILDTVGNTPLIKLNRLDKYLPGNVVVKVEFFNPANSVKDRIGKAIVDAAEASGDLKPGGTIVEATSGNTGIALALVGAARGYNVVLTMPETMSLERRVMLRAYGAEIVLTSGAAGMQGAVDKANEIVAERDNAILASQFKNAANPEIHRRTTGEEIWNDTDGQVDIFVAGVGTGGTVTGAGETLKKHNPEIKVYAVEPAASALLTTGKAGPHKIQGLGANFIPSVLNQKVYEEVITVTNEDAISTSRQLAAQEGILGGISAGANLKAALELAALPENEGKTIVTVVPDYGERYVSTVLFDDIRD

SEQ ID NO: 22871 - protein, 156 aa, Corynebacterium diphtheriae NCTC 13129
MSILDTEVTLINGEKASMDQWAGHCLLIVNTASECGYTPQLETLEELYEDYAMRGFFVIGVPCNQFGEEEPGKDAQVARRYEEKFGVRFPLLAKSDVNGPNTIELYKKLKGDGPDIEWNFEKFIVAPSGEVVGRFAPSLDPDDMKIINVLEEYLPI

SEQ ID NO: 22872 - protein, 463 aa, Corynebacterium diphtheriae NCTC 13129
MAKKARSSHICSECGYTSPKWLGRCPDCGAWGTFQEHQVTTSSAAPSVSAKPIGLTPTSPAQSITRIDATRSSTQSTGIGELDRVLGSGIVPGSVVLLAGEPGVGKSTLLLEVASKWAQQKQGSSNRTALYITAEESAGQVRMRAERTGALQDSLYLAAESNLDIVFGHVEQIKPSLLIIDSVQTMQASGVEGVAGGVAQSRAVTAAITSLAKTTGIPCLLVGHVTKDGNVAGPRVLEHLVDVVLNFEGDRHSSLRMLRGIKNRFGATDEVGCFEQHSDGIREVPDPSGLFLSHHGSTPDGTAVTVAMDGVRPIVAEVQALVVPTEAKNPRRAVTGLDPTRVPMVLAVLAARAGKRTHSSEVYVATVGGMKVGEPATDLAIALATASALNKKAIAEKTVVLGEVGLAGEIRRVPNIQRRLMEAQRLGYKRAIIPVSDPSETKVAGIKVIQVSDIREALDVAVG

SEQ ID NO: 22873 - protein, 187 aa, Corynebacterium diphtheriae NCTC 13129
MPANPYGNDVKEVLITEDQLQNRIQELADLVSEKYRDEKEDLVLICVLKGAVFFLTDFARKLSIPCQIEFMSVSSYGNSASSSGVVRILKDLDRDVAGCNVVIVEDIIDSGLTLKWLIKNLSGRKPKSLEIVTLLRKPEAVKTTIDCLDIGFDLPNEFVIGYGLDFAEKYRDLPFVASLNENVYTEQ

SEQ ID NO: 22874 - protein, 360 aa, Corynebacterium diphtheriae NCTC 13129
MTTLFESATAGVLELNNRITMAPLTRSRAGQDGVPTDMHVEYYKQRANNGLIVTEGTFFEDINRAFLGQPGIATADQQEGWRKVAQAVHEQGSNIVMQIMHGGRLTLPSINGFDQGESSSAIAPGVTLHGDGESREEVPTPVALDAEGIKRVIQKFTEGARRAIDAGMDGVEVHGANGYLLHQFLAPSSNDRTDEYGGSPENRARLTIEVIRSIADEIGADRVGLRISPMHNIQGCIEEDEDDVRATYKALLDGIADLNIAYLSILYQDAESDLVAYLRESFGGFTILNTGFGAVTELEDARYIVENGLADAVAVGREIIANPDLSYRWKNNLALNSIDFDTFYTPGPRGYIDYPMVDEG

SEQ ID NO: 22875 - protein, 452 aa, Corynebacterium diphtheriae NCTC 13129
MTEPLRVAVIGSGPAGIYASDLLTKNNPTTTVDLYERMPAPFGLIRYGVAPDHPRIKGIITSLHKVLSNPNIRLIGNVTIGTDLTIDDLRHHYDAIILATGATADRNLTIPGAELEGSHGAAEFVGFYDGNPDFQRTWDLTATDVAVIGVGNVGLDVARILAKTADELHTTEIPDNVYHTLKNNQATTIHVFGRRGPAQVKFSPLELKELDHSPTIEVIVDPEDIDYDDTSITTRRQSKSQDLVCQTLENYAMREPKGAPHKLHIHLFESPVEILGTNGHVTALRTERTEYDGNGGIRGTGKYTDWPIQAVYRAVGYRSEPINDVPFDTTNHVIYNDGGHVTTQDGTIIPGLYTTGWIKRGPVGLIGNTKSDAKETTEMLINDWETGQLTPADNRDPNAIFDVLKQRGIPVTTWDGWHALDAAERELGQAEGRERKKIVEWNDMLQHAAKKD

SEQ ID NO: 22876 - protein, 346 aa, Corynebacterium diphtheriae NCTC 13129
MSATEFPSAFTAAVVDKFGSELNIHDVDLPEPGQHQALVKVLTSGICHTDLHAAEGDWPVKPKPPFVPGHEGVGEVVKLGPGEHSVALGDMVGNVWLWSACGECEYCRTGWETMCEKAEYGGYTVDGSFGQYMLVDTRYCARIPDGCDLLEVAPILCAGVTVYKGLKVTETRPGQFVVISGVGGLGHIAVQYAVAMGMRVIAVDIADDKLELAKKHGAEFVVNAREEDPTEAIVKYTKGGAHGVLVTAVHPQAFGQAIGMARKNGTIVFNGLPPGEFPAPIFDIVFKGLTIRGSLVGTRQDLEEALDFYARGMIKPTVTECKLDDVNSVFADMKQGKIDGRMAIRY

SEQ ID NO: 22877 - protein, 506 aa, Corynebacterium diphtheriae NCTC 13129
MTVYAYPGTPGAVANYKKRYDNYIGGQWVPPVGGEYLDNITPVTGEVFCQVARGTAADVEKALDAAHDAAKTWGHSSPAERALILHRIADRMEEHLEEIAVAETWDNGKAVRETLAADIPLAIDHFRYFAGAIRAQESRTSQIDHNTVAYHFHEPIGVVGQIIPWNFPLLMAAWKIAPALAAGNTIVLKPAEQTPASILFWIDIVGDLLPDGVLNIVNGLGEEAGVALSSSNRIGKIAFTGSTQVGKIINRAAADKIIPVTLELGGKSPSIFFADIMDYDDPFREKCIEGLAMFALNQGEVCTCPSRALVHESIADEFLELGVQRVKNIKLGNPLDTETMMGAQASMEQMDKISGYLDIGPKEGAEVLTGGHVNKIDGLENGYYIEPTVFKGTNDMTIFREEIFGPVLSVATFKDFDEAIRIANDTNYGLGAGVWTRHQNTAYRAGRAIQAGRVWVNQYHNYPAHAAFGGYKESGIGRENHLMMLDHYQQTKNLLVSYDENPTGLF

SEQ ID NO: 22878 - protein, 390 aa, Corynebacterium diphtheriae NCTC 13129
MAAKNEWAEKDYYADLGVSSSATEAEIKKAYRKLARENHPDSHPGDAAAEERFKKVAEAYDVVGDETKRKEYDEFRSMIASGGFGGAGFPGGFRTQEGFDFDLGDIFGSGAGRGHAPQGGFGDIFGGIFNRGGGARNAARPTRGSDVETEITLEFREAAKGTTIPLQLTGDAPCHTCHGSGSRSGAPTTCTECNGTGFTSENKGAFGFSAPCTQCGGTGKMISDPCPDCSGTGTQRRTRSITVRIPAGVVDGQKVRLAGQGEAGPNGLPAGDLYVTVHVKNDRVFTRSGDDLEVTVPVSYAELALGDTISVPTLDLPVRVRIPSGTPNGRVLRVRGKGVPKRGGSAGDLLVKVEVTVPSSLDAASASALRAYVQAERDAGFDPRAGWAGK

SEQ ID NO: 22879 - protein, 284 aa, Corynebacterium diphtheriae NCTC 13129
MWKFATRLGLESVDTIAATNPREAIAAVAAGQADYACVAIENSVDGPVTPTFDALATIDGVRIFHELDLPIAFAIMQRTGAPLRRFATHPVAYQQVKTWLAANAPAAEFVPASSNAEAARMAKENIVDFAAAPARAAEVYGLDIIADGVADVTGARTRFVLVGHADTPTARTGHDRTSVVFTLKNEPGSLVGALSEFAMRGVDLTRIESRPIEEGLGTYRFHVDINGHIDDLNVAEALRALYPRCNALKFIGSWPAISGQPVTAVDPTVAQAASAWVEAARNGA

SEQ ID NO: 22880 - protein, 469 aa, Corynebacterium diphtheriae NCTC 13129
MFSVFDLKKIPNKGIPLEQQRKMWLGQFLKAFFVVFFVYMSMYFIRNNFKAAQPMLKEDFGLTTLQLGYIGLAFSITYGIGKTLVGYFVDGHNSKRIISTLLICASTMVLLMGLLLSYFGSVIGIFIVLWGLNGLFQSAGGPASYSTISRWAPRTKRGKYLGLWNASHNVGGALAGGLALWGANVFFGGNVVGMFIFPALIGLTIGIIGLFVGKDDPEELGWNRSEEIFGEAVEAENSQAETMPQREIFLNYVLKNPWLWTLCIANVFVYIVRIGIDNWAPLYVTEELHFDKGDAVNTIFYFEIGALVASLLWGYVSDLLKGRRAIVAIGCLFMIYFAVMLYRNASSVTMVNLSLFILGALIFGPQLLIGVSLVGFVPKRAISVANGMTGTFGYLFGDSMAKVGLAAIADPEQKGLTVFGHLLHGWGAVFTVFYFALTIGIVLLMIVAVGEERRIRKLQAAEAVGKALA

SEQ ID NO: 22881 - protein, 441 aa, Corynebacterium diphtheriae NCTC 13129
MLDAQQSPPLTRNQRLDRLPLNSQHKRLLVGSGLGWALDAMDVGLISFVMAALIKHWGLTHGQTSVLASAGFVGMAIGATFGGLLADKWGRRNVFALTLLVYGLATGASALAGGLAVLIVLRFIVGLGLGAELPVASTLVSEFAPLRHRGRLVVILEAFWAVGWILAAIIGAFVVSASDSGWRWALVLGCVPALYSAYVRSSLPESVRFLEARGRHDEAEAAVQQFEKASATIPDTPVIATEDPADQADSIFAPNMRRRTFGLWTVWFCINLSYYGAFIWIPSLLVADGFSLVKSFQFTLIITLAQFPGYALAAWLIEIWGRRTTLAVFLLGSAGSAALYGFADTTALIIAAGCCLSFFNLGAWGALYAISPELYPSQIRGTGTGSAAGFGRIASIIAPLIVPPIVAAAGTPALFALFGAAFLAAAIAAFTLPEQRGKALV

SEQ ID NO: 22882 - protein, 502 aa, Corynebacterium diphtheriae NCTC 13129
MFAYSTEAIRLSENPMIAAAQPDALMKQAAQAVAEAAVCMVPSASAAITVVAGTGGNGGDGLYAGAILAQLGYRVHAVLTGESAHAPALSAFVQAGGCVDKRAPRADLVIDAILGLGGTLGLRDAAWQIWQAATAGDPLILAVDVPSGIAADTGTAGEQHVVADATITFGAARIAHAVSAECGEVLIADINVPEAGGSLAAAIASHTPELQLYHAIERERYPWPEHFRRPEQLLIHESLEPSASHNKYSGGVVGVVAGSAHYPGAAVLTATAAVRATSSMVRYAGPCAREVVRACPEVVATDTLIDAGRVQAWAYGPGAGDTDALGDLLEREEPLVIDADGITQLAQEPALRELMHARNKSGRSTLLTPHEGEFWRLASCYGDAIPADDRVAAVRYLARETGCALLLKGRITTICVADTVTCVDARNSWAATPGSGDVLTGLLGAWIARNGLGSIALCVAVHATAAWLSAHTEYGLAPTSALRIANTIPQATALLSQGKKLR

SEQ ID NO: 22883 - protein, 463 aa, Corynebacterium diphtheriae NCTC 13129
MAYATTNPYTGEVVKEFPTATAQEVEQAITRAHDTFTQWSRKPVAERVEVLARAADILETKKREYAEIITLEMGKLIAEAEAEIDICVDMLRYYVANGEAQLAPRYLPAKGFGEHDVQLVNEPLGVLYAVEPWNFPYYQVIRIGAPQFTAGNTIVLKHASNVPQSALKMVELFREAGAPEGLLVNIFADHNATETILSDPRVRGVALTGSEGAGAAVSATASKYLKKSTLELGGADAFIVLNDAELDKAVDWAVFGRHWNAGQVCCSSKRIIVEDSLYDAFLTQYTQKVAALTAGDPMDPNTQLAPLSSQTAADDLGKLVDKARAEGATVTEVGIDLPEHGAFYQPTILTDIPLDSDTAHSEFFGPVSQIYRARDIDHAVEIANSSPFGLGGSVFSQDEAKAKDIARRLDTGMVYINQPTGVKADIPFGGTKRSGFGRELIDLGLHEFVNQKVVVVTDIDGSF

SEQ ID NO: 22884 - protein, 278 aa, Corynebacterium diphtheriae NCTC 13129
MTRYTKLFSALSAKNEGAFVPFIMLGAPTPEASLAIIRTVVAAGADALELGVPFSDPVADGPTIQRSHLRALDNGATVDSSLELIRQIRKEFPELPIGMLIYGNVAFTRGITQFYQEFADAGVDSILLPDVPVREGEPFIAAAKQAGIDPIFIAPAQASEATLEGVAQHSSGYIYAISRDGVTGTERQSSTRGLDKVVANVKRFGGAPILLGFGISTPEHVRDAIAAGASGAITGSALTSIIERHTTGTHPEPAQVTDLEALTEEIFAFVKDMKAATR

SEQ ID NO: 22885 - protein, 112 aa, Malassezia pachydermatis
MGVTVESISNGDGKTFPKAGDTVDMHYVGTLQSNGNKFDSSRDRGQPFRTRIGVGQVIRGWDEGVPQLSLGQKARLICTPDYAYGARGFPPVIPPNSTLVFEVELLAINGKQ

SEQ ID NO: 22886 - protein, 400 aa, Pseudomonas syringae pv. syringae
MNDALAQLQSYPFEKLRTLLNGVTPNASLRPIALSIGEPKHPSPAFVKTALAANLDKMSVYPATLGIPELRAAIADWCQQRFDVPKGWLDPARHILPVNGTREALFAFTQTVVRRDSNGLVISPNPFYKIYEGAAILAGATPHYLPCLESHGFNPDFDSVPADIWKRCQLLFLCSPGNPTGALVPLDALKKLISLADEHDFVIAADECYSEIYFDETSPPPGLLTACAELGRSDFKRCVVFHSLSKRSNLPGLRSGFVAGDADILKAFLLYRTYHGCAMPVHSQLASICAWKDEDHVRENRDLYREKFDAVLAILSPVMDVKKPDGSFYLWAKVPMDDAEFCRELFEQTHITVIPGSYLSREVDGVNPGAERIRMALVAPLAECVEAAERIRDFLLQRRL

SEQ ID NO: 22887 - protein, 139 aa, Brucella melitensis biovar Suis
MSIFPAQPSDKKAVEEGAAFMPRFDASGLITAIVTDARDGELLMVAHMNEEALRLTLETGIAHYWSRSRKTLWKKGETSGNLQSVVELRTDCDQDALWLKVHVAGDGPTCHTGRRSCFYRQVVSSGGKVALTMVSDHDQ

SEQ ID NO: 22888 - protein, 138 aa, Ricinus communis
MAEHQQSPVVSHRPRVNQLVKAGTAATAGSSLLFLSGLTLTGTVIALALATPLMVLFSPVLLPAVIIISLIGAGFLTSGGFGFGAILVLSWIYRYVTGKQPPGAESLDQARLKLAGKAREMKDRAEQFGQHVTGQQTS

SEQ ID NO: 22889 - protein, 163 aa, Sisymbrium irio
MSPLSWPFKIVKMLFKKKKREKRPPKPTFKGVLTAFFATAAAIFLLLLAGLSLAGTAVAFIATMPLFVVFSPVLVPAGITTGLLATGLAAGGGSGVTALTIFMWLYKAITGKEPPKIPGLTPAAGAPADKPADKPAEPAKPAAKPAAKPAAKPAAKQAAKPSK

SEQ ID NO: 22890 - protein, 151 aa, Arabidopsis arenosa
MAPFPLSLIFGKNKRPRDDIRYRQKPTLKGVMTAFLATQAAIFLLLLAGLSLTGTVVALFASMPVFLVLSPVLVPAGITTTILASCLMAGGTSGVTGLTILMWLYKQFTGKDLPKIPGLNPGGGAAAGGAAPAPAAPAAKPAAKPAAKPGG

SEQ ID NO: 22891 - protein, 461 aa, Capsella rubella
MSEELNQNPSSAHQSLSMREGRKFPFLSLPQNPSSAQSLSMREGRKFPFLSLPQNPSSAQSLSQKQSSAENLSEREGRKLSFLHMFSFLMPLLEVIKIIIASVASVIFLGFACVTLAGSAVALVISTPLFIIFSPVLVPATLATAVLTTGFTAGGTFGATAIGLIMWLIKRRMGVKPKDNPPPGGLPPTGGGGALSLTFKSKKKAKPKLKSKISKDKLKLPEWCKKIPVLGKMAGGKGKSGSEESSSSSSGDEGMSGGRGGKSKSKLGHKSEDKKCKKSKSKSKKGMSGGMSGGMSGSEGGMSSGSEGMSGSGGGKSKGGGRKSGGLGGKSGKIKSKSGKKGGMSGSEGGMSGSEGGMSGGSMSGGSMSGGSMSGGSMSGGRGGSMSGGRGGKSKSRGHKSGGLKSKSSKKGMSGSEGSMSGSEGSMSGSGGSKHGGGGCKSKGKHGSGGMSGGRGSFVEE

SEQ ID NO: 22892 - protein, 172 aa, Capsella rubella
MSILKLLFGKKKRERVVVRTQRPTIKGVMTSVLATQAAIFLLLLAGLSLTGCAVASVACMPLFLLFSPVLVPAGITATVLASGFMAGGGSGVTALTIFMWLYKRFTGKDPPKIPGLTPAGGAASGGAASGGSAPAEGGDAGGGAAPAAKKSASKKSAAKKPAAKKPAAKAGK

SEQ ID NO: 22893 - protein, 180 aa, Capsella rubella
MLFRKKKREKVIVRTKRPTLKGLMTAFFATTAAVFLLLLAGLSLVGTAVAASMPLFLLFSPILVPAGITATVLASGLMVGGTSGVTVLTILIWLYNDTSGGTSPVGAAPVGTTSGGAAPPIGDIPFGDASGGAAPAGGAIPDEPTTKPTAKATSKSAIKPISKPKTKPTSKPTSKPKKNQ

SEQ ID NO: 22894 - protein, 490 aa, Olimarabidopsis pumila
MSEELSQKPSSAQSLLQKPSSAQSLSQKPSSAQSLSQREGRMFPFKYLSQREGRMFQSLSEREGKKSSFLSMFSFLMPLLEVIKIIIASVASVVFLGFACVTLAGSAAALAVSTPIFIIFSPVLVPATVATVVLATGFTAGGSFGATALGLILWLVKRRMGVKPKDNPPPAGLPPNSGAGAGAGGASAPQTLIAKSKSKSKSKGGLKLPAWCKKIPVLGKLGGKKSGSEGGKSGDEGGMSSSGDEGMSGGGGGKSKGKGRLLGGRKGKSKKKGGMSGGEEGMSSGSEGMSGGGGRKSKGGGRKSKGLGGKSGSKGGMSGGGGGMSGSEGGMSGSEGGMSGGGMSGGSMSGGGGHKSKGGGHKSGGLRGKSGSKKGMSGSEGGMSGSEGGMSGGGGGKSKGGHKSRGLRGKFKSKKGMSGSEGGMSGSEGGMSGGGGGKHGGKHGGGGMSGSEGGMSGGEGGKHGGGGGKHGGKHGGGGMSGGGGRFVEEE

SEQ ID NO: 22895 - protein, 148 aa, Olimarabidopsis pumila
MVFLKLLFRKKKREKVVQRQRPTLKGVMTAFFATTAAVFLLLLAGLSLTGTAVAFIASMPLFLVFSPVLVPAGITTTVLASGLMAGGTSGMTGLTIFMWLYKRFTGRDPPSIPGLIPPGGAAAAAGGGAAPAAGGAAPAAKPAAKTGK

SEQ ID NO: 22896 - protein, 158 aa, Arabidopsis arenosa
MAPFPLSLILGKKKRPRDDIRYRQKPTLKGVMTAFFATQAAIFLLLLAGLSLTGTAVALIASMPVFLVLSPVLVPAGITTTILASCLMAGGTSGVTGLTILMWLYKQFTGKDLPKIPGLNPGGGAAAGGAAPAPAAPAAPAAKPAAKPAAKPAAKPGG

SEQ ID NO: 22897 - protein, 174 aa, Populus nigra
MSRDRDPLSVGRVIGDVLDPFTKSISLRVTYSSREVNNGCELKPSQVANQPRVDIGGEDLRTFYTLVMVDPDAPSPSDPSLREYLHWLVTDIPATTGASFGHETVCYESPRPTMGIHRFVFVLFRQLGRQTVYAPGWRQNFNTRDFAEVYNLGSPVAAVYFNCQRESGSGGRRR

SEQ ID NO: 22898 - protein, 1737 aa, Streptomyces diastaticus
MVPVHTADYVIQPPTDAAEVRGGHTLPEVFETASRAAPDAVAIVDGDRSRTWAQWRADVRALARGLQESGVGPGDVVAVRLPNSWEFQTLHLAVAAVGAVLLPVHEGTPTAEVHALLTRAEPVLLVLSASGSEGTATARSLLESVPTLRGVLLAGASEAECEEPGIGALDGLRAAWTGSEPRPVHLTPDMPLALIPSSGTTSARPKLCVHTHGGLLANTAAVVADAADAFGGTVLTACPMTHLFGLQSLHTALFAARTQVLLTGWDVDRFLELAREHNPRVVFAVPAQLRDIVARLARAGEPAGFAPHQVRTAGAALAPALAAQIRAALDCEPVVVWGMSEIGTGTATRAHHPDGSVGEPVDGVRVRVVDEHGAECAAGETGELQYQGPAMFRGYFREPELTRSALTDDGWLRTGDIAAIDADGVVVLHGRAAEVIATGGRKFGATEIESLLAELAGLGPLAVAGAPDDRLGEYPCLVVTDRADRTIGLTEVTAFLRRRGLADHKIPLELVTVRELPFTPAGKLDRRALKEQLRTGLEATPVAARLGAVPPETAEEALELVRDCVGQVLGSSGDPAGPAVGAPEFPDTEFRRLGLDSVLAVRLRNLLREETGLSLPVTLAFDFPTPRAVAHALAEQNDPASAAASGKTAEEARRFPADEADPVAIVAMACRLPGGADSPDALWELLAGGTDAMRPFPDDRGWDLDRLFDEDPDRPGTCYAREGGFLPGAGDFDAGFFGLSDHEATATDPQQRLLLVAAWETFERAGIDPASLKGTRTGVFTGAMERGYGALASAVPSEWESTLTTGAANSAISGRIAYTYGLEGPALTVDTASSSSLVALHLACRSLRSGETDLALAGGVTVMATPAPFTHFARLRALATDSRAKAYADTANGSAWAEGAGLLLLERLSDARRNGHRVLALVRGSAVNQDGASNGLTAPSGPAQQRVIRQALADAGLTPRDVDAVEGHGTGTPLGDPIEAQALMATYGQERPEGRPLWLGSVKSNLGHTQAAAGVVGVIKTVLALGRGVLPRTLHVETPSTKVDWSAGAVRLLTEAQPWPQESGHTRRAGVSSFGLTGTNAHVILEEAPDGTQSAPGSEPADDTAVPWVLSARSRTALREQARRLAEHVTAHPGLRTQDIAHALATTRTRHRHRAVVSGSDRDRMLSATAAFGRGERAADVTPLDSAPGGLAFVFSGQGGQHPGMGRGAAEAFPVFGEALREVCDTLDPLLARPLTSVMWADADSEEATLLHNAEFSQPSLFALQVALYRLYESWGMAPDRLAGHSAGEIAAAHVTGILTLQDACALVASRGRLISSLPVGGATVAVRISEDEVRGWLAEETTGSVSIAAVNGPHSLVLSGAEAPLIALTDRLRDAGHKTHRIPMRVAAHSPLMDPILGEFRAVVRTLAYGTPTIPLVSTVTGRPLTDEEARDPEHWVRHVRRPVRFKDAIGRLREERVTGFLELGAEPLLTPMIDECLEAAGPQHGTAVVPSLSSGVPDRQILLSAAARVHTHGAPVDWDAVLPGARPVDLPTYAFQRRRFWLAAGPGAAAEAGFVGAAIGAGAPAADAEEPSGLEARLAGLEDAEQDAYVRSLVLAETSAVLGGQEPLDSEGTHTFKEMGINSVNAVELRNRLIAATDLRLPATLVYDHPTPNAVVRLVRERLARPATAARDVDSVVAELESLLTAGAEVSAEAVARLKAMAAGRDGTTDTGSGGPLDLTSASDEDLFRLMDAEH

SEQ ID NO: 22899 - protein, 261 aa, Photorhabdus temperata
MTEKKLETSLVNAGRSRKFTQGAVNPIIQRTSSVIFDSVASKRQATHNRANGELFYGRRGTQTHFSFQEAMAELEGGAGCTLYPSGAAAISNAILSFAAAGDHILLTGSAYDPTQGFCDKILSRMNITTDYFDPMIGEEIAELIKPNTKVVFLESPGSITMEVQDIPAIVRTVRQVNPDIVIMIDNTWAAGVLFKALAFGIDISIQSGTKYIVGHSDAMLGIAVANERCWVQLRESSYLMGQMADADTVYMASRGLRGSVV

SEQ ID NO: 22900 - protein, 353 aa, Fagus sylvatica
MEKYELVKDIGSGNFGVARLMRNKESKELVAMKYIERGRKIDENVAREIINHRSLRHPNIIRFKEVVLTPTHLAIVMEYAAGGELFERICAAGRFSEDEARYFFQQLISGVPYCHSMQICHRDLKLENTLLDGSPAPRLKICDFGYSKSSLLHSRPKSTVGTPAYIAPEVLSRREYDGKLADVWSCGVTLYVMLVGAYPFEDPEDPKNFRKPINRIMAVQYKIPDYVHISQECKHLLSRIFAANPSKRITIKEIKNHPWFLKNLPRELTEAAQIMYYKKENPSFSLQSDREITKIVEDAKIPPPTSRSIGGFGWGGEEDGDGKEEEVNAEDEEEDEYEKKVKEAQESGDVQVS

SEQ ID NO: 22901 - protein, 183 aa, Fagus sylvatica
MKAVREKPNLFELFLQNQYAGAAPQNDEFGNPIRSDEYGNRVRTHEFGNPTHHTQQRCCRIRNWWFDTNTLQGMRHDATTGAGHGGVDYRHDQQQQQHGLSGMLHRSGSGSSSSSEDDGFGGRRKKKGVMEKVKEKIPGVGHKDDQYHQGQTTSTITPDYYDQGQTHEKKGIMEKIKEKLPGH

SEQ ID NO: 22902 - protein, 475 aa, Mytilaria laosensis
MSPQTETKASVGFKAGVKDYKLTYYTPDYETKDTDILAAFRVTPQPGVPPEEAGAEVAAESSTGTWTTVWTDGLTSLDRYKGRCYHIEPVAGEKTQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELTAACEVWKEIKFEFEAMDTL

SEQ ID NO: 22903 - protein, 475 aa, Exbucklandia populnea
MSPQTETKASVGFKAGVKDYKLTYYTPDYETKDTDILAAFRVTPQPGVPPEEAGAEVAAESSTGTWTTVWTDGLTSLDRYKGRCYHIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKPLRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 22904 - protein, 475 aa, Rhodoleia henryi
MSPQTETKASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDNL

SEQ ID NO: 22905 - protein, 470 aa, Platanus occidentalis
ETKASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 22906 - protein, 327 aa, Oryza sativa (japonica cultivar-group)
MGHVDASAAAAAARDAKKKRGNRSSAKLKQCKLDARREQWLSQVKDGKEAKASTSPTGTEPNAGSMTVPSPHPPLPRRRLDVRSKGGDPEEDREERGAARQELGSSYLDSPVHSPSSDNSGSVGGMHRKHYNNGGGLNLSSSSSVWSSSRSVSEAEDDDTGGPEEENGVLDDWEAVADADALTVDDCHSHQSSGHVAPPAAPNVCTAPANQTGRQDPIQRTKAWAPDDIFRPQSLPSISRQVSFPASIGNGWMGAAQQANLSTPLTCPICCEDLDLTDSSFCPCPCKFCLCLFCHNKILEADGRCPGCRKEYVAARLSRSCSMGPRY

SEQ ID NO: 22907 - protein, 368 aa, Oryza sativa (japonica cultivar-group)
MGWASAAATCGRLQPGGGGGESSSTTTTRTTQMDPSCPPFPQPEAPPLPLQLQLQPGLPRLELPTLDLERVGGEDRAALVAACRDLGAFRVVNHGVPGELRRRLLELGKQLLGRDTFELKKARPGYFWGTAALKSLRVKEVNWLEGLHVDLVPGSSSSSSQVGDGDDDDDDGWMRIRALMAEYGDHMARIARKLFDALAAELGLDHHQAASYLAERQGFLRLYRYPPCPSSASCLGMEPHTDSSVLSIILGQDHVGGLQVIRDGAWRDVAPAPGELLVNLGDMMTAISGGSYQSVRHRVLASRPSTERVSCCYFAFPQEDAVVEAPSGIGGGVYRPFSYREFREQVQADIKAVGTKVGLSRFYATATR

SEQ ID NO: 22908 - protein, 161 aa, Oryza sativa (japonica cultivar-group)
MQMVLRVKHPSSLGGGGGGGEEEAGEASSRSALSVFKAKEEQIERKKMEVREKVFAQLGRVEEESKRLAFIRQELEGMADPTRKEVEVIRKRIDVVNRQLKPLGKTCVKKEKEYKEILEAYNEKNKEKALLVNRLIELVSESERMRMKKLEELNKTVDSLY

SEQ ID NO: 22909 - protein, 372 aa, Serratia marcescens
MKSRAAVAFGPGKPLEIVEIDVAPPQKGEVLVKITHTGVCHTDAFTLSGDDPEGVFPAVLGHEGGGIVVEVGEGVTSLKPGDHVIPLYTAECGECKFCKSGKTNLCQAVRATQGKGLMPDGTTRFSYNGEPIYHYMGTSTFSEYTVCAEISLAKVNPQAPLDKVCLLGCGVTTGIGAVHNTAKVKEGDSVAVFGLGGIGLAVIQGAAQAKAGRIIAVDTNPEKFKLAGEMGATDFVNPNDYDKPIQDVIVELTDGGVDFSFECIGNVNVMRAALECCHKGWGESVIIGVAGAGQEIRTRPFQLVTGRVWRGSAFGGVKGRSQLPGMVEDAMAGKIRLDPFITHRLPLEKINEAFDLMHEGKSIRTVIHFGDK

SEQ ID NO: 22910 - protein, 502 aa, Mycoplasma penetrans
MKKGPVLLAVLDGYGFSKDTKGNAILNAKTPFMDNLVKEYDHCYIEASGEYVGLPDGQIGNSEVGHLTIGAGRIVYTGLSLINQDIKTKKFDSNKTLLEAINHAKKNNSNIHIMGLLSPGGVHSNEQHIFEMIRIVSENGLKPVIHVFGDGRDVAPQSIISSLERLNDVLKKYPGTIATISGRFYSMDRDKRWERTKQAYDNLLGISNNYFDNPIDYVNKQYSENIFDEFLVPARINDSNVVIKDNDAVIHANFRPDRARQISHLFCGSTVYEEKNDHPLKNLYYAIMMTYEGITPTSILFPTVVVKNTFGEVVANSGLTQLRIAETEKYAHVTFFFDGGVEVDLKNESKILVDSKKVKTYDEVPAMSAVEITDKLIENLDKFDVIVLNFANADMVGHTGKYNEAVLAIEALDSQLARIDQKIKELNGTMFITADHGNAEVMLDDDNNPVTKHTTNPVIFISNNKDVKFNKPGSLGNVAPTILDFMGLEIPADMDKKSLLKK

SEQ ID NO: 22911 - protein, 413 aa, Podospora anserina
MGDLQGRKVFKVFNQDFIVDERYTVTKELGQGAYGIVCAAVNNQTNEGVAIKKVTNVFSKKILAKRALREIKLLQHFRGHRNITCLYDMDIPRPDSFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQNYTKAIDVWSVGCILAELLGGRPFFKGRDYVDQLNQILHILGTPNEETLSRIGSPRAQEYVRNLPFMAKKSFPSLFPNANPDALDLLDRMLAFDPSRRISVEEALEHPYLAIWHDASDEPDCPTTFNFDFEVIDDVNEMRKMILSEVVNFRAQVRTVPGQAGSAGNIQQAPSNVPIPAGGPGQQWTAEDPRPMEYGNQMQGLEAELGGR

SEQ ID NO: 22912 - protein, 1118 aa, Hordeum vulgare
MDCLRLAVAAAALLLAALAAAADDAQLLDEFRMALPSQAPLEGWTAREGACRFPGAVCRGGRLTSLSLAAVTLNADFRAVANTLLQLSAVERLSLRGANVSGALAAARCGGKLEELDLSGNAALRGSVADVAALAGSCGALRTLNLSGDAVGAAKPAGGGGGGQGFAALDALDLSSNKIAGDADLRWMVGAGLGSVRWLDLAWNKISGGLSDFTNCSGLQYLDLSGNLIAGDVAAAALSGCRSLRALNLSSNHLAGAFPPNIAGLTSLTALNLSNNNFSGEVPADAFTGLQQLQSLSLSFNHFSGSIPDSVAALPDLEVLDLSSNNFSGSIPDSLCQDPNSRLRVLYLQNNYLSGSIPEAVSNCTDLVSLDLSLNYINGSIPESLGELSRLQDLIMWQNLLEGEIPASLSSIPGLEHLILDYNGLTGSIPPELAKCKQLNWISLASNRLSGPIPSWLGKLSNLAILKLSNNSFTGKIPAELGDCKSLVWLDLNSNQLNGSIPPELAEQSGKMTVGLIIGRPYVYLRNDELSSQCRGKGSLLEFSSIRSEDLSRMPSKKLCNFTRMYMGSTEYTFNKNGSMIFLDLSFNQLDSEIPKELGNMFYLMIMNLGHNLLSGAIPTELAGAKKLAVLDLSHNRLEGQIPSSFSSLSLSEINLSSNQLNGTIPELGSLATFPKSQYENNSGLCGFPLPPCESHTGQGSSNGGQSNRRKASLAGSVAMGLLFSLFCIFGLVIIAIESKKRRQKNDEASTSRDIYIDSRSHSGTMNSNWRLSGTNALSINLAAFEKPLQKLTLGDLVEATNGFHNDSLIGSGGFGDVYKAQLKDGRVVAIKKLIHVSGQGDREFTAEMETIGKIKHRNLVPLLGYCKIGEERLLMYDFMKYGSLEDVLHDRKKIGVRLNWAARRKIAIGAARGLAFLHHNCIPHIIHRDMKSSNVLVDENLEARVSDFGMARMMSVVDTHLSVSTLAGTPGYVPPEYYQSFRCTTKGDVYSYGVVLLELLTGKPPTDSTDFGEDHNLVGWVKMHTKLKITDVFDPELLKDDPTLELELLEHLKIACACLDDRPSRRPTMLKVMTMFKEIQAGSTVDSKTSSVATGLSDDPGFGVMDMTLKEAKEEKD

SEQ ID NO: 22913 - protein, 477 aa, Oryza sativa (japonica cultivar-group)
MGQKLALNIAEKGFPISVYNRTAAKVDATVSRAEAEGALPVLGHRDPRGFVLSLSRPRTVVLLVQAGRAVDATIDALVPYLDAGDAIVDGGNEWYQNTERRIEEAAARGILYLGMGVSGGEEGARNGPSLMPGGHIDAYNNIRDILEKAAAQTEDGACVTFVGPGGAGNFVKMVHNGIEYGDMQLIAEAYDVLRRVGGLSNSEIADVFAEWNRGELESFLVEITADIFTVADPLDGSGGGGLVDKILDKTGMKGTGKWTVQQAAELAIAAPTIAASLDGRYLSGLKDERVAAAGVLKAEGMPSGLLETINVDKKMLVDRVRQALYASKICSYAQGMNLLRAKSVEKGWNLNLAELARIWKGGCIIRAKFLDRIKKAYDRNPELANLIVDREFAREMVQRQNAWRWVVARAVEAGISTPGMSASLSYFDTYRCSRLPANLIQAQRDLFGAHTYERIDRPGSFHTEWTKLARKSNGAAI

SEQ ID NO: 22914 - protein, 292 aa, Pseudomonas cruciviae
MNTLKIAVLGTGMMGLPMARRLAQAGHEVHAWNRTRAKAEPLAADGVNIHDSAADAVRGVDFAVSLLESGAIVGEVLFDLGVAEAMPKGSLFIDMASIQPREAREHAGKLAALGLRHLDAPVSGGTLGAEAGTLAIMAGGEAADFEQALPVFAALGRATHVGPHGAGQLAKLANQMIVGITIGAVAEALLLAERGGADPAKVREAISGGFADSRILQVHGERMVKHDFAPRGRMTVQLKDMRNATATAEEIGFDAPITGLLEQLYAEGVKNGLGDLDQAGLFVELQRRNALD

SEQ ID NO: 22915 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIILVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 22916 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVITVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 22917 - protein, 468 aa, Bartonella henselae
MSYDVVVIGAGPGGYVAAIKAAQLGLKTAIIEKRMTLGGTCLNVGCIPSKALLHASEVFAETQHGFETLGISIAKSKLNLEQMMAHKKAVVTANTSGVSFLMKKNKIDTFFGTAKILNAGQIEVVARDGNKQTIETKNIIIATGSESSGIPGVNVEIDEKVIVSSTGALALEKVPTRMIVVGAGVIGSELGSVWSRLGAKVTIIEYLNKVLGSMDGEVSRQFQKIMEKQGIEFKIGAKVTAITQSGSVAQVTFEAVKGGPSETLEADVVLIATGRFPYTEGLGLEEAGVQLDERGFITIDAHWQTNIPGVYAIGDVVKGPMLAHKAEEEGVAVAEILAGQKGHVNFDVIPSVVYTQPEIASVGKTEEELKAAGIDYNVGKFPFMANGRARAMQKSDGFVKILADKKTDRVLGGHILGFGAGEMIHEIAVLMEFGGSSEDLGRCCHAHPTLSEAVREAALATFAKPLHI

SEQ ID NO: 22918 - protein, 370 aa, Sulfitobacter sp. EE-36
MKTRAAVAVAAGQPLEVMDVNLEGPKRGEVLIEINATGLCHTDEFTRSGDDPEGIFPAILGHEGAGVVLEVGEGVTTLEVGDHVIPLYTPECRECEYCLSGKTNLCQAIRVTQGQGLLPDGTTRFSMMDGTPIHHYMGCSTFANHTVIPEIALAKVRKDAPFDKICYIGCGVTTGIGAVINTAKVEIGARCVVFGLGGIGLNVIQGLRMAGADQIVGVDLNDDKEETGRYFGMTDFVNPTKVEGDMVAHLVELTKGGADYTFDATGNTKVMRQALEAAHKGWGESIIIGVAPAGAEISTRPFQLVTGRVWKGTAFGGAKGRTDVPKIVDWYMNGKIEIDPMITHKLTLDQINEGFELMHKGESIRAVVEF

SEQ ID NO: 22919 - protein, 370 aa, Sulfitobacter pontiacus
MKTRAAVAVAAGQPLEVMDVNLEGPKRGEVLIEIKATGLCHTDEFTRSGDDPEGIFPAILGHEGAGVVLEVGEGVTTLEVGDHVIPLYTPECRECEYCLSGKTNLCQAIRVTQGQGLLPDGTTRFSMMDGTPIHHYMGCSTFANHTVIPEIALAKVRKDAPFDKICYIGCGVTTGIGAVINTAKVEIGARCVVFGLGGIGLNVIQGLRMAGADQIVGVDLNDDKEETGRYFGMTDFVNPTKVEGDMVAHLVELTKGGADYTFDATGNTKVMRQALEAAHKGWGESIIIGVAPAGAEISTRPFQLVTGRVWKGTAFGGAKGRTDVPKIVDWYMNGKIEIDPMITHKLTLDQINEGFELMHKGESIRAVVEF

SEQ ID NO: 22920 - protein, 268 aa, Salmonella typhimurium
MERYENLFAQLNDRREGAFVPFVTLGDPGIEQSLKIIDTLIDAGADALELGVPFSDPLADGPTIQNANLRAFAAGVTPAQCFEMLALIREKHPTIPIGLLMYANLVFNNGIDAFYARCEQVGVDSVLVADVPVEESAPFRQAALRHNIAPIFICPPNADDDLLRQVASYGRGYTYLLSRSGVVGAENRGALPLHHLIEKLKEYHAAPALQGFGISSPEQVSAAVRAGAAGAISGSAIVKIIEKNLASPKQMLAELRSFVSAMKAASRA

SEQ ID NO: 22921 - protein, 508 aa, Pichia angusta
MQLSTLWEPPIVNPRNLKATSIPIFNLWNVYGRNFFFGWFGFFVCFLSWFAFPPLLHGMLKKDLRLTAVDISNNNICGLTGTLLGRFILGPLNDKYGPRITLTGVLVAGAIPTAFVPLVTNVAGLHAIRFFISFLGSSFICCSQFCAVFFDNNIIGTANAISAGWGNAGGGVAFFVMPAISNALENRGYSLHHSWSYSFVIGPFLILMITAILIFVFGSDCPRGRWSLRGDILGINMDNMLVKSVSVTRHFSKEGELTSVFVEPVNAIDKVVVEPNQDQEILEVADIINGDEIIEDPSLNDVVKICLSPRTMLVGLCYMCSFGTELAVESIISNLFGQKMTNWSTSKAGAWGSMLGLLNVVARPAGGIISDFLYQRFKTTKAKKFWMIFTGLMQGIFLIWIGLVPELSIAGLIVSVSFLCLWFEMGNGANYACVPVVNRHHSGIVSGVTGAMGNLGGILFSLVFRYTISNGVNNYFKAFWIIGIVCTAVNLVCVLIPIREERPRKAEN

SEQ ID NO: 22922 - protein, 1044 aa, Pichia angusta
MTCSVPPLPEDISPRAAKKKLVIVGLGMVGLSFLEKLLSNDSKLNEYSIMVYGEEPYLAYNRVGLTEYFQHREFKNLLLSPEEFYQLRGEKWNYAIDEKVVDIDRRARIITTDKGNRASYDVLVLCTGSAAILPTDLLPPLTRKSYREMGCFVYRTIDDLYSMIDYCQGAKKTRAIVVGGGLLGLEAAKALYDMESFEDITIVHRSHWLLSQQMDQKGGSLLTSKVKELGITCRTGTTVSELLFDEDQNLKGVKYDNGQIEECSLLCYTIGIKPRDELTSCGLNAGSRGGFKVNNMLQTSDENIYAIGECASWNNMTFGLIAPGYEMADILAFNLTQGKLHQPKEFSEPSMGTRLKLMGVDVASFGDFFADRNGPKWLLADTTKKFVDLVFEDPIDATYTKLLFTKDGKYMLGGILVGDTSNYTKFSAMIRKPLPKSPSELLIGKSGEDDMEMLSDETQICSCHNITKGKLVEAVKNGCSSLADVKKCTKAGTACGGCEPTVKIIFEKELKKLGGKVSNNLCVHFDYSRAHWFSLIMVKNFRSFRRVMEELGNDPSSSGCEICKPTIGSILSTLYNRHLLKKEVHGLQDTNDRYLGNIQRDGTFSVVPRMSAGEITPEKLVSIGKIAKKYGVYTKITGAQRLDLFGVKKSDLLKIWKDLNEAGFESGQAYGKSLRNVKSCVGSTWCRYGIGDSVGLAVRLEERYKGIRSPHKMKGGVSGCVRDCAEFHSKDFGLCAVSGGFNIYVGGNGGMKPRHAQLLATNVRPDEVIPILDRYLMFYITTADRLQRTARWLENLDGGIEYLKDVIIRDKLGICKDLEAQMRHVVAGYYDEWAKAVSEEKENPIFKQFVNTPENQDCVEIVNERGQPRPAMWPEKAANQKFNEIRWSSVSWQEVCECSDLPLAEAGSSATVLVGDTQIALFRTSKNELYCSQNMCGHKRAFVLNQGLLSEDSDKNCYISCPMHKRNFYLKSGACKNDEALSIATFEVKEENGKVYAKLPPLKELDEVLGTSKWKVTSQETEAKQVRKITTEKNLVDKAILLDW

SEQ ID NO: 22923 - protein, 254 aa, Schizosaccharomyces pombe
MSRKNLIKLNHDPTVTYSTKDDADELFDDLSSSPLHENVSWISWFCSRPGREYFVEVKEDFIEDLFNLTGLNLAVPFYNEALDLILDRTAPDTLENFDMDVIETSAQILYGLIHQRYIITRTGLHQMAEKYSMGIFGCCPRVNCCYTHVLPAGLSDIVGKMPVMLFCPNCLDLYAPSSSRYKNIDGSFFGATFPHLFFESYPELNPKRSIPCGKIYQPRIYGFKVSELSKTGPRMQWLRMYLEDSGSDSESESD

SEQ ID NO: 22924 - protein, 459 aa, Schizosaccharomyces pombe
MTETVTTTSSDKSEKKNYLFYTSPNHRPPTVVRAEGVYLYLEDGTRIMDATGGAAVACLGHGNKEVIDAMHKQSEKVCYIHSMGFSNEPADKLANLLVSEHPDVFARAYFANSGSEAVETCLKLILQYWQLVGEKQRCHIIARKQGYHGNTLFALSVGGMKPRKQPYEGVFSHTTSHVSPCFEYRYKENGETTEEYVARLAKELEDEILRVGPEKVAAFVAETVSGACTGCATPVPGYFKAMRKVCDKYGVIFYLDEVMSGIGRTGTMHAWEQEGVTPDIQSIAKCLGGGYQPISGALVGHRIMNVFEQKDAAMAGFFTYQAHPIACSAALAVQTILRRDHLVERAAEMGKYLSEKLHETFDSHPNVGNIRGRGLFWGLEIVKDKATKECFPPEYKVGSLANKIGCEHGVFVYPGMGTIDGTRGDHVLLAPPYIITREQIDELVEALSKTITSTVAALP

SEQ ID NO: 22925 - protein, 336 aa, Schizosaccharomyces pombe
MSELVLITGITGFVASHSAEALLSQGYRVRGTYRFQEKLDGLLKNRPEWEKKVEFVQVPDCRAPNAYVEAAKGVDYVIHAATEVHSNLEPPRKDPHELLHIAIQGCENALIAAAQEPKVKRFVYISSEAALKGPVNYFGDGHVFTEKDWNPKTLREAEESDDELLNYTVCKKLGERAMHAFVARNTPRFQAIALNPPLILGPVFHLQSVDNLNFSTWFFWQLIKGRYEVAPESKFFNYVDVRDLAEAQVKALTAKTDKDRFVISGGAFKNDDIVNVALKYFPQFKDKIAKPNGETSPCNYEVDASLSIKELGLTYRPAEETFKDATESLYKLAGLL

SEQ ID NO: 22926 - protein, 346 aa, Schizosaccharomyces pombe
MALRYVVHDEISGFDQLKPEEYEVPQKLNPGEVLVKLKAASLNYRDLIITKGLYPLPLQLPVVPGSDGAGIIEKVGEDVEGFEKGDSVVCNFFTNYLDGTPTDFATHSALGGTRDGCFQKYAVLPAHALVHAPKNLSFEEIATLPCAAVTAWNGLFGSKEHQVKPGNNVLVLGTGGVSTFALQFALAAGANVTVTSSSDEKLEFAKKLGATHTINYKKTPQWASPALKMTNGVGYHHVIEVGGEKTLPQSIACLAKDGMISMIGFVASEGTTPNLTSIIGQILNRNANIRGIFVGSVSMFRDMVACIEAKDIHPVVDKVFPFDQLKEAYEYQWSQAHIGKVVLKID

SEQ ID NO: 22927 - protein, 178 aa, Schizosaccharomyces pombe
MRAYIFQDEGDQRKPNDSKIEVSAEDLEAAKVSYRHHDGDLHTFADGLMKEYGFKNRDEVVVSRKGLGDRYDNMVKKFFEEHLHEDEEIRLILDGNGYFDVRSVDDRWVRIFVEKGDLIILPPGIYHRFTTTTDDYIHAMRLFHENPKWIALSRTDSTSEELDARKSYLNSIKKSVYV

SEQ ID NO: 22928 - protein, 218 aa, Hordeum vulgare subsp. vulgare
MSGGAGAATAVSRFIKCVAVGDGAVGKTCMLICYTCNKFPTDYIPTVFDNFSANVSVDGSIVNLGLWDTAGQEDYSRLRPLSYRGADVFILSFSLTSRASYENVHKKWMPELRRYAPGIPVLLVGTKLDLREDRAYLADHAADSIITTEQGEDLRRQIGAVAYIECSSKTQRNIKAVFDTAIKAVLQPQRHKEVARKETRTRSSRSVRQYFCGSSCFA

SEQ ID NO: 22929 - protein, 311 aa, Cucumis sativus
MAVFPIINLENINGDGRAKILEQIEDACQNWGFFELVNHGIPHEFLDMVEKMTRDHDKKCMEERFKETVLSKGLEAAQAEVNDMDWESTFFLRHLPESNISQMSDLDEEYKKIMKEFAKKLENLAEELLDLLCENLGLEKGYLKNAFYGSKGPTFGTKVSKYPPCPKPDLIKGLRAHTDAGGIILLFQDDKVGGLQLLKDGDWIDVPPMRHAIVVNLGDQLEIQKCDARVLITQTSGTGRMSIASFYNPGSDAVIYPAPALVEKDEEKKEVYPKFVFEDYMKLYLGVKFQAKEPRFEAMKANANLGPMATA

SEQ ID NO: 22930 - protein, 151 aa, Pseudotsuga menziesii
MASLMDKAKQFVVDKIAHIEKPSADVTDIDMKNLTTDSVTLESAIDITNPYDHDLPIWEISFRLRSADKLIASGTIKDPGSVKANDKTGMIVPVTVPYNFLISIMKDLGRDWDIDYEWDIGLTMHIPVVGKFTLPLNKKGTMKLPTLSDIF

SEQ ID NO: 22931 - protein, 167 aa, Pseudotsuga menziesii
MIVYQDLLSGDELLSDSFPYKELYNGVLWEVEGKWVVQGAVDVDIGANPSAEGGDEEGVKIRLVKVVDIVDTFRLQEQPPFDKKQFLGFIKRYIKNLATKLSEERQAEFKKNVEGAAKMLVSKLSDLQFFVGESMHDDGSMVFAYYKDGATDPTFLYFADGLKEVKC

SEQ ID NO: 22932 - protein, 474 aa, Corylopsis pauciflora
  misc_feature (5)..(5): Xaa can be any naturally occurring amino acid
  misc_feature (82)..(82): Xaa can be any naturally occurring amino acid
SPQTXTKASVGFKAGVKDYKLTYYTPEYATKDTDILAAFRVTPQPGVPPEEAGAAVAAESSTGTWTTVWTDGLTSLDRYKGXCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEIWKEIKFEFEAMDTL

SEQ ID NO: 22933 - protein, 439 aa, Neurospora crassa
MVALTNLLLTTLLASAGLGAALPPRIGSTVIEAREPELPVSGRKITLPQQKNPRFHKFNGALSVYKTYLKYGAPVPDHLVQAVANHLGISVEEVHNYANTTANARRDQGSATAAPIDQSDSAYITPVSIGTPAQTLNLDFDTGSSDLWVFSNSLPSSQRAGHTIYNPSKSSTAKRVNGASWDISYGDGSSSKGQVYLDKVTIGGLVVSNQAVETAQQVSQSFTAETSIDGLVGLAFGSLNTVRPRQQKTWFENAIGQLDQPLFAADLKYEASGTYDFGFIDPAKHTGDITYVPVNTNPGYWTWTSTGYQVGSSPFVSQSITNIADTGTTLMYVPDSILRAYYGQIRGATNSQSYGGYVFPCSTEAPDFTFGVTDEATITIPGRFINYGPVTDDGETCFGGLQTSSDVGINIFGDVALKAAYVVFKGGDSPSLGWASKQL

SEQ ID NO: 22934 - protein, 212 aa, Hordeum vulgare subsp. vulgare
MSVTKFIKCVTVGDGAVGKTCMLICYTSNRFPSDYIPTVFDNFSANVSVDGNIVNLGLWDTAGQEDYSRLRPLSYRGADVFVLAFSLISSASYENVLKKWMPELRRFAPNVPIVLVGTKLDLRDHRAYLADHPGASAITTAQGEELRKQIGAAAYIECSSKTQQNVKAVFDTAIKVVLQPPRRREVMSARKKTRRSSGCSIKHLICGSTCAA

SEQ ID NO: 22935 - protein, 215 aa, Hordeum vulgare subsp. vulgare
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEVEQFAKEHGLVFMEASAKTAQNVEEAFIKTAGTIYKKIQDGVFDVSNESYGIKVGYAVPNASGGGAGLVLSNQGRLLAIKQV

SEQ ID NO: 22936 - protein, 174 aa, Populus nigra
MPRDREPLSVGRVIGDVLDPFTRSISLRVNYNSREVNNGCELKPSHVVNQPRVDIGGEDLRTFYTLVMVDPDAPSPSNPNLREYLHWLVTDIPATTGANFGQEVVCYESPRPTAGIHRFVFVLFRQLGRQTVYPPGWRQNFNTRDFAELYNLGSPVAAVYFNCQRESGSGGRRP

SEQ ID NO: 22937 - protein, 168 aa, Arabidopsis thaliana
MGSEQNDSTSFSPSEPKLCVKGCGFFGSPSNMNLCSKCYRDIRATEEQTASAKAAVEKSLNPNKPKTQPQQSQEITQGVLGSGSSSSSTRGGDSAAAPLDPPKSTATRCLSCNKKVGVTGFKCRCGSTFCGTHRYPESHECQFDFKGVAREAIAKANPVVKADKVDRI

SEQ ID NO: 22938 - protein, 262 aa, Arabidopsis thaliana
MVWLTNQQIGRWKRKRILVVGSFLCWSIIMFITPKVPLDSFRHHIFADKRNFMGVPNTLNVMTNFPFLIVGVLGFVLCIGGSFFNISLNGEIWGWTLFYAGIASLAFGSAFYHLKPDDNRIVWDTLPILIAYSSLFSSFLVERAGEKVGLSCLILLLFISCLSVAYARVFNDLRLCMTFQLIPCLVIPVMAVLLPPKYTHSRFWLWATAAYTIAKIEGLADNKIYNANRYIISGHSLEHLCSAVATLLLTIMLLYRSIRFNR

SEQ ID NO: 22939 - protein, 368 aa, Cicer arietinum
MASSFIIPVTVFLATVIIAVNGCSPSDRAALLSFKAALKEPYHGIFNSWSGENCCLNWYGISCDSTSGRVTDINLRGESEDPIFEKSGRSGYMTGKISPEICKIDRLTSLIIADWKAITGDIPPCVTSLSNLRILDLIGNQIAGKIPSTIGNLQSLSVLNLADNSISGEIPASIADLGSLKHLDLSNNVLTGSIPANFGKLQMLSRALLNRNKLTGSIPVSISNIYRLADLDLSMNRLTGSVPSELGKMQVLSTLNLDSNLLSGQIPSSLLSNSGLGILNLSRNGFSGTIPDVFGPKSYFMALDMSFNNLNGRVPGSLLSAKYIGHLDLSHNHLCGSIPLGLGSPFDHLEASSFSNNDCLCGNPLKTC

SEQ ID NO: 22940 - protein, 314 aa, Neurospora crassa
MDTVVMDHDQTISPNEAQLPHNNNIPDDNMGGLEDSPQITPDQNGFPDRHYQQQFDQNLNSSPRSYSQHDNFDSDRYATPPAPQPSTSRPPSGLDGQNPSQSAENGSRTTAGGSSSEQANGRNHVVIKVGMVGDAQIGKTSLMVKYVEGSWDEDYIQTLGVNFMEKTISIRNTEITFSIWDLGGQREFVNMLPLVCNDAVAILFMFDLTRKSTLNSIKEWYRQGRGFNKTAIPVLVGTKYDHFVNLSREEQEEISNQARRFAKAMRAALIFSSTSHSINVQKIFKIVLSKAFDLKCTIPEISNVGEPLLLYQSV

SEQ ID NO: 22941 - protein, 1151 aa, Neurospora crassa
MSSTTEALLVSQNSPSTLPEAISRTMAPNTSPSRRARPAHVQTALTLQPQAFTNVSPLSAISTSSASPTSQQPSPALTPDTAGAIFTESSSLQGSPATFVSSTTKGMDSYASTIKGMEEPVTPLNLPEPLAPAPLSSKKSSNSLKRNGEKSGEKIPRQQNAMGEALSKSSFAGSLVRRASNTVNKARDILTRRASMNIVNRDADPMVASLRRGSNTFPLGEHNYRGHLLESDDECAIDDAGPLDGLRDAQIPLSIGPEIPVALRQGVMLKKISKKKKEKRITLTLDPDTSKIWWDKSRTGRKSVFIDDIKEVRTAEDIRQYRLDAGVEESEEPRFFSILYTVPEKSGTKVLHLIALNSTDFRNWTTTLDAILQYRQDFTTNLMAFNEKAVHEFWQRQMRKKYADRVIPAEGETIELPDIERICRSLHMHLSPTEIRDNFNAAKAAKATSNGVCDPTSPSSLNFNEFKEFVRLLKARSEISHVFKNHTTNPKAGMTRQEFIQFLKEIQCEDVEEDSTHWNNIFSQFARRRRSKDAEQTISGDESLTISEAGFTGFLNSHFNSLLIQEPSEYVLDRPMNEYYISSSHNTYLLGRQVRGISSVEGYISALERGCRCVEVDCWDGPNDEPYVSHGHTWTTRIKFEEVIKTINKYAFVKSRFPLWISLEVRCNAATQANMAKIMIDIFGDKLVRAPLDPSSDRLPSPSDLIERILIKVKKSQPVPNTPSEESLKTERPGRRRGNSLPSPYQRPSPLPSPMDNTSVAVPGSPSLSPSPMLRATRQINTITEGEVHSHGGPSNSPSEYESDAEKDSGKKVVSKINPILGELGVYCMGVHFDGFDSPDAKKFNHIFSFKEKTFAERSQPGEAKRALYRHNMRYLMRVYPNGGRISSSNFDPLLYWKRGVQMAALNWQTFDLGMQLNQAMFDSGTDLSGYVLKPLEGRQIQVVPTDAAGQLSGKRPRKRISFKIEVISAQQLMRPLNLPKGRTLDPYVEVEIFLADDKRNKQDGATNAPAQETQLKYRTDIVKDNGFNPVFKGNNSYEFIVTTKYPDLIFVRWSVKLGDNKGYNDRSPPLATFTAKLGGLKQGYRTIPLLDHNGYNYLFSTLFCKITKSQPTDIMVTYSSEVPRNSVSRIKNIFNQSGISPKSSMDSGRA

SEQ ID NO: 22942 - protein, 167 aa, Neurospora crassa
MSSATTIYDFKPLDKKGSELPLSTYQGKVVLIVNVASKCGFTPQYAGLEKVYKEIKEKYPDDFEILAFPCNQFGGQEPGTEEEIQSFCQLNYGVSFPIMKKVEVNGDNADPLYEWMKNEKPGLMGLKRIKWNFEKFLIGKDGKVKGRWASTTKPESLKEAILKELGE

SEQ ID NO: 22943 - protein, 1105 aa, Neurospora crassa
MRAIQAGAVLTSLLLSSLPLTLSQLVIPTNLPGVWEYDGCYTEVDRTIGAATYADGEDMTNEACISFCSARGFQYAGTQYAQECYCGESIATTAQKLEDSQCNMACKGNATEPCGGPSKLSIFHSSAAVGPQANPGVNGYSLLGCYSEGTTGRALTFVVGTIPGANMTVDKCTAACDASAYKYAGVEYGGECYCGNRISNGGAPATSGCTTLCNGNSTEICGGGNRLNIYIKGNPPPTSTVSGIIAITSSAVPDPQDPAQPASVGNYDWYGCRTEATGNRALSAATTASDEMTLEACSAFCAAYTFFGVEYARECYCGNSLNAGSVAAPDSDCSMTCAGKSTEYCGAGNRLSVYAKNGTEPPSTTVAPSSTVSSAIPQPTGLPEGWAPQGCWTEGTTGRLLNHQAPDSQTNSQVVCATYCASQGYSISGTEYGVQCFCGNSLFNSGAKVDDSQCSVNCPGDASQKCGAGDRLTIVSRGEPQVDLPPAPKGTVGDWAYKGCYEDNLNNQRTFFWQSEFPNVMTPKMCLDRCAEYGYMAAGLEYGQECYCGDPANIGTSGATKRPESECNIVCPGETSSICGGGSRLTTYFWTGTPFYSWDFPQDYRAGKYELLVNGVTVPLMTSETIQGKISFLSKWGTGPANETGAYELDLSKIGTNAAFRELHLKTDVFCAGGVTLPDKVGRQLTVGGWSGDSTYGTRLYWPGHDWEENVNELSLQAGRWYPSAMIMANGSIFVIGGETGSNAAAVPSIEVLPYTGTKPLFMEWLERTDPNNLYPFVAVLPSGGIFVQYWNEARILDEKTFATIKVLPKVPGAVNDPTSGRTYPLEGAAVLLPQRYPYSENLGVLICGGSNVGPGYALDNCVSTRPDDANPTWVIERMPSFRVMPCMAPLPDGTYLIANGAHHGVAGFGLANNPNLNALLYDPTKPYGSRITVMANTTIARMYHSEAITLLDGRVMISGSDPQDAVNPEEYRVEVFVPPYLLNGKPRPTFTLANRDWDWNQKTIPFTLGAAARNGAITVTLLGSVSSTHGNSMGARTIMPNVQCTGTSCTVDAPPNAHTAPPGWYQFFVLDGGVPAVGVYVRIGGDPAGLGNWPNTDGFSKPGI

SEQ ID NO: 22944 - protein, 484 aa, Neurospora crassa
MATNGNAPKEITAAQLPDLLANDNSVKLAGIDVDGQLRGKLVSKKKFLSIAESGFGFCSVIFGWDMHDQTYIKELKVSNKENGYRDIIAIPDLNSFRRIPWENNVPFFLISFHDPDTMEPVSACPRGLLRKQLAKLSEKGYGAMAGAEYEFFQFRAPSENASDSTASYLKENPPHSLPSLTEGMFGYSLTRPVHNKDYYYDIFNTCEQFQCNIEGWHTESGPGVFEAALEFGEVKQMADRASLFKYVVKSVATKYGITPCFMAKPKQGLPGNSGHMHISLVDKDGKNLLAREEVDPNAPYPDVAYLSDLGRHFLAGILEGLPDVMPMVAPTINSYKRLVENFWAPVTVSWGLEHRAASIRLIGPPGSKAGATRFEIRVPGADANPFYVLSAVLALGWRGVEKKLEIPCPPLGKGEQVGGVTDAGARLAKSLKEATDRFMSKNSIAREVFGDEFVDHYGGTREHEIRLWDEAVTDWEMKRYIETV

SEQ ID NO: 22945 - protein, 337 aa, Neurospora crassa
MSKAADIPKEQWAQVTEKDGVITYKKIPVPTPGHDEVLVNIKYSGVCHTDLHALDNDWPLPRKTPVIGGHEGAGVVVQKGELVTNVDIGDKVGVKWLMSTCFHCTFCQQALESLCPKAQLSGYTKDGTFQQYCVANAAHLARFPPQTDLSAVAPIMCAGLTVYKGLKESDTRPGQYVAIVGAGGGLGTIGIQKRGEACKKLGASMYIDFKESKDLVADVKKATHDGLGPQGVVLLAPQEQPFQQATGYVRSHGTVVCIGMPAGAKVSMPVFDTVVRMIKVKGSYVGNREDTAEALDFFLRGKVHAPYKVIGLSQLQSVFDEMRANRVIGRYVMDMSK

SEQ ID NO: 22946 - protein, 510 aa, Neurospora crassa
MGFMPGLTITTRVSPDAGTTSPIGSSGTAGDVGAPDAETPQNAPSPTRPPVSPITPTQESARLSGPDGHGDGPIHEQAHRHRHRQQHTTFSSSASTSSHSLTPPFTSTNNNGNNNNDNNNIPSFARGRPTFTHSQVDQVGIPPPPPQPIAFDDNPDVLALKSAITILQLQRQRATADIQALNRAKAAALSDPGAFVADLAAGRIGMDGDPLLNGPGPTGDGSSNDDDNDDDGDDDGDDDGDDDGDEDGDEDMNSEGDSVDGEDDGDDGEYDGAAVPSSSGLPHDPDGDISMSGAGAGAGNTSPTSTHNCNSNNSRRNVPKRKDRVSKTTTTTTTTKPPQGLSKTWRSLPKPQTVVRCPPINWAQYAIVGESLDKLHREQLTAPTLGVPAVLSVGGVYEFRGTAAAAAGAAPGGGVVSVGNGSGYAMGDTTATTDRTSTPPTTTMATTAGTEAQQSPGETLGQGQGQGQGQGQFPTLGRNEQSQRLVGIAAPYTPGRDKIERTTGRKGAKR

SEQ ID NO: 22947 - protein, 361 aa, Neurospora crassa
MARVYADVNQNMPRAYWDYDSVNISWGVLENYEVVRKIGRGKYSEVFEGINVVNYQKCVIKVLKPVKKKKIKREIKILQNLAGGPNIVALLDVVRDSQSKTPSLIFEYVNNTEFRTLYPRFNDFDVRYYIFELLKALDFCHSKGIMHRDVKPHNVMIDHENRKAMRLIDWGLAEFYHPGTEYNVRVASRYFKGPELLVDFQEYDYSLDMWSLGAMFASMIFRKEPFFHGQSNSDQLVKIAKVLGTDELFDYLDKYEIELDAQYDDILGRFQRKPWHSFINAENQRFVSNEAIDFLDKLCATIITYVFALEFVSLNTAVTLETDMILFQERLTAKEAMAHPYFAPVRDEATRARYLAGETIN

SEQ ID NO: 22948 - protein, 207 aa, Neurospora crassa
MPCGLGGSKTVQRKLVLLGDGACGKTSLLNVFTRGYFPTVYEPTVFENYVHDIFVDNVHIELSLWDTAGQEEFDRLRSLSYDDTDLIMLCYSVDSKDSLENVESKWQGEIAENCPGVKIVLVALKCDLREATEDEEDGGANEDGAQREKKPMISYDQGLEVARRIKALRYLECSAMRNRGVNEAFTEAARVALSVKKDREESKCVVM

SEQ ID NO: 22949 - protein, 446 aa, Shigella boydii
MSKQQIGVVGMAVMGRNLALNIESRGYTVSIFNRSCEKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVHRALYLGKIVSYAQGFSQLRAASEEYNWDLNYGEIAKIFRAGCIIRAQFLQKITDAYAENPKIANLLLAPYFKKIADDYQQALRDVVAYAVQNGIPVPTFSAAVAYYDSYRAAVLPANLIQAQRD

SEQ ID NO: 22950 - protein, 291 aa, uncultured crenarchaeote DeepAnt-EC39
MSFLDLHMTKSPLIMNPNDNSESVAVIFGVPFDSTHSYKPGCRFGPDAIRDAFNNIEIFQPEFGIDLETVNINDLGNTKHTVVATEMLQIVENITTELKKQNKQLIILGGEHLITLGSFSCFPKDTGYVVFDAHYDLRDQYADTKLSHAAYLRRIVEKRGSENIVHVGARAFVKEELAFLNEHNISTVSDKEIRNGNGPKLLKDIISTFDSLYLSIDLDVLDPAFAPGVGNPEAIGISSRELYDLVTTLQNKKIVAADIVELNPTYDNGATVSMAAKMISTIIAMNLSRSN

SEQ ID NO: 22951 - protein, 437 aa, uncultured crenarchaeote DeepAnt-EC39
MKNNIEIYKSKTRKSSKLFEKSKKYHVNGVHHNIRFFEPYPFVTKSANSKFLVDIDSNKYVDYWMGHWSLILGHKPKKIINVIKKQLNYDWMHGVLNKNSIELSEKISKVVPVAEKIRYASTGTEATMYAVRLARTVTKRKIIAKIDGGWHGYTTDLLKTVNWPFSKSESSGLTDEKYIISLPYNDLENSIKILKSKKNELAAVIIEPVLGGGGCIPATKEYMFGIQEFCRKNKTVFILDEIVTGFRFRFGCLYNTMKLDPDLLTLGKIVGGGLPIGVICGKDELMKYANTEIYSKIERAYIGGGTFSANPLTMIAGNSMLSTIKNKSNQLYRKLNSFGTETRKMLDKKFDGKVITTGMGSLFLTHFLNDSICEINNATDVAKCNIKKLHDYHFHMIANDDIFFLPGKLGAFSDVHTKSDIKTMERSTDEFLTKFKK

SEQ ID NO: 22952 - protein, 263 aa, Candida albicans
MPKNTLYVTGFSRESKAADLAPDFEKYGELVRLDIPPPRSDDGEKYAFVEYKDAESCERALELDGKTLPYSIKDGLVVQVARSDPYRVRQQFSGPRGGYRDGGYGGRGGYRDGGYGGRGGYRDGGYGGRGGYGGGRGGGYGGYRDGGRGGYRDGGRGGYGGYRDGGRGGGYGGYRDGGRGGGYRDGGYRDGGYRDGGRGGYGGGRGGYDRDREEGRGGYDREEDRGGYERDEGREPRVEERRYSRSPSRSPPRRDRSRSPERY

SEQ ID NO: 22953 - protein, 345 aa, Candida albicans
MSTDHHSHPVEGHQFKKIFNRLSGQPESYSRKQNYTFGKTLGAGSFGIVRYARDNSTDEEVAVKIILKKALKGNESMIIDEMQLLEQLNNPHIVGFRDWFESKDKFYLVTQLATGGELFDRIVQKGRFTEHDASLVVLQMLEALEYLHNKDIVHRDIKPENILYLTSKDDSPIVLADFGIAKRLQNPNEKLTSSAGSFGYAAPEVILGTGHGKPCDIWSLGVVTYTLLCGYSPFRSENVQDFINEVKHNNAVIFHADYWKDVSKDARRFIIKALQFNPDNRPTATELLNDPWLVSIAKEYKETDLLPNFKQGFDAKKKFRQAIELVKLNNRIKKLKEWQTDEDDD

SEQ ID NO: 22954 - protein, 210 aa, Candida albicans
MSGKGTSSRAYDMIMKLLLVGDSGVGKSCLLLRFVEDKFNPSFITTIGIDFKIRTIESKGKRIKLQVWDTAGQERFRTITTAYYRGAMGIVLIYDVTDSRSFENVENWFQTVTQHANEDAQIFLVGNKCDDEVNRQVSKEQGQELAAKLNVPFLEASAKSNENVDSIFYELASIIQEKHVEENIGGVGGASGAGGIDVSQNNSGAKNNCC

SEQ ID NO: 22955 - protein, 331 aa, Candida albicans
MSITVFVAGAGGYIGKHIVSQLLSKGYTVIGSVRNDEKGERLVSLFENDNFTYVVVEEAEAKGAFDKPLKDHPHIKVFIDTASPLPIGVNYEKQLIRRTSKGIKYILSSIKDHGPNITKVVVTSSIASCMNEKQSHDPNFVVDESKWNPDKHSVGKNNPTSAYFYAKASAEHEAWDFMKKKTHFTLATILPGYTFGPQCFDEDVSDLLETSVEIVTKIFELNKNDPIPKESGLFVDVRDVAAAHIRAFELNEAQNKRLMLVSEPFSAQEIVDILHEMYPAVQLPLGHPGDKPNYKFNNIETKKILNTDFRSLRSSIKDDYDQYLRTHGIIS

SEQ ID NO: 22956 - protein, 348 aa, Candida albicans
MSVPTTQKAVIFETNGGKLEYKDIPVPKPKANELLINVKYSGVCHTDLHAWKGDWPLATKLPLVGGHEGAGVVVALGENVKGWKVGDYAGVKWLNGSCLNCEYCQSGAEPNCAEADLSGYTHDGSFQQYATADAVQAARIPAGTDLANVAPILCAGVTVYKALKTAELEAGQWVAISGAAGGLGSLAVQYAKAMGYRVLAIDGGEDKGEFVKSLGAETFIDFTKEKDVVEAVKKATNGGPHGVINVSVSERAIGQSTEYVRTLGKVVLVGLPAGAKISTPVFDAVIKTIQIKGSYVGNRKDTAEAVDFFTRGLIKCPIKIVGLSELPEVYKLMEEGKILGRYVLDNDK

SEQ ID NO: 22957 - protein, 183 aa, Capsicum chinense
GAYGIVCSALNSETNENVAIKKVANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRPPELLLNSSDYTAAIDVWSVGCMF

SEQ ID NO: 22958 - protein, 180 aa, Capsicum chinense
GAYGIVCSALNSETNEHVAIKKIANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDLGLARVTSETDSMTEYVVTRWYRPPELLLNSSDYTAAIDVWSVG

SEQ ID NO: 22959 - protein, 183 aa, Capsicum chinense
GAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIF

SEQ ID NO: 22960 - protein, 380 aa, Cryptomeria japonica
FSIKGNGIGNGNGHCNGYSNGHGHCINGYSNGISASVSSNGVSHLPYSNGNTVHHSNSNGHIHTSPSFGDGRRRCFWYEEEIEDDLRWCFALNRILHTGVSEYQDIALIDTRPFGKALVIDGKMQSTEVDEFIYHESLVHPALVYHSQPKSAFIMGGGEGSTAREILRHKCVKKVVMCDIDKEVVDFCKKYLVVNREAFSNSRLELVINDARTELQSRQERFDVIIGDLADPVEGGPCYQLYTKSFYELVIKPKLNHQGIFVTQAGPAGVLTHTQVFSSIYNTLRQVFKHVMPYSAHVPSFADTWGWVMASDHPLTLEAGEIDDRIKQRIKGELQFLDGQTFLVAATLNKSVRKSLSKETHVYTEETARFIHGHGKASYQ

SEQ ID NO: 22961 - protein, 454 aa, Cicer arietinum
TDELRTVLETNLPKVKEGKKPKFSLGVAESKLGSQIHDVTKIPCQCNEFVGELLRGVRQHFVDSVGDLKPGDLIKAQLGLSHSYSRAKVKFNVNRVDNMVIQAIFLLDTLDKDINSFSMRVREWYSWHFPELVKIVNDNYLYCKVAKFIEDKSKLSEDKLEGLTDQVGDEDKAKEIIEAAKASMGQDLSPVDLINVHMFAQRVMDLSDYRRRLYDYLTTKMNDIAPNLASLIGEVVGARLISHAGSLTNLAKCPSSTLQILCAEKALFRAFKTRRNTPKYGLIFHSSFIGRASAKNKGRMARYLANKCSIASRIDCFSENGSTIFGEKLREQVEERLDFYDKGVAPRKNIDVMKSAIEIADNKDTEMETEEASAKKSKKKKQKATDEDDMAVDNAAEVTNGDATEDHKSEKKKKKKEKRKVDLEVETQDPSVDEGANGDSSKKKKKKSKRMDVD

SEQ ID NO: 22962 - protein, 378 aa, Taxodium distichum
FSIKGNGIGNGNGHCNGYSNGHGHCINGYSNGISASVSSNGVSHLPYSNGNTVHHSNGNSHTSPSFGDGRRRCFWYEEEIEDDLRWCFALNRIIHTGVSEYQDIALIDTRPFGKALVIDGKMQSTEVDEFIYHESLVHPALVYHSHPKSAFIMGGGEGSTAREILRHKCVKKVVMCDIDKEVVDFCKKYLVVNREAFSNSRLELVINDARTELQSRQERFDVIIGDLADPVEGGPCYQLYTKSFYELVIKPKLNHQGIFVTQAGPAGVLTHTQVFSSIYNTLRQVFKHVMPYSAHVPSFADTWGWVMASDHPLTLKAEEIDDRIKQRIKGELQFLDGQTFLVAATLNKSVRKSLSKETHVYTEETARFIHGHGKASYQ

SEQ ID NO: 22963 - protein, 263 aa, Holcus lanatus
MASSSLVLLVVALFAVFLGTAHGIAKVPPGPNITATYGDKWLDAKSTWYGKPTGAGPKDNGGACGYKDVDKPPFSGMTGCGNTPIFKSGRGCGSCFEIKCTKPESCSGEPIVVHITDDNEEPIAAYHLDLSGKAFGAMAKKGEEQKLRSAGELELKFRRVKCEYPKGTKVTFHVEKGSNPNYLALLVKYVDGDGDVVAVDIKEKGKDKWIELKESWGAVWRVDTPDKLTGPFTVRYTTEGGTKVEAEDVIPEGWKADTAYESK

SEQ ID NO: 22964 - protein, 465 aa, Arabidopsis thaliana
MDHVSSLPEGVLCNIFSFLTTKEAALTSILCKRWRNLLAFVPNLVIDDSVFLHPEEGKEERYEIQQSFMEFVDRVLALQGNSPIKKFSLKFRTDFASHRVNAWISNVLARGVSELDVLVILYGAEFLPLSPKCFKSRNLVTLKINSLGIDWLAGDIFLPMLKTLVLHSVKLCVDKFFFRALPALEELVLFAVSWRDRDVTVSNASIKTLTIKFNYYLGTLSLDTPSLVSFCFSDHVAKDYPLAKMEKLSEARISLLVTEYQIERARAPNIYWVEDDVVLRLVNVGKLMKGIRNVQYLNLSPNTLEVLSKCCESMPLFNNLKSLTIESNERRGWQAMPVLLRNCPHLETLVLEGLLHHVTEKCRNACDCVSQEEKGRSLTSCQVKVLEIKGFQGTTKEMHTIKHFLEHFPCLREIKIHMEENGPTQLRVPEVSQYIAEMMEHYEKSSSCNVQLLVGGYLCKKWTTQ

SEQ ID NO: 22965 - protein, 472 aa, Arabidopsis thaliana
MWALLIWVSLLLISITHWVYSWRNPKCRGKLPPGSMGFPLLGESIQFFKPNKTSDIPPFIKERVKKYGPIFKTNLVGRPVIVSTDADLSYFVFNQEGRCFQSWYPDTFTHIFGKKNVGSLHGFMYKYLKNMVLTLFGHDGLKKMLPQVEMTANKRLELWSNQDSVELKDATASMIFDLTAKKLISHDPDKSSENLRANFVAFIQGLISFPFDIPGTAYHKCLQGRAKAMKMLRNMLQERRENPRKNPSDFFDYVIEEIQKEGTILTEEIALDLMFVLLFASFETTSLALTLAIKFLSDDPEVLKRLTEEHETILRNREDADSGLTWEEYKSMTYTFQFINETARLANIVPAIFRKALRDIKFKDYTIPAGWAVMVCPPAVHLNPEMYKDPLVFNPSRWEGSKVTNASKHFMAFGGGMRFCVGTDFTKLQMAAFLHSLVTKYRWEEIKGGNITRTPGLQFPNGYHVKLHKKRD

SEQ ID NO: 22966 - protein, 141 aa, Arabidopsis thaliana
MMNTKKLLKMAKKWQQRAALRRKRISFHRSTDTTSSSTAAEKGCFVVYTSDRIRFAFPISYLSNSVIQELLKISEEEFGIPTEGPITLPFDSVFLEYLIRLVQRRMDGDTEKALITSISSTRCSLPCSFQLQEHSSTRLVF

SEQ ID NO: 22967 - protein, 386 aa, Lycopersicon esculentum
MALHATAFSFTGVSTSSKSSRSALLSLPRRCAVKATSQYPHSFPRCKIQGRALPSDNGLVEKDESSLVVCFGEMLIDFVPTTSGLSLAEAPAFKKAPGGAPANVAVGISRLGGSSAFIGKVGEDEFGYMLAEILKENNVNSDGMRFDPGARTALAFVTLRKDGEREFMFYRNPSADMLLQEDELDLELIRKAKVFHYGSISLITEPCKSAHIAAAKAAKDAGVILSYDPNLRLPLWPSAESAREGILSIWNTADIIKISEEEISFLTQGEDPYDDNVVRKLYHPNLKLLLVTEGPEGCRYYTKDFSGRVKGIKVDAVDTTGAGDAFVAGILSQLASDVSLLQDEGKLRDALSFANACGALTVMERGAIPALPTKEVVLNTLLKSVA

SEQ ID NO: 22968 - protein, 488 aa, Staphylococcus aureus subsp. aureus MW2
MWESKFAKESLTFDDVLLIPAQSDILPKDVDLSVQLSDKAKLNIPVISAGMDTVTESKMAIAMARQGGLGVIHKNMGVEEQADEVQKVKRSENGVISNPFFLTPEESVYEAEALMGKYRISGVPIVDNKEDRNLVGILTNRDLRFIEDFSIKIVDVMTQENLITAPVNTTLEEAEKILQKHKIEKLPLVKDGRLEGLITIKDIEKVIEFPNAAKDEHGRLLVAAAIGISKDTDIRAQKLVEAGVDVLVIDTAHGHSKGVIDQVKHIKKTYPEITLVAGNVATAEATKDLFEAGADIVKVGIGPGSICTTRVVAGVGVPQITAIYDCATEARKHGKAIIADGGIKFSGDIIKALAAGGHAVMLGSLLAGTEESPGATEIFQGRQYKVYRGMGSLGAMEKGSNDRYFQEDKAPKKFVPEGIEGRTAYKGALQDTIYQLMGGVRAGMGYTGSHDLRELREEAQFTRMGPAGLAESHPHNIQITKESPNYSF

SEQ ID NO: 22969 - protein, 170 aa, Oryza sativa
MPRSRINGNFIDKTFSIVANILLRIIPTTSGEKRAFTYYRDGMLAQSEGNYAEALQNYYEAMRLESDPYDRSYILYNIGLIHTSNGEHTKALEYYFRALERNPFLPQAFNNMAVICHYRGEQAILQGDSEIAEAWFDQAAEYWKQAIGLTPGNYIEAQNWLKITKRFEFE

SEQ ID NO: 22970 - protein, 170 aa, Triticum aestivum
MPRSRVNGNFIDKTSSIVANILLRIIPTTSGEKKAFTYYRDGMLAQSEGNYAEALQNYYEAMRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 22971 - protein, 447 aa, Neurospora crassa
MLLDVKASQRLDSRGNPTIQVEVRTAHGIFRALVPSGASTGVHEAVELRDNDKRKYGGKGVLTAVNNVNEIIGPALVKEGYSSRRDLKQIDGFMRELDGTPNKAKLGANAILGVSMACARAGAAAANIPLYEFLRREGGEEAPYMVPVPFFNVLNGGRHSGNGMAFQEFMIAPTGAKTIEEGIQMASETYFVLKQMISDKFGAIYTGVGDEGGFAPPITQPEEALDLLTEAVAKAGYTDKIKFGIDAASSEFFNPENGTYDLGFKRIKEGESHSDDVRTPAEMMALYKSLIEKYPIPLLEDPFAEDDWESWTKFCKDFYFEELVGDDLLVTNVERVRMAESRVACNAMLLKINQIGTVTEALDAAKLAKSLGWGVFVSHRSGETTDDFIADLSVGLCTGHIKSGAPCRGERVAKYNRLLDIETELKESWKPWSYAGEKFRKPEAFFI

SEQ ID NO: 22972 - protein, 1168 aa, Neurospora crassa
MSTAFQTTPNQSISVSATTSPSNRQYSSFHPGPTTREGPGSGYYANQHNAGQSSPHTSSQPHSRRPSAYDQPTGLEPHMSARTAFAQSIPAPVTSIASDQPPSSSDRRRNNMPTAVPPRTSSRHDPNTSSRRAQQAADRAAASRQSNTNGTMDPAVVDEAAARSRRQHQMTQDAHQRTTSSRGNPTPTSLPVRSQPNATSSRQQSSREASEILNNILIQQPEIDIERERERLAQAQAQAHAQAQAQAQAQAQAQAQQASNYNHHHRQETASQAMAAPGGDHGEESRRGHRSRHDHSKREKHTKFGEYILGNTIGEGEFGKVKLGWKQEGGVQVAIKLIKKDTVGNNPSRMAKIMREVAILKQLTHPNIVRLHKMEESDRHYGIVLEYASGGELFDYILNHRYLKDNAARRLFAQLVSGVGYLHKKGIVHRDLKLENLLLDRNRNIIITDFGFANTFDPNQELSEEEELNLSDREFVKRMGLDKVNDAGWRKGDLMQTSCGSPCYAAPELVVSDSLYTGRKVDVWSCGVILYAMLAGYLPFDDDPANPEGDNINLLYKYIVNTPLTFPEYVTPHARDLLRRILVPNPRKRADLFEVARHSWLSEYSHVVEFITSSTTTPSEIQNTTVPAEDEGESPHLARSASVREAPKKSTASPAIGGLVSKQGTVDPEAEAAYAKQQRDNKRRTVQVEYVAPNTTTQRGDIAGQQQPSSNANRNRNESQAPVESSDSRPTTSAKDKQLSQGPSAPKDAYNNKPPVSSRRPPSSQRNGGNAPTTGNAVAPPRPSRDGRPTADNQYLSGAAGAPTQRPTTGGSMQSGRPSYAQPAPPEVADANVHGRIQQPSKGSGSSHFGVPTTTPAEQQPSESADYGRPSISTGSRFDKVREDGVVKGHKRSSTMGEIGGKLFGRSGSLFGGRKSKRQQELQQAGEKTKRYPPVSMNNSMPGGENGSRPSLDSKRSRRSFSMGMGKKSSGGSITGSNGSQEKSNKRFSFIPPSLSRAFGYNKEDEPPALDSQQDLPIQEPSSVDQFLGREQNVSATTVDGMYTQLQDSQQGSPAVNTQYQYGRPSASQGFMPGTMPNAGSDPSVNSMPQAPGSTPQLQTMTQQDGLYDARKGNSRANRGVLQKNKRFVDYEGDGFARPHDHSGSSGPARKVMDFFRRRGKARGGENN

SEQ ID NO: 22973 - protein, 220 aa, Neurospora crassa
MATRGPPGARPGMGNRFAQFKLVLLGESAVGKSSIVLRFVKDQFDSYRESTIGAAFLTQTIALDENTTVKFEIWDTAGQERYKSLAPMYYRNANCAVVVYDITQAASLDKAKSWVKELQRQANENIIIALAGNKLDLVQEQPDKRAIQTADAQAYAKEAGLLFFETSAKTAENVQNLFTEIAKKLPLDQVGPRHARPGQRPGVSLAPEGANTQVGGPCAC

SEQ ID NO: 22974 - protein, 466 aa, Pseudomonas sp. ND6
MQGARRAVAAGFDAIEFHGAHGYLLGQFLSPFTNKRTDQWGGSLENRARFALEVVRAVRTQVGPDFPLLYRLSVTEPYEGGLSLEDGLAFCQMLEPYVDALDVSAGNYDTAMVLLPMGAPGSLVNYAKAVKQRVSLPVIGVGRLTWLLEDMAKAIDNNELDFVALGRAGLADPDTVIKTRRGEPESVRRCIAVNECISRWMFNGKGTQCVINPTLGEERRAQLARRPAAVKQRVLVVGAGPAGCEAAILAAQRGHQVVLLERRNRVGGQLHAWAAASPFRQEILNMITFYETELGKAGVEVRLNAVADEVVPAEWDHVLLATGTAPATGPMDVVDMLADNALPTALELIVYGETETAMYAAIWLAENQRKVTLVSPSDKVGVDSNDMQRDHLESVLKQLGVSIALNGKPPEAGTVVMATARQPSTAHAALERYLNVQPIGTRLRGGRMYEATQSGFWAAANLGELQ

SEQ ID NO: 22975 - protein, 483 aa, Pseudomonas sp. ND6
MTVQLVIDNQKQSASDGKTFERIDPLSSHAVSVGAACSVEDALRAAQSSERAFQTWSGTGPTERRRILLAAADALEAKMADFCSAMAEEIGASQLWAQFNVGASANLLREAAAMTTQIKGETIPTDKPGALSMTLRQPVGTVLSIVPWNGPVILGARAIAYPLACGNTVIFKGSESSPRTHALLAEAFYEAGLPAGVLNFLISAPEDAAAVTEALVAHDTVRRVNFTGSTKVGRMIAQTCASHLKRCLLELGGKAPFIVLDDADIEGAVNAAVFGAFLYQGQICMSTERFVVDEAVADAFVARFAERVNALETGLPAKSPGCVIGPMIGQGSVQRINHLLDDAVNKGAKIVTGGLAETALMGPTLVDCVTREMAIYDEETFGPVTTIVRVKGAEQALAVANDTAYGLSSSIFSRDVTKALGLASRLDAGCVHINGATVQNEPQAPYGGMKKSGYGRFDGNAVIEEFTEVKWVTVEPSGQPYPF

SEQ ID NO: 22976 - protein, 377 aa, Pseudomonas sp. ND6
MSHDNVQKMRIQAAVLRESGAALKVEDVLLEAPRPTEVRVRVVASGVCHTDMVVRDQLFPTPMPIILGHEGAGVVDAVGSAVTTVKPGDHVVMTYMSCGLCLPCETGHPAHCTHMHPLNFGGGRLDGSASSCSCESHAPIHDHFFGQSSFSTYAIANERNVVKVAKEAPLELLGPLGCGIQTGAGSVLNALKVEAGSSFVAFGAGAVGLAAVMAARVAGATTIIAVDVTPSRLELALELGATHVINSRDENPVERIQQITAGGANYSLECSGRAEVLRQAIDALATLGTCGIVGATKFGTEVAFNINEVMIPGKRIMGIVQGDVVANAFIPKLVDLYLQGRFPFDKLCKFYEFDQVNEAMADSERGVTIKPILRMPQ

SEQ ID NO: 22977 - protein, 449 aa, Pseudomonas sp. ND6
MSNAMRTIDVSALIDGARFNAFHARVLVWCALIIIFDGYDLVIYGVVLPSLMTEWGLSSLQAGALGSCALVGMMLGALFFGSISDRIGRRKTIVICVLLFSGVTALNGFASSPEIFALCRFIAGLGIGGVMPNVVALMNEYAPKKSRSTLVAIMFSGYSLGGMLSAGLGMLFIPQWGWQAVFYVALIPLLMLPLLLRQLPESMDFLLRSGQIEQAKSVLALTTPSYLPEADDQLVHAVSRGATASIGELFRDGRLISTLALWVAFFCCLLMVYALSSWLPKIMSSAGYGLNSSLAFLLVLNGGAILGAIAGGWLGDRVGIARVLLLFFACGALSLSLLAIKAPLAVLYLLIAIAGACTIGTQILANACAVQYYPPHVRSTGLGWAMGIGRTGAIIGPVLGGVLHGSSLPLQASFLFFAIPGVIGAAAILVFLKRRKEIPPVQISPQTVS

SEQ ID NO: 22978 - protein, 204 aa, Buchnera aphidicola (Chaitophorus populeti)
MLTISQILDLNWDKVNNLIPIIVQDVFSNEILMHGYANKKSLLITLKKKKLTFFSRTKNRLWTKGETSKNYLKVIDIIPDCDQDSLLALVQAIGNTCHLNNKSCFKKKKNINVSFILELERILKYYKKNNNSTSYTSNLYKKGINKISQKVGEEAVELVIAAINKDKKNMLEECADLIYHILVLFSYTNIPFIDLIKILKKRNT

SEQ ID NO: 22979 - protein, 486 aa, Buchnera aphidicola (Chaitophorus populeti)
MLNKNLIDLFRSFSNMSLQKVGVIGMAVMGRNLALNIESKGYTVSIFNRSKNKTKEVILKNKNKNLIPFFTIKDFILSLQKPRIILLMVQSGTATDLTIKSIIPYLDPEDILIDGGNSFYKDTIKRSSLLFKKKIYFFGIGISGGEEGALKGPAIMPGGNKLIYKKISSLLKKIAAKTENNESCVSYIGTDGSGHYVKMVHNGIEYGDMQLISESYFILKHSLNLNNKQLSKIFSNWNKGELKSYLIEITKNIFLKKDSSGKYLIDVILDKANNKGTGKWTSQSALNLGEPLSLITQSVFFRYLSSFKNQRLQASKILYGPKPSQDVLNHEDFIENIRRSLYLGKIISYAQGFSQLKKASQVYHWNLNYSKIAKIFRAGSIIRADFLKEIIHAYQKSNGLENLLLAPYFIKISKEYQNSLRKIVSYSVMHGIPIPAFSAAISYYDSYRSPILPANLLQAQRDYFGAHTYSRIDKKGTFHTNWIDIK

SEQ ID NO: 22980 - protein, 365 aa, Enterobacter cloacae
MSAEKLFTPLKVGAVTAPNRVFMAPLTRLRSIEPGDIPTPLMGEYYRQRASSGLIITEATQISAQAKGYAGAPGLHSPEQIAAWKKITAGVHAEEGRIAVQLWHTGRISHSSIQPGGQAPVSASALNANTRTSLRDENGNAIRVDTSTPRALELDEIPGIVNDFRQAVANAREAGFDLVELHSAHGYLLHQFLSPSSNHRTDQYGGNVENRARLVLEVVDAVCQEWSPDRIGIRVSPIGTFQNVDNGPNEEADALYLIEELAKRGIAYLHMSEPDWAGGQPYSEAFRQKVRERFHGVIIGAGAYTPEKAEDLINKGLIDAVAFGRDYIANPDLVARLQQKAALNPQRPESFYGGGAEGYTDYPTL

SEQ ID NO: 22981 - protein, 341 aa, Gordonia sp. TY-5
MRAVQVVGYHDKLQLNEIPDPEITGPLDVIVRIGGAGVCRTDLHILEGQWEAKSGVALPYTIGHENAGWVEAIGDAVTNVAVGDKVILHPLITCGLCRACRDGDDVHCENSKFPGIDTDGGYADYLKTTARSVVRIDDSLEPAAVAALADAGLTAYHAAAKVARMTRPGDTCVVIGAGGLGHIGIQVLSAISGVTIVVLDRNPDAVALAVEVGAHEGIVADGNHIEKVLALTDGKGAEAVLDFVGEGGATAEGVAMLRQAGNYFVVGYGENINVPTIDIISTEINFIGNLVGSYNDLTELMTLAAQGKVTLHTATYPLTDFQQALDDLDAGKVRGRAILIP

SEQ ID NO: 22982 - protein, 507 aa, Gordonia sp. TY-5
MTVYAKPGTEGSVMSFESRYDNWIGGQWTPPVKGQYFENPSPVDGKTFCEVARSTAEDIDLALDAAHKAAPQWGKTSVAERSLVLLRIADRLEENLEKIAVAETWDNGKAVRETLAADIPLAVDHFRYFAGALRAQEGSISEVDEDTVAYHFHEPLGVVGQIIPWNFPILMAVWKLAPALAAGNAVVLKPAEQTPASILYVMSLIADLLPAGVINIVNGFGVEAGKPLASSNRIRKIAFTGETTTGRLIMQYASENLIPVTLELGGKSPNIFFNDVMSADDGFLDRALEGFSMFALNQGEVCTCPSRALIQEDIYDDFIGKAVDRVSKIKQGNPLDTDTMMGAQASNDQFEKISSYLAIGKEEGAKVLIGGEPADLGGDLSGGYYIKPTVFDGHNKMRIFQEEIFGPVLAVTTFKDYADAIHIANDTLYGLGAGVWSRDGATAYRAGREIQAGRVWTNTYHDYPAHAAFGGYKQSGIGRETHLMMLEHYQQTKNLLVGYAQSAKGFF

SEQ ID NO: 22983 - protein, 252 aa, Prunus persica
MPIRNIAVGRPEEAYHPDALRAGLAEFISTLIFVFAGEGSGMAFAKLTHGAATTPAGLVAAALAHGFGLFVAVSVSANISGGHVNPAVTFGAFVGGNISLLRGILYWIAQLLGSAVACGLLRFAPNYQTTSAFALSEGVGVWNAFVFEIVMTFGLVYTVYATAIDPKRGSVGTIAPIAIGFVVGANILAGGAFDGASMNPAVSFGPALVSWNWHNHWIYWAGPLIGGGLAGLIYEFVFIGNSSHEPLPTADY

SEQ ID NO: 22984 - protein, 409 aa, Rhodococcus sp. RHA1
MAGATAVTALRDQGFSGRVCLIGAEEHLPYERPPLSKEFLGGEMPEDRLLVHSRETYEEQDIELLLGRRAIRLCPADGAVELEGGERVGADRVLLCMGVRPRPVGVPGGTLPGVHYLHDLEDAWALQTVIERGVPVVVVGEGFIGSEVASTLAEQGADVTLLMAGDLPMPVLGAEASGWILDQHRSNGVDVRARSPLQAIRGRDRVESVELSDGTVLPAGAVVVGIGSEPVVDLATDVGITVDNGILVDGLSRTSVPGIYAAGDLARFPSPTFGRSIRVEHWQNAQLQAAKAVEGMLGHGDRDIEPYDDIPWAWTKQYGNQWEIAGRPGPDMQVIRRGVPGSTDGALWIFSAHGRVQGAVVVNRRRELRAVRRALEQGPIFTNDTIRDESVDLRAALSDTDAARHEKTA

SEQ ID NO: 22985 - protein, 334 aa, Medicago truncatula
MGSMAETVCVTGASGFIGSWLVMRLMERGYMVRATVRDPENLKKVSHLLELPGAKGKLSLWKADLGEEGSFDEAIKGCTGVFHVATPMDFESKDPENEMIKPTIKGVLDIMKACLKAKTVRRFIFTSSAGTLNVTEDQKPLWDESCWSDVEFCRRVKMTGWMYFVSKTLAEQEAWKFAKEHNMDFITIIPPLVVGPFLIPTMPPSLITALSPITGNEAHYSIIKQGQFVHLDDLCEAHIFLFEHMEVEGRYLCSACEANIHDIAKLINTKYPEYNIPTKFNNIPDELELVRFSSKKIKDLGFEFKYSLEDMYTEAIDTCIEKGLLPKFVKSTNK

SEQ ID NO: 22986 - protein, 339 aa, Medicago truncatula
MGSVSETVCVTGASGFIGSWLVMRLMERGYTVRATVRDPDNMKKVKHLLELPGANSKLSLWKADLGEEGSFDEAIKGCTGVFHVATPMDFESKDPEKEVINPTINGLLDIMKACKKAKTVRRLVFTSSAGTLDVTEQQNSVIDETCWSDVEFCRRVKMTGWMYFVSKTLAEQEAWKFSKEHNIDFVSIIPPLVVGPFIMPSMPPSLITALSLITGYEAHYSIIKQGQYIHLDDLCLAHIFLFENPKAHGRYICCSHEATIHEVAKLINKKYPEFNVPTKFKDIPDDLEIIKFSSKKITDLGFIFKYSLEDMFTGAIETCREKGLLPKVTETPVNDTMKK

SEQ ID NO: 22987 - protein, 494 aa, Triticum aestivum
MSATCAADLGPLLGAAAANATDYLCNRFADTTSAVDSTYLLFSAYLVFAMQLGFAMLCAGSVRAKNTMNIMLTNVLDAAAGALFYYLFGFAFAFGTPSNGFIGKHFFGLKDMPQTGFDYSFFLFQWAFAVAAAGITSGSIAERTQFVAYLIYSAFLTGFVYPVVSHWIWSVDGWASAARTSGPLLFKSGVIDFAGSGVVHMVGGIAGFWGALIEGPRIGRFDHAGRSVALKGHSASLVVLGTFLLWFGWYGFNPGSFVTILKSYGPPGSINGQWSGVGRTAVTTTLAGSVAALTTLFGKRLQTGHWNVVDVCNGLLGGFAAITAGCSVVDPWAAVICGFVSAWVLIGLNALAGRLKYDDPLEAAQLHGGCGAWGIIFTALFAKKQYVEEIYGAGRPYGLFLGGGGRLLAAHIVQILAIAGFVSCTMGPLFLALKKLGLLRISAEDEMAGMDLTRHGGFAYVYHDDDEHDKSVGGFMLRSAQTRVEPAAAANSQV

SEQ ID NO: 22988 - protein, 169 aa, Vigna radiata
MVFSLHKRFWVSSSFLLLFWALSVSSLTPTFLSDHVFDSQAHAGRNLLQAKKGCSVNFEFLNYTIITSKCKGPQYPPKECCGAFKEFACPYADVLNDLTNECASTMFSYINLYGKYPPGLFASECHDTKRGLECPALPPSVSADDTSNQFLHCPSLLLLLTTCFLILLF

SEQ ID NO: 22989 - protein, 177 aa, Ficus carica
GHATFYGDMTGSETMQGACGYGDLFKQGYGLQTTALSTALFDQGLACGACFELMCVDDPQWCIPKAGTITVTATNFCPPNLPETGGNWCNPPQQHFDLSMPMFTNLANYKAGIIPVQYRRVPCQKQGGVKFELKGNPYWLLVLVYNVGGAGDVSSLKIQSANTSWSQMSRNWGQNWQ

SEQ ID NO: 22990 - protein, 118 aa, Ficus carica
SPNTDGMHVQASTGVTILNSQIGTGDDCVSIGPGTTNLWIEDIACGPGHGISIGSLGKELKEAGVQNVTVKTATFRGTQNGLRIKSWGRPSSGFARNILFQHVVMINVQNPIIIDQHY

SEQ ID NO: 22991 - protein, 117 aa, Ficus carica
SPNTDGVHVTNTQNMTISNCDIGTGDDCISIVNGSKNVEAMDITCGPGHGISIGSLGAKKSEAYVSGVTVKRAKLTGTTNGVRIKTWQGGSGCASDILFSDIEMVDVCNPSSSTNKS

SEQ ID NO: 22992 - protein, 178 aa, Escherichia coli O157:H7
MKHTVEVMIPEAEIKARIAELGRQITERYKDSGSDMVLVGLLRGSFMFMADLCREVQVSHEVDFMTASSYGSGMSTTRDVKILKDLDEDIRGKDVLIVEDIIDSGNTLSKVREILSLREPKSLAICTLLDKPSRREVNVPVEFIGFSIPDEFVVGYGIDYAQRYRHLPYIGKVILLDE

SEQ ID NO: 22993 - protein, 472 aa, Escherichia coli O157:H7
METNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGYLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDTEGEDSPLLKKMLAGMIDLMPSSMALLAPNVNSYRRFQPGMYVPTQASWGHNNRTVALRIPCGDRHNHRVEYRVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 22994 - protein, 195 aa, Escherichia coli O157:H7
MDVSRRQFFKICAGGMAGTTVAALGFAPKQALAQARNYKLLRAKEIRNTCTYCSVGCGLLMYSLGDGAKNAREAIYHIEGDPDHPVSRGALCPKGAGLLDYVNSENRLRYPEYRAPGSDKWQRISWEEAFSRIAKLMKADRDANFIEKNEQGVTVNRWLSTGMLCASGASNETGMLTQKFARSLGMLAVDNQARV

SEQ ID NO: 22995 - protein, 383 aa, Escherichia coli O157:H7
MDFSLTEEQELLLASIRELITTNFPEEYFRTCDQNGTYPREFMRALADNGISMLGVPEEFGGIPADYVTQMLALMEVSKCGAPAFLITNGQCIHSMRRFGSAEQLRKTAESTLETGDPAYALALTEPGAGSDNNSATTTYTRKNGKVYINGQKTFITGAKEYPYMLVLARDPQPKDPKKAFTLWWVDSSKPGIKINPLHKIGWHMLSTCEVYLDNVEVEESDMVGEEGMGFLNVMYNFEMERLINAARSTGFAECAFEDAARYANQRIAFGKPIGHNQMIQEKLALMAIKIDNMRNMVLKVAWQADQHQSLRTSAALAKLYCARTAMEVIDDAIQIMGGLGYTDEARVSRFWRDVRCERIGGGTDEIMIYVAGRQILKDYQNK

SEQ ID NO: 22996 - protein, 496 aa, Escherichia coli O157:H7
MSTTTQNIPWYRHLNRAQWRAFSAAWLGYLLDGFDFVLIALVLTEVQGEFGLTTVQAASLISAAFISRWFGGLMLGAMGDRYGRRLAMVTSIVLFSAGTLACGFAPGYITMFIARLVIGMGMAGEYGSSATYVIESWPKHLRNKASGFLISGFSVGAVVAAQVYSLVVPVWGWRALFFIGILPIIFALWLRKNIPEAEDWKEKHAGKAPVRTMVDILYRGEHRIANIVMTLAAATALWFCFAGNLQNAAIVAVLGLLCTAIFISFMVQSTGKRWPTGVMLMVVVLFAFLYSWPIQALLPTYLKTDLAYNPHTVANVLFFSGFGAAVGCCVGGFLGDWLGTRKAYVCSLLASQLLIIPVFAIGGANVWVLGLLLFFQQMLGQGIAGILPKLIGGYFDTDQRAAGLGFTYNVGALGGALAPIIGALIAQRLDLGTALASLSFSLTFVVILLIGLDMPSRVQRWLRPEALRTHDAIDGKPFSGAVPFGSAKNDLVKTKS

SEQ ID NO: 22997 - protein, 512 aa, Escherichia coli O157:H7
MTNNPPSAQIKPGEYGFPLKLKNRYDNFIGGEWVAPADGEYYQNLTPVTGQLLCEVASSGKRDIDLALDAAHKVKDKWAHTSVQDRAAILFKIADRMEQNLELLATAEAWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 22998 - protein, 206 aa, Escherichia coli O157:H7
MTTPTFDTIEAQASYGIGLQVGQQLSESGLEGLLPEALVAGIADALEGKHPAVPVDVVHRALREIHERADAVRRQRFQAMAAEGVKYLEENAKKEGVNSTESGLQFRVINQGEGAIPARTDRVRVHYTGKLIDGTVFDSSVARGEPAEFPVNGVIPGWIEALTLMPVGSKWELTIPQELAYGERGAGASIPPFSTLVFEVELLEIL

SEQ ID NO: 22999 - protein, 339 aa, Escherichia coli O157:H7
MSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALSGQFDLIINTVNVSLDWQPYFEALTYGGNFHTVGAVLTPLPVPAFTLIAGDRSVSGSATGTPYELRKLMRFAARSKVAPTTELFPMSKINDAIKHVRDGKARYRVVLKADF

SEQ ID NO: 23000 - protein, 183 aa, Gibberella moniliformis
IPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALSHDYLSPYHDPTDEPVAEEKFDWSFNDADLP

SEQ ID NO: 23001 - protein, 488 aa, Acinetobacter calcoaceticus
MLTIVQEALTFDDVLLLPAYSTVLPKDVSLKTRLTRGIYLNIPLVSAAMDTVTESRMAIAMAQNGGIGILHKNMDIAAQAAEVRRVKKFEAGMVKDPITVSPETTVRELIAITSANNISGVPVVKDSKVVGIVTGRDTRFETNLEQPVSNIMTGQDRLVTVREGESKENIQALLQKHRIEKVLVVGESNELKGLITVTDFRKAESYPNSCKDDLGRLRVGAAVGTGADTPSRVEALVEAGVDVIVVDTAHGHSAGVIERVRWVKQNFPQVQVIGGNIATGDAALALLDAGADAVKVGIGPGSICTTRIVAGIGMPQISAIDSVASALKDQIPLIADGGIPFSGDMAKAIGAGASTIMVGSLLAGTEEAPGEVEFFQGRYYKAYRGMGSLGAMAGRTGSADRYFQDSKAGAEKLVPEGIEGRVPYKGPMGNIVHQMMGGLRSSMGYTGSAVIEDLRQNAKFVKITSAGMSESHVHDVTITKEAPNYRVG

SEQ ID NO: 23002 - protein, 422 aa, Schizosaccharomyces pombe
MSLNLLVNQEELKRYLDEYGVWSKIFRALFVARNSKPLRSFCVHYAIKELKEKTYNLELYQSLFEEFQDCFENEQLDVEWVESVTFHRKQNLEQLRRELKAYKNNLIRESIRAAQLDLASFFADVGQFDSALRSYAKVREYCTNAGQIAHLSLELMRISIWIGNYSHVLAFGSRAKSTVSAAMELTSPIYAYCGLANFCLGDYEEALAHFLKVETDTSDGIITKTDISVYISLCALACWDHKRLIQELERNEEFNALSDLDPSLRRCLQAKCNRKYSLLLDTLQQNAQDYSLDMYLAPQLTNLFSLIRERSLLDYLIPYSALPFSKIAVDFHIDENFIEKNLLEIIEAKKLNGKVDSLQKRVYIEPSSEPENFEDIKNIAQTSLLYSKALYLQTLAAMNTENTDDEAPVIAQTNITAEDSQN

SEQ ID NO: 23003 - protein, 306 aa, Schizosaccharomyces pombe
MSKTAASSAVDASQAGTVKVGDMVVNRMGFGAMRVTGDGIWDEPKDKEACIATLKRLPELNINFIDTADSYGPEVSENLLREALYPYKGLIIATKGGLVRTGPNEWHPCGAPKFLRQEVLMSMRRLGVKQIDLWQLHRIDPKVPRKDQFSEIAAMKKEGLIRHVGLSEVTVDDIKEAEQYFPVVSVQNLFNLVNRKNEKVLEYCEQKGIAFIPWYPLASGALAKPGTILDAVSKDLDRSTSQIALSWVLQRSPVMLPIPGTSKVDHLEENVKAAGIQLSSEVFAKLDEEGKSEDAKRQEEEKKKSS

SEQ ID NO: 23004 - protein, 416 aa, Agaricus bisporus
MSLSNKLSITDLALTGKRVLIRVDFNSPIQDGKITNPARINAALPTIKYALDNGASKVILMSHLGRPDGKAISKYSLKPVASELEKLLKKPVFFLHDCVGPDIEKAVLEAPEGAVVLLENLRFHIEEEGSAKNEEGKKIKADPSKVTQFREQLTRLGDVYVNDAFGTAHRAHSSMVGIKLPRRASGFLVKKELDYFAKALENPERPFLAILGGAKVSDKIQLIENMLDKVNCLVIGGGMAFTFKKTMQNVAIGNSLFDKPGSEKVAGIVEKAKKNNVEIVFPVDYVVGDKFDANANHKIVTDDEGVPDGWMGLDVGPKSNELFREAVLKAKTILWNGPPGVFEFPAFAKGSKVLLDATVEAVQKGATVIVGGGDTATVVANHDAEEKLSHVSTGGGASLELLEGKTLPGVAELSNK

SEQ ID NO: 23005 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVVVLVGVPHKDAEFKTHPMNFLNERTLKGTFFGNYKPRTDLPNVVELYMKKELEVEKFITHSVPFAEINKAFNLMAKGEGIRCIIRMEN

SEQ ID NO: 23006 - protein, 498 aa, Arabidopsis thaliana
MNVDFQNCLILILLCLLSFLCYSFFFKKPKDGFNLPPSPPSLPIIGHLHHLLSLFMHRSLQKLSSKYGPLLYLHVFNVPILLVSSPSIAYEIFRTQDVNVSSRDFPTNEGSLLFGSFGFGTAPSSGLKHSRGHKKSVQRSYYLNLLDKAVKKESVEIAEEAMKLVNNTVCQMIMGRSCSEENGEAERVRGLVTKTDALTKKFILAGILRKPLQKIGISLFKKELMDASCKFNEVLEKILVEYKEKVEEHHQGTDMMDKLLEVYGDEKAEYKITRDHIKSLFVDLFFAGTDTWTHAIQWIMAEIINNSYILERLREEIDSVVGKTRLIQETDLPNLPCLQATVKEGLRLHPPVPLVLRTFKEGCTIGGFYVPEKTTLVVNGYAMMRDPEYWEDPQEFKPERFLASSRSSQNDEIRDELLKYLPFGNGRRACPGANLAYISVGTAIGVMVQCFDWEIKGDKINMDEAPGKITLTMAHPLNCTLVPRTLIPVTSTVQIPSS

SEQ ID NO: 23007 - protein, 236 aa, Oryza sativa (japonica cultivar-group)
MAALAAASTAFAAKPRLARAPSSPAARFSVSCSASGNNGGAGEMAQSLAASAKTFSAALALSSVLLSSAATSPSPAAADIAGLTPCKESKAFAKREKQSIKKLQSSLKKYAPDSAPALAINATIEKTKRRFENYGKFGLLCGADGLPHLIVSGDQRHWGEFITPGLLFLYIAGWIGWVGRSYLIAISGEKKPAMREIIIDVELAVKLLPRGFIWPVAAYRELITGNLVVDDADIGY

SEQ ID NO: 23008 - protein, 315 aa, Rhodococcus sp. TK6
MPLFHTAGCGLVTLGALQTGGCHVIPPSFDADLLLDLFEAEQGTVMLSVPTMLIRMIERHEDQPRDVSSWRLTTLGGAPVPLDLALRARRVLGVEVGIGYGQTESSPYITHTESEDQRTQTLSTVGRPLPGIEVKIVDPNTRDVIDVGELGEVCTRSSCVMTEYFDDPRATAETIDIEGWLHTGDLGTMDAFGFVTIRGRLKDMIIWGGENIFPREIEDVLSAHPAVSAVSVVGLPDPEWGEIVAAFIVTARGAHVTEDDLATYCGAYLASYKIPRVWQFRTELPQTASGKIQKFVLRDRYLEDLRTHADQATSE

SEQ ID NO: 23009 - protein, 474 aa, Nostoc sp. PCC 7120
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPPVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 23010 - protein, 352 aa, Rhodococcus sp. TK6
MRVFAVQPDDTAIHDLEVPTPSPEGRQVLLKVVRAGVCHTDTHLRAGGYDLGSRGMMSMKARGIEYPMVLGHEVVGVVEKVGDSVESVRVGDVRLIYPWIGCGECRQCREGHDNRCAAGKNLGVARHGGYAEYILVPDEKYLVDIDGLDPSWAATLACSGLTAYSAVDKVLPLEPDEPVVVFGAGGLGLTAIAILRSRGHRNICAVDVAERNLALAQDMGASSTVLSGPGSGADDIRRAAGGPASAVIDFVNNGVTATAAFEVLAKAGIMVQVGLFGGEVTLPTALLALRMIRIEGSFVGTPAQMQELVRLAQRGALPHIPLVERPLSAAAVSQALDDLTAGGVAGRIVLTA

SEQ ID NO: 23011 - protein, 460 aa, Rhodococcus sp. TK6
MGVYTTTDPATGEEVAQYPEISDAELDELIGRSAAAYRSWRTTPLEQRRAVLARAAEIHREQADELAALLTLEMGKPITQAKGEVALVASIYQYYADHAEEFMADEPLDIAGSGTAVVRTEAIGPLVGVMPRNYPFYQVARFAAPNIALGNTIILKHARNCPQSALALERVLTEAGLPDGVYLNAFISSAQVAAAIADPRIQGVSLTGSEKAGSAVGEVAGRHMKKCVLELGGSDPFIVLGDADVDAAASAAVVGRLGNGGQACTASKRFLVEEPVYDEFVRKFLDGMTGWQPSDPASPETKLGPLSSRSAVDELDELVQDAVSHGAEVLTGGDRPDEKGAYYPPTVLVGVTPEMRAYHEELFGPVVVVHRVGSLDEAIEAANDSPFGLSSSVFTSDPDKADRVAEELETGMVWINSTSKSSPDLPFGGVKRSGVGRELARFGFNEFANKKLVRNPGGKK

SEQ ID NO: 23012 - protein, 376 aa, Pectobacterium carotovorum subsp. carotovorum
SDSRTVSEPKTPSSCTTLKADSSTATSTIQKALNNCDQGKAVRLSAGSTSVFLSGPLSLPSGVSLLIDKGVTLRAVNNAKSFENAPSSCGVVDKNGKGCDAFITAVSTTNSGIYGPGTIDGQGGVKLQDKKVSWWELAADAKVKKLKQNTPRLIQINKSKNFTLYNVSLINSPNFHVVFSDGDGFTAWKTTIKTPSTARNTDGIDPMSSKNITIAYSNIATGDDNVAIKAYKGRAETRNISILHNDFGTGHGMSIGSETMGVYNVTVDDLKMNGTTNGLRIKSDKSAAGVVNGVRYSNVVMKNVAKPIVIDTVYEKKEGSNVPDWSDITFKDVTSETKGVVVLNGENAKKPIEVTMKNVKLTSDSTWQIKNVNVKK

SEQ ID NO: 23013 - protein, 482 aa, Neisseria meningitidis
GSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASARKITKANFPWAASGRAIANGCDKPFTKLIFDAETGRIIGGGIVGPNGGDMIGEVYLAIEMGCDAADIGKTIHPHPTLGESIGMAAEVALGTCTDLPPQKK

SEQ ID NO: 23014 - protein, 295 aa, Nostoc sp. PCC 7119
DVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLEGMEEGIDAALSAAAAKEGVTWSDYQKDLKKAGRWHVETY

SEQ ID NO: 23015 - protein, 302 aa, Staphylococcus aureus
MTKTKAIDIIGAPSTFGQRKLGVDLGPTAIRYAGLISRLKQLDLDVYDKGDIKVPAVNIEKFHSEQKGLRNYDEIIDVNQKLNKEVSASIENNRFPLVLGGDHSIAVGSVSAISKHYNNLGVIWYDAHGDLNIPEESPSGNIHGMPLRILTGEGPKELLELNSNVIKPENIVLIGMRDLDKGERQFIKDHNIKTFTMSDIDKLGIKEVIENTIEYLKSRNVDGVHLSLDVDALDPLETPGTGTRVLGGLSYRESHFALELLHQSHLISSMDLVEVNPLVDSNNHSAEQAVSLGGTFFGEPLL

SEQ ID NO: 23016 - protein, 208 aa, Cicer arietinum
EVSARDLTEISSNTEKDVAEKKNEVTDANYDGFNGGGNYGNGGGYPSNGGGNYGHGGGNYGNGGGNYGHGGNGGGNYGNGGGNYGHGGGNYGHGSNGGGNYGNGGGNYGHGGGNYGHGGNGGGNYGNGGGSYGNGGGNYGHGGGNYGNGGGNYGHGGGNYGHGGGYPGNGGHGGGYPGNGGHGGGHGGHGGGYVGEATDVQREDKTLN

SEQ ID NO: 23017 - protein, 394 aa, Ipomoea batatas
MVDGNHPKVVCVTGAAGFIGSWLVMTLLQRGYHVHATVRDPGNTKKVKHLLELPKADTNLRVWKGVMEEEGSFDEAIAGCEGVFHVATPMDFDSKDPENEVIKPAINGVLNIINSCVKAKTVKRLVFTSSAGTLNVQPQQKPVYDESCWSDLDFIYAKKMTGWMYFASKILAEKEAWKATKEKKIDFISIIPPLVVGPFITPTFPPSLITALSLITGNQAHYSIIKQGQYVHLDDLCEAHIFLYEHPKAEGRFICSSHHTTIHGLGEMIRQNWPEYYIPSQFKGIEKDLPVVYFSSKKLQDMGFQFKYSLEDMYRGAIETLRKKGLLPYSTKEPAAIEEEQETVPLKVQEPTKQEATTVPLKPAAIEQKQETVPLKLEEPTAIEQKQKVVPLKA

SEQ ID NO: 23018 - protein, 263 aa, Phleum pratense
MASSSSVLLVVALFAVFLGSAHGIPKVPPGPNITATYGDKWLDAKSTWYGKPTAAGPKDNGGACGYKDVDKPPFSGMTGCGNTPIFKSGRGCGSCFEIKCTKPEACSGEPVVVHITDDNEEPIAAYHFDLSGIAFGSMAKKGDEQKLRSAGEVEIQFRRVKCKYPEGTKVTFHVEKGSNPNYLALLVKFVAGDGDVVAVDIKEKGKDKWIALKESWGAIWRIDTPEVLKGPFTVRYTTEGGTKGEAKDVIPEGWKADTAYESK

SEQ ID NO: 23019 - protein, 168 aa, Avena vaviloviana
VMASSATTVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 23020 - protein, 238 aa, Geobacillus stearothermophilus
EFIHLPLNDVDALKQAMSEEVAAVMLEVVQGEGGVRPVDPAFLQTASELCQQHGALLIIDEVQTGIGRTGKPFAYQHFDVEPDIITAAKGLGSGIPVGAMIGKAFLKESFGPGVHGSTFGGNPIAMAAAKATLEVVFDPAFLQDVQEKGRYFLARLHDALASLDIVKDVRGLGLLVGIECQTDVAPLLPLIHENGLLVLSAGPNVIRLLPLVVTKAEIDEAVDILTNVLNNANASAVL

SEQ ID NO: 23021 - protein, 354 aa, Stylosanthes humilis
MASSKAFGWAAKDASGHLSPFHFTRRQNEADDVTLKILYCGVCHSDLHTVKNDWGFTTYPVVPGHEIAGIVTKVGSNVTKFKEGDRVGVGVIVDSCQECECCQQDLESYCPKPVFTYNSPYKGTRTQGGYSDFVVVHQRFVLQFPDNLPLDAGAPLLCAGITVYSPMKYYGMTEPGKHLGVAGLGGLGHVAIKFGKAFGLKVTVISSSPNKESEAIDVLGADSFLLSSDPEKMKAATGTMDYIIDTISAVHSLVSLLGLLKLNGKLVTVGLPSKPLQLPIFPLVAGRKLIGGSNFGGLKETQEMLDFCGKHNIAANIELIKMDEINTAIERLSKADVKYRFVIDVANSLSSSNM

SEQ ID NO: 23022 - protein, 363 aa, Stylosanthes humilis
MEASQVEFEHPRKAFGWAARDSSGLLSPFNFSRRDIGEEDVALEVLYCGICHTDLHMAKNDFGNSIYPYVPGHEVIGIVAEVGSKVEKYKVGDKVGVGYFVESCRSCQNCIDNLENYCPKHILTQGDKHIDGTTTYGGYSDSMVVDEHFVTRIPEGLPLDGCGSSSLCWGYSHSPLKYYGLDKPGLHVGVVGLGGLGHMVAKFAKTHGLKITVISTSPPTKKEEAIKNLGADSFLVSRDPDQMEAPKETLDGIIDTVSADHSIVPLIGLLKSHGKLVLIGAIEKPLELPPFPLILGRKLVGGTLVGGLKETQEMIDFSPKHNVKPEIEVVPMDYVNIAMQRLAKADVKYRFVIDVANTLKPTS

SEQ ID NO: 23023 - protein, 505 aa, Candida maltosa
MAIFTPELWLICFAVTVYIFDYIYTKYLMYKLGAKPITHVIDDGFFGFRLPFLITLANNQGRLIEFSVKRFLSSPHQTFMNRAFGIPIILTRDPVNIKAMLAVQFDEFSLGLRYNQFEPLLGNGIFTSDGEPWKHSRIMLRPQFIKSQVSHVNRLEPHFNLLQKNITAQTDNYFDIQTLFFRFTLDTATEFLFGQSVHSLNDGENSLQFLEAFTKSQAILATRANLHELYFLADGIKFRQYNKMVQDFSQRCVDKVLNMSNSEIDKLDRYFFLYEMVKITRNPQVLRDQCLNILLAGRDTTASLLSFAFFELALNEPIWIKLRTEVLHVFQTSLELITFDLLKTKCPYLQAILHETLRLYPSVPRNARFSKKNTTLPHGGGVDGMSPILIKKGQPVAYFICATHVDEKFYTKDALIFRPERWCEEPLIKKNLAWSYLPFNGGPRICLGQQFALTEASYVLTRLAQCYTKISLQPNSFEYPPKKQVHLTMSLLDGVHVKISNLSIS

SEQ ID NO: 23024 - protein, 510 aa, Candida maltosa
MIDALYILIVALVIYKTAQFVHRKSLEKKHHCQPVKQIPLVSILSGLGFDMFFKDTAEMTKNGGLHKKLQQMLESLQTTTFRSRMLTGSQIVTMEPENERTMCSSAHMKDWTIGYRPFALKPLLGDGIFSSEGESWKHSRIMLRPIFAKEHIKQITAMEPYMLLLIEIIKSSSANEGPVDLQPLFHAFTIDYASDFLFGESCDVLKENLGGKSTSGMDAQVKRDFASVFNDVQNYLTKRMMLGPLAFLVSSKDFHDGIKKQHEFVSYFVQKAISMSDEELNDESKNYVFLYQLAKQTKDAKVLQDELLSILLAGRNTTASLLSFLFFELSHHENVWTTLKEVVDQSFPDVESITFETIQNCDYLRWCLFESLRVNPSVPFNSRTANKDTILPRGGGEDCSHPILVKKGDQVLFPLYASNRQEKYFGRKPEEFIPERWRDLPKTGGPAFMPFSTGPRMCLGQQFALIEASYVTIRLVQTFSKLKSHSLEYAPKRLVAATIRLIDGCFVSFE

SEQ ID NO: 23025 - protein, 198 aa, Klebsiella pneumoniae
MLTEQLDWEKTDGMMPAIVQHAVSGEVLMLGYMNKEALEKTEATGKVTFYSRTKQRLWTKGETSGNVLNVVSITPDCDNDTLLVLVNPIGPTCHKGTTSCFGETGHQWLFLYQLEQLLAERKHADPESSYTAKLYASGTKRIAQKVGEEGVETALAATVNDRFELKNEASDLMYHLLVLLQDQGLDLGEVIDNLKSRH

SEQ ID NO: 23026 - protein, 133 aa, Azotobacter chroococcum (strain mcd 1)
MKDWLDEIHWNADGLVPAIAQDHKTGRILMMAWMNRESLALTVRENRAIYWSRSRGKLWRKGEESGHLQKVHEVRLDCDADVIVLQVEQLGGIACHTGRESCFYRVFEDGAWKVVEPILKDPDAIYHAGHRHE

SEQ ID NO: 23027 - protein, 178 aa, Glycine tomentella
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYRENHRSPGYYDGRYWTMWKLPVFGCTDASQVLKELQEAKTAYPNGFIRIIGFDNVRQVQCISFIAYKPPSF

SEQ ID NO: 23028 - protein, 178 aa, Glycine tabacina
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYREHHRSPGYYDGRYWTMWKLPMFGCTDASQVLKELQEAKTAYPNAFIRIIGFDNVRQVQCISFIAYKPPSF

SEQ ID NO: 23029 - protein, 181 aa, Lactuca sativa
MASISSSAIATVNRTTSTQASLAAPFTGLKSNVAFPVTKKANNDFSSLPSNGGRVQCMKVWPPIGLKKYETLSYLPPLSDEALSKEIDYLIRNKWIPCLEFELEHGFVYREHHHSPGYYDGRYWTMWKLPMFGCTDSAQVMKEVGECKKEYPNAFIRVIGFDNIRQVQCISFIVAKPPGVL

SEQ ID NO: 23030 - protein, 180 aa, Stellaria longipes
MASSIMSSAAVATRSNGAQASMVAPFTGLKSNASFPVSRKTNLDITSIASNGGRVRCMQVWPPINMKKYETLSYLPDLSSEQLLSEIEYLLKNGWVPCLEFETEHGFVYREHTSSPGYYDGRYWTMWKLPMFGCTDATQVAAEVQEAKKAYPDAHIRIIGFDNVRQVQCISFIAYKPEAF

SEQ ID NO: 23031 - protein, 506 aa, Petroselinum crispum
MMDFVLLEKALLGLFIATIVAITISKLRGKKLKLPPGPIPVPVFGNWLQVGDDLNQRNLVDYAKKFGDLFMLRMGQRNLVVVSSPELAKDVLHTQGVEFGSRTRNVVFDIFTGKGQDMVFTVYSEHWRKMRRIMTVPFFTNKVVQQYRFGWEDEAARVVEDVKANPEAATNGIVLRNRLQLLMYNNMYRIMFDRRFESVDDPLFLKLKALNGERSRLAQSFEYHFGDFIPILRPFLRGYLKLCQEIKDKRLKLFKDYFVDERKKLESIKSVDNNSLKCAIDHIIEAQQKGEINEDNVLYIVENINVAAIETTLWSIEWGIAELVNNPEIQKKLRHELDTVLGAGVQICEPDVQKLPYLQAVIKETLRYRMAIPLLVPHMNLHDAKLAGYDIPAESKILVNAWWLANNPAHWNKPDEFRPERFLEEESKVEANGNDFKYIPFGVGRRSCPGIILALPILGIVIGRLVQNFELLPPPGQSKIDTAEKGGQFSLQILKHSTIVCKPRSL

SEQ ID NO: 23032 - protein, 505 aa, Populus kitakamiensis
MDLLLLEKTLLGSFVAVLVAILVSKLRGKRFKLPPGPLPVPVFGNWLQVGDDLNHRNLTDLAKKFGDIFLLRMGQRNLVVVSSPDLSKEVLHTQGVEFGSRTRNVVFDIFTGKGQDMVFTVYGEHWRKMRRIMTVPFFTNKVVQQYRYGWEEEAAQVVEDVKKNPEAATNGIVLRRRLQLMMYNNMYRIMFDRRFESEDDPLFNKLKALNGERSRLAQSFDYNYGDFIPILRPFLRGYLKICQEVKERRLQLFKDYFVDERKKLASTKNMSNEGLKCAIDHILDAQKKGEINEDNVLYIVENINVAAIETTLWSIEWGIAELVNHPEIQKKLRHELDTLLGPGHQITEPDTYKLPYLNAVVKETLRLRMAIPLLVPHMNLHDAKLGGFDIPAESKILVNAWWLANNPAHWKNPEEFRPERFLEEGAKVEANGNDFRYLPFGVGRRSCPGIILALPILGITLGRLVQNFELLPPPGQSKIDTSEKGGQFSLHILKHSTIVAKPRSF

SEQ ID NO: 23033 - protein, 505 aa, Populus tremuloides
MDLLLLEKTLLGSFVAILVAILVSKLRGKRFKLPPGPLPVPVFGNWLQVGDDLNHRNLTDLAKKFGDILLLRMGQRNLVVVSSPELSKEVLHTQGVEFGSRTRNVVFDIFTGKGQDMVFTVYGEHWRKMRRIMTVPFFTNKVVQQYRYGWEEEAAQVVEDVKKNPGAATHGIVLRRRLQLMMYNNMYRIMFDRRFESEEDPLFNKLKALNGERSRLAQSFDYNYGDFIPILRPFLRGYLKICQEVKERRLQLFKDYFVDERKKLASTKNMCNEGLKCAIDHILDAQKKGEINEDNVLYIVENINVAAIETTLWSIEWGIAELVNHPEIQKKLRHELDTLLGPGHQITEPDTYKLPYLNAVVKETLRLRMAIPLLVPHMNLHDAKLGGFDIPAESKILVNAWWLANNPAHWKNPEEFRPERFLEEEAKVEANGNDFRYLPFGVGRRSCPGIILALPILGITLGRLVQNFELLPPPGQSKIDTSEKGGQFSLHILKHSTIVAKPRSF

SEQ ID NO: 23034 - protein, 505 aa, Zinnia elegans
MDLLLVEKTLLALFAAIIASIFISKLRGKRFKLPPGPVPVPIFGNWLQVGDDLNHRNLTDLAKKFGEIFLLRMGQRNLVVVSSPNLAKEVLHTQGVEFGSRTRNVVFDIFTGKGQDMVFTVYGEHWRKMRRIMTVPFFTNKVVQQYRTGWEAEAAAVVDDVKKNPKAATEGVVIRKRLQLMMYNNMFRIMFDRRFESEDDPLFVKLKMLNGERSRLAQSFEYNYGDFIPILRPFLKGYLKLCKEVKEKRFQLFKDYFVDERKKLGSTKSMDNNQLKCAIDHILDAKDKGEINEDNVLYIVENINVAAIETTLWSIEWAIAELVNHPEIQAKLRHELVSQLGPGVQVTEPDLHKLPYLQAVIKETLRLRMAIPLLVPHMNLHDAKLGGYDIPAESKILVNAWWLANNPDQWKKPEEFRPERFLEEESKVEANGNDFRYLPFGVGRRSCPGIILALPILGITIGRLVQNFELLPPPGQDKVDTTEKGGQFSLHILKHSTIVAKPRVL

SEQ ID NO: 23035 - protein, 462 aa, Escherichia coli
MTITPATHAISINPATGEQLSVLPWAGADDIENALQLAAAGFRDWRETNIDYRAEKLRDIGKALRARSEEMAQMITREMGKPINQARAEVAKSANLCDWYAEHGPAMLKAEPTLVENQQAVIEYRPLGTILAIMPWNFPLWQVMRGAVPIILAGNGYLLKHAPNVMGCAQLIAQVFKDAGIPQGVYGWLNADNDGVSQMIKDSRIAAVTVTGSVRAGAAIGAQAGAALKKCVLELGGSDPFIVLNDADLELAVKAAVAGRYQNTGQVCAAAKRFIIEEGIASAFTERFVAAAAALKMGDPRDEENALGPMARFDLRDELHHQVEKTLAQGARLLLGGEKMAGAGNYYPPTVLANVTPEMTAFREEMFGPVAAITIAKDAEHALELANDSEFGLSATIFTTDETQARQMAARLECGGVFINGYCASDARVAFGGVKKSGFGRELSHFGLHEFCNIQTVWKDRI

SEQ ID NO: 23036 - protein, 360 aa, Amycolatopsis methanolica
PQTVRGVIARSKGAPVELTDIVIPDPGPSEVTALIATCAVCHTDLTYREGGINDEFPFLLGHEAAGTVESVGEGVDSVQPGDYVVLNWRAVCGQCRACKRGRPQYCFSTFNATQKMTLTDGTELTPALGIGAFADKTLVHAGQCTKVDPAADPAVAGLLGCGVMAGLGAAVNTGAVSRGDSVAVIGCGAVGDAVIAGARLAGANKIIAVDRDAKKLEWATELGATHTVNATETDVVEAVQALTGGFGADVVIDAVGRPETWKQAFYARDLAGTVVLVGVPTPDMRLEMPLLDFFSRGGALKSSWYGDCLPERDFPVLIDLHLQGRLPLDKFVTERISLDDVEKAFHTMHAGEVLRSVVVW

SEQ ID NO: 23037 - protein, 242 aa, Cyanidium caldarium
MFIAYLTAGAPDLNTTKQALLNLANDGADVIEIGVPYSDPLADGMILQKASQQALKNRFRLEQLWHLLAEIELPVPVVILAYYNQIFHYGVEKWVTTLVNLKVKALIVPDLPYEEAAILRAACARHHLHMIWLISPTTPKVRAKQLALACDDWIYLVSRTGVTGVDAHFDNQIPNMIAELKQVTTTPIALGFGIHQKQQLQLVKSWGADGVIIGTACMQILLEKGVDQLTEWISAMKKSSYP

SEQ ID NO: 23038 - protein, 461 aa, Escherichia coli
MAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVALSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYDGDRTPVSET

SEQ ID NO: 23039 - protein, 298 aa, Escherichia coli
MIRVACVGITVMDRIYYVEGLPTESGKYVARNYTEVGGGPAATAAVAAARLGAQVDFIGRVGDDDTGNSLLAELESWGVNTRYTKRYNQAKSSQSAIMVDTKGERIIINYPSPDLLPDAEWLEEIDFSQWDVVLADVRWHDGAKKAFTLARQAGVMTVLDGDITPQDISELVALSDHAAFSEPGLARLTGVKEMASALKQAQTLTNGHVYVTQGSAGCDWLENGGRQHQPAFKVDVVDTTGAGDVFHGALAVALATSGDLAESVRFASGVAALKCTRPGGRAGIPDCDQTRSFLSLFV

SEQ ID NO: 23040 - protein, 415 aa, Brachyspira hyodysenteriae
AGTWAAKTLKATDPNCQVVTYDRNDNISFLACGIALWVGGVVKDPKGLFYASPESLRGEGIDVYMGHDVTKIDWANKKLCVKELKTGKEFEDTYDKLILATGSWPVTPPIEGLKQEGTTYGLKKGIFFSKLYQQGQEIIDEIAKPDVKKVMVVGAGYIGVELIEAFKNHGKEVILMEAMPRVMANYFDKEITDEAEKRIKEAGIEMHLGETVKKFEGDDRVKKVVTDKGSYDVDMVVMSVGFRPNNELYKDYLETLPNGAIVVDTTMKTTKDPDVFAIGDCATVYSRASEKQEYIALATNAVRMGIVAANNALGKHVEYCGTQGSNAICVFGYNMASTGWSEETAKKKGLKVKSNFFKDSERPEFMPTNEDVLVKIIYEEGSRRLLGAQIASKHNHAEAIHAFSLAIQNGMTVDQ

SEQ ID NO: 23041 - protein, 420 aa, Brachyspira hyodysenteriae
AGTWAAKTLKATDPNCQVVTYDRNDNISFLACGIALWVGGVVKDPKGLFYASPESLRGEGIDVYMGHDVTKIDWANKKLCVKELKTGKEFEDTYDKLILATGSWPVTPPIEGLKQEGTTYGLKKGIFFSKLYQQGQEIIDEIAKPDVKKVMVVGAGYIGVELIEAFKNHGKEVILMEAMPRVMANYFDKEITDEAEKRIKEAGIEMHLGETVKKFEGDDRVKKVVTDKGSYDVDMVVMSVGFRPNNELYKDYLETLPNGAIVVDTTMKTTKDPDVFAIGDCATVYSRASEKQEYIALATNAVRMGIVAANNALGKHVEYCGTQGSNAICVFGYNMASTGWSEETAKKKGLKVKSNFFKDSERPEFMPTNEDVLVKIIYEEGSRRLLGAQIASKHNHAEAIHAFSLAIQNGMTVDQFALSD

SEQ ID NO: 23042 - protein, 452 aa, Brachyspira hyodysenteriae
MKVIVIGCNHAGTWAAKTLKATDPNCQVVTYDRNDNISFLACGIALWVGGVVKDPKGLFYASPESLRGEGIDVYMGHDVTKIDWANKKLCVKELKTGKEFEDTYDKLILATGSWPVTPPIEGLKQEGTTYGLKKGIFFSKLYQQGQEIIDEIAKPDVKKVMVVGAGYIGVELIEAFKNHGKEVILMEAMPRVMANYFDKEITDEAEKRIKEAGIEMHLGETVKKFEGDDRVKKVVTDKGSYDVDMVVMSVGFRPNNELYKDYLETLPNGAIVVDTTMKTTKDPDVFAIGDCATVYSRASEKQEYIALATNAVRMGIVAANNALGKHVEYCGTQGSNAICVFGYNMASTGWSEETAKKKGLKVKSNFFKDSERPEFMPTNEDVLVKIIYEEGSRRLLGAQIASKHNHAEAIHAFSLAIQNGMTVDQFALSDFFFLPHYNKPLSWMTMVAYTAK

SEQ ID NO: 23043 - protein, 421 aa, Brachyspira murdochii
  misc_feature (381)..(381): Xaa can be any naturally occurring amino acid
TWAAKTLKATDPNCQVVTYDRNDNISFLACGIALWVGGVVKDPKGLFYASPESLKAEGIDVYMGHDVTKIDWANKKLHVKELKTGKEFDDNYDKLILATGSWPVTPPIEGLMQEGTEYGLKKGIFFSKLFQQGQEIIDEIAKPEVKKVMVVGAGYIGVELIEAFKNHGKEVILMEAMPRVMANYFDKEITDEAEKRIKEAGIEMHLGETVKKFEGDDRVKRVVTDKGSYDVDMVVMSVGFRPNSELYKDYLETLPNGAIKVDTTMKTTKDPNVFAIGDCATVYSRASGKEEYIALATNAVRMGIVAANNALGKHVEYCGTQGSNAICVFGYNMASTGWSEETAKKKGLKVKSNFFKDAERPEFMPSYEDVLVKIIYEEDTXRMVGAQIASKHNHAEAIHAFSLAIQNGMTVDQFALSDFFF

SEQ ID NO: 23044 - protein, 413 aa, Brachyspira innocens
WAAKTLKATDPNCQVVTYDRNDNISFLACGIALWVGGVVKDPKGLFYASPESLKAEGIDVYMGHDVTKIDWANKKLHVKELKTGKEFDDNYDKLILATGSWPVTPPIEGLMQEGTEYGLKKGIFFSKLFQQGQEIIDEIAKPEVKKVMVVGAGYIGVELIEAFKNHGKEVILMEAMPRVMANYFDKEITDEAEKRIKEAGIEMHLGETVKKFEGDDRVKKVITDKGSYDVDMVVMSVGFRPNSELYKDYLETLPNGAIKVDTTMKTTKDPNVFAIGDCATVYSRASGKEEYIALATNAVRMGIVAANNALGKHVEYCGTQGSNAICVFGYNMASTGWSEETAKKKGLKVKSNFFKDAERPEFMPSYEDVLVKVIYEEDTRRMVGAQIASNHNHAEAIHAFSLAIQNGMTVDQF

SEQ ID NO: 23045 - protein, 416 aa, Brachyspira innocens
HAGTWAAKTLKATDPNCQVVTYDRNDNISFLACGIALWVGGVVKDPKGLFYASPESLKAEGIDVYMGHDVTKIDWANKKLHVKELKTGKEFDDNYDKLILATGSWPVTPPIEGLMQEGTEYGLKKGIFFSKLFQQGQEIIDEIAKPEVKKVMVVGAGYIGVELIEAFKNHGKEVILMEAMPRVMANYFDKEITDETEKRIKEAGIEMHLGETVKKFEGDDRVKKVITDKGSYDVDMVVMSVGFRPNSELYKDYLETLPNGAIKVDTTMKTTKDPNVFAIGDCATVYSRASGKEEYIALATNAVRMGIVAANNALGKHVEYCGTQGSNAICVFGYNMASTGWSEETAKKKGLKVKSNFFKDAERPEFMPSYEDVLVKIIYEEDTRRMVGAQIASNHNHAEAIHAFSLAIQNGMTVDQ

SEQ ID NO: 23046 - protein, 423 aa, Brachyspira pilosicoli
AGTWAAKTLKATDPNCQVVTYDRNDNISFLACGIALWVGGVVKDPKGLFYASPEGLKSEGIEVYMGHEVTKIDWANKKMTVKELKTGKEFEDNYDKLILATGSWPVTPPIEGLKQEGTTYGLKKGIFFSKLYQQGQDIIDEIAKPEVKRVMVVGAGYIGVELIEAFKNHGKEVILMEAMPRVMANYFDKEITDEAEKRIKDAGIELHLGETVKKFEGDDRVKKVVTDKGSYDVDMVVMSVGFRPNSELYKDYLETLPNGAIVVDTTMKSSKDENVYAIGDCSSVYSCSSKSHEYIALATNAVRMGIVAANNILGKKVNYCGTQGSNAICVFGYNMASTGWSEETAKKKGLKVKSNFFRDAERPEFMPTYEDVLVKIVYEEGTGRLLGAQIASKHNHAEAIHAFSLAIANEMTVQDFALSDFFF

SEQ ID NO: 23047 - protein, 407 aa, Brachyspira pilosicoli
TWAAKTLKATDPNCQVVTYDRNDNISFLACGIALWVGGVVKDPKGLFYASPEGLKSEGIEVYMGHEVTKIDWANKKMTVKELKTGKEFEDNYDKLILATGSWPVTPPIEGLKQEGTTYGLKKGIFFSKLYQQGQDIINEIAKPEVKKVMVVGAGYIGVELIEAFKNHGKEVILMEAMPRVMANYFDKEITDEAEKRIKDAGIELHLGETVKKFEGDDRVKKVVTDKGSYDVDMVVMSVGFRPNSELYKDYLETLPNGAIVVDTTMKSSKDENVYAIGDCSSVYSCSSKSHEYIALATNAVRMGIVAANNILGKKVNYCGTQGSNAICVFGYNMASTGWSEETAKKKGLKVKSNFFRDAERPEFMPTYEDVLVKIVYEEGTGRLLGAQIASKHNHAEAIHPFSLAIAN

SEQ ID NO: 23048 - protein, 421 aa, Brachyspira pilosicoli
AGTWAAKTLKATDPNCQVVTYDRNDNISFLACGIALWVGGVVKDPKGLFYASPEGLKSEGIEVYMGHEVTKIDWANKKMTVKELKTGKEFEDNYDKLILATGSWPVTPPIEGLKQEGTTYGLKKGIFFSKLYQQGQDIIDEIAKPEVKRVMVVGAGYIGVELIEAFKNHGKEVILMEAMPRVMANYFDKEITDEAEKRIKDAGIELHLGETVKKFEGDDRVKKVVTDKGSYDVDMVVMSVGFRPNSELYKDYLETLPNGAIVVDTTMKSSKDENVYAIGDCSSVYSCSSKSHEYIALATNAVRMGIVAANNILGKKVNYCGTQGSNAICVFGYNMASTGWSEETAKKKGLKVKSNFFRDAERPEFMPTYEDVLVKIVYEEGTGRLLGAQIASKHNHAEAIHAFSLAIANEMTVQDFALSDF

SEQ ID NO: 23049 - protein, 422 aa, Brachyspira pilosicoli
AGTWAAKTLKATDPNCQVVTYDRNDNISFLACGIALWVGGVVEDPKGLFYASPEGLKSEGIEVYMGHEVTKIDWANKKMTVKELKTGKEFEDNYDKLILATGSWPVTPPIEGLKQEGTTYGLKKGIFFSKLYQQGQDIINEIAKPEVKRVMVVGAGYIGVELIEAFKNHGKEVILMEAMPRVMANYFDKEITDEAEKRIKDAGIELHLGETVKKFEGDDRVKKVVTDKGSYDVDMVVMSVGFRPNSELYKDYLETLPNGAIVVDTTMKSSKDENVYAIGDCSSVYSCSSKSHEYIALATNAVRMGIVAANNILGKKVNYCGTQGSNAICVFGYNMASTGWSEETAKKKGLKVKSNFFRDAERPEFMPTYEDVLVKIVYEESTGRLLGAQIASKHNHAEAIHAFSLAIANEMTVQDFALSDFF

SEQ ID NO: 23050 - protein, 415 aa, Brachyspira intermedia
  misc_feature (38)..(38): Xaa can be any naturally occurring amino acid
AGTWAVKTLKATDPNCQVVTYDRNDNISFLACGIALWXGGVVKDPKGLFYANPEGLTSEGIEVHMGHDVTKIDWANKKLHVKELKTGKEFEDNYDKLILATGSWPVTPPIEGLKQEGTTYGLKKGIFFSKLYQQGQEIIEELKKPEVKKVMVVGAGYIGVELIEAFKNHGKEVILMEALPRVMGNYFDKEITDEAEKRIKEAGIEMHLGETVKKFEGDDRVKKVITDKGSYDVDMVVMSVGFKPNSDLYKDYLETLPNGAIIVDTTMKTSKDPDVYAIGDCASVYSCSSKNNEYIALATNAVRMGIVAANNILGKKVNYCGTQGSNAICVFGYNMASTGWSEETAKKKGLKVKSNFVKDAERPEFMPTYEDVLVKIIYMEDTGRIVGAQIASKHNHAEAIHAFSIAIANEMTVQD

SEQ ID NO: 23051 - protein, 415 aa, Brachyspira intermedia
HAGTWAVKTLKATDPNCQVVTYDRNDNISFLACGIALWVGGVVKDPKGLFYASPESLKSEGVEVHMGHDVTKIDWANKKLYVKELKTGKEFEDTYDKLILATGSWPVTPPIEGLKQEGTTYGLKKGIFFSKLYQQGQEIIEELKKPEVKKVMVVGAGYIGVELIEAFKNHGKEVILMEALPRVMGNYFDKEITDEAEKRIKEAGIEMHLGETVKKFEGDDRVKKVVTDKGSYEVDMVVMSVGFKPNSDLYKDYLETLPNGAIVVDTTMKTSKDPDVYAIGDCASVYSRASEKQEYIALATNAVRMGIVAANNALGKHVEYCGTQGSNAICVFGYNMASTGWSEETAKKKGLKAKSNFFKDSERPEFMPTHEEVLVKIVYEEDTGRLLGAQIASKNNHAEAIHAFSIAIQRGMTVQ

SEQ ID NO: 23052 - protein, 423 aa, Brachyspira intermedia
  misc_feature (387)..(387): Xaa can be any naturally occurring amino acid
AGTWAVKTLKATDPNCQVVTYDRNDNISFLACGIALWVGGVVKDPKGLFYASPESLKSEGVEVHMGHDVTKIDWANKKLYVKELKTGKEFEDTYDKLILATGSWPVTPPIEGLKQEGTTYGLKKGIFFSKLYQQGQEIIEELKKPEVKKVMVVGAGYIGVELIEAFKNHGKEVILMEALPRVMGNYFDKEITDEAEKRIKEAGIEMHLGETVKKFEGDDRVKKVVTDKGSYEVDMVVMSVGFKPNSDLYKDYLETLPNGAIVVDTTMKTSKDPDVYAIGDCASVYSRASEKQEYIALATNAVRMGIVAANNALGKHVEYCGTQGSNAICVFGYNMASTGWSEETAKKKGLKAKSNFFKDSERPEFMPTHEEVLVKIVYEEDTGRLLXAQIASKNNHAEAIHAFSIAIQRSMTVQEFALSDFFS

SEQ ID NO: 23053 - protein, 424 aa, Brachyspira murdochii
HAGTWAAKTLKATDPNCQVVTYDRNDNISFLACGIALWVGGVVKDPKGLFYASPESLKAEGIDVYMGHDVTKIDWANKKLHVKELKTGKEFDDNYDKLILATGSWPVTPPIEGLMQEGTEYGLKKGIFFSKLFQQGQEIIDEIAKPEVKKVMVVGAGYIGVELIEAFKNHGKEVILMEAMPRVMANYFDKEITDEAEKRIKEAGIEMHLGETVKKFEGDDRVKRVVTDKGSYDVDMVVMSVGFRPNSELYKDYLETLPNGAIKVDTTMKTTKDPNVFAIGDCATVYSRASGKEEYIALATNAVRMGIVAANNALGKHVEYCGTQGSNAICVFGYNMASTGWSEETAKKKGLKVKSNFFKDAERPEFMPSYEDVLVKIIYEEDTRRMVGAQIASKHNHAEAIHAFSLAIQNGMTVDQFALSDFFF

SEQ ID NO: 23054 - protein, 421 aa, Brachyspira alvinipulli
  misc_feature (14)..(14): Xaa can be any naturally occurring amino acid
AGTWAAKTLAASKXKCEVVTYDRNDNISFLACGIALWVGGVVKDPKGLFYASPESLKSEGIDVHMGHEVMKIDWANKKLHIKELKTGKEFDDNYDKLILATGSWPVTPPIEGLMQEGTTYGLKKGIFFSKLYQQGQEIIDEIAKPDVKRVMVVGAGYIGVELIEAFKNHGKEVILMESMPRVMANYFDKEITDEAEKRIKEAGIEMHLGETVKKFEGDDRVKKVVTDKGSYDVDMVVMSVGFRPNSELYKDYLETLPNGAIVVDTTMKTSKDENVYAIGDCSTVYSRASEKQEYIALATNAVRMGIVAANNIVGNKVEYCGTQGSNAICVFGYNMASTGWSEDTAKKKGLKVKSNFFKDAERPEFMPTHEDVLVKIVYEEGTGRLLGAQIASKNNHAEAIHAFSLAIQRGMTVQEFALSDF

SEQ ID NO: 23055 - protein, 420 aa, Serpulina sp. P280/1
WAAKTLKATDPNCKVVTYDRNDNISFLACGIALWVGGVVKDPKGLFYATPESLKGEGIDVYMGHEVMKIDWANKKLHVKELKTGKEFEDTYDKLILATGSWPVTPPIEGLKQEGTEYGLKKGIFFSKLFQQGQDIINEIAKPEVKKVMVVGAGYIGVELIEAFKNHGKEVILMEAMPRVMANYFDKEITDEAEKRIKEAGIEMHLGETVKKFEGDDRVKKVVTDKGSYDVDMVVMSVGFRPNSELYKDYLETLPNGAIVVDTTMKSSKDPDVYAIGDCATVYSRASEKQEYIALATNAVRMGIVAANNALGKHVEYCGTQGSNAICVFGYNMASTGWSEETAKKKGLKAKSNFFKDSERPEFMPGNEDVLVKIVYEEGTGRLLSAQIASEHNHAEAIHAFSLAIQRSMTVQEFALSDFFF

SEQ ID NO: 23056 - protein, 418 aa, Brachyspira aalborgi
HHAGTWAAKTLKAVDSSTTVVTYDRNDNISFLACGIALWVGGVVKDPKGLFYANPEGLKSEGIDVHMGHEVVKIDWANRKLTVRELITGKEFEDNYDKLILATGSWPVTPPIEGLMQPGTKYGLKEGIFFSKLFQQGQEIIDEIKRPEVKRVMVVGAGYIGVELVEAFKNHGKEVILMEAMPRVMANYFDKEITDEAEKRIKEAGIELHLGETVKKFEGSVRVQKVVTDKGSYDVDMVVMSVGFRPNSELYKDYLETLPNGAIVVDTTMKTTKDPNVFAIGDCSTVYSRASEKQDYIALATNAVRMGIVAANNALGRHVEYCGTQGSNAICVFGYNMASTGWSEETAKKKGLNVKSNFFKDAERPEFMPTYEDVLVKIIYEEGSRRMIGAQIASKHNHAEAIHAFSLAIQNGMTVDHL

SEQ ID NO: 23057 - protein, 178 aa, Zea mays
MALTRIGLAGLAVMGQNLALNIAEKGFPISVYDRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARDGPSLMPGGSFEAYKYIEDILLKVAAQVPDSGPCVTYIGK

SEQ ID NO: 23058 - protein, 178 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGK

SEQ ID NO: 23059 - protein, 169 aa, Leavenworthia stylosa
NTEIVGMIHDGESRFSIKGKPIHHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVPKVIAEMTNGGVDRSVECTGSVQAMIQAFECVHD

SEQ ID NO: 23060 - protein, 169 aa, Leavenworthia stylosa
DTDRVGMIHDGESRFSIKGKPIHHFLGTSTFSEYTVVHSGQVAKINPEAPLDKVCIVSCGLSTSLGATLNVAKPKKGQSVAVFGLGAVGLGAAEGARIAGASRIIGVDLNSNRFEQAKKFGVTEFVNPKEHDKPVQQVIAEMTNGGVDRSVECTGSVRAMIQAFECVHD

SEQ ID NO: 23061 - protein, 169 aa, Leavenworthia stylosa
NTDRVGMIHDGESRFSIKGKPINHFLGTSTFSEYTVVHSGQVAKINPEAPLDKVCIVSCGLSTGLGATLNVAKPKKGQSVAVFGLGAVGLGAAEGARIAGASRIIGVDLNSNRFEQAKKFGVTEFVNPKEHDKPVQQVIAEMTNGGVDRSVECTGSVQAMIQAFECVHD

SEQ ID NO: 23062 - protein, 313 aa, Cicer arietinum
ETVAIKKVLQDKRYKNRELQTMRLLDHPNVVTLKHCFFSTTEKDELYLNLVLEYVPETVYRVIRHYSKMNQRMPLIYVKLYFYQICRALAYIHNCVGVSHRDIKPQNLLVNPHTHQLKLCDFGSAKVLVKGEPNISYICSRYYKAPELIFGATEYTTAIDIWSAGCVLGELLLGQPLFPGASGVDQLVEIIKVLGTPTREEIKCMNPNYTEFKFPQIKAHPWHKIFRKRMPPEAVDLVSRLLQYSPNLRSTALEALVHPFLDELRDPNTRLPNGRHLPPLFNFKANELKGVSAEMLVKLIPLHARKQCALFVS

SEQ ID NO: 23063 - protein, 181 aa, Cicer arietinum
MASSMISSSAVTTVKRASSVPSGAVAPFVGLKSMAGFPVRKVNNDITSIASNGGRVHCMQVWPPIGKKKFETLSYLPPLTEEQLLKEVEYLLRKGWVPCLEFELEKGFVYREHNNSPGYYDGRYWTMWKLPLFGCTEAVQVLKELQEVVKAYPNAFVRIIGFDNVRQVQCISFIAHTPKEF

SEQ ID NO: 23064 - protein, 361 aa, Arabis stelleri
CKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSEESNMCDLLRINTERGGMIHDGESRFSIDGKPIYHFAGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEQYMNKELEIEKFITHAVPFSEINKAFDYMLKGEG

SEQ ID NO: 23065 - protein, 361 aa, Arabis glabra
CKAAVAWKAGKPLVMEEVEVAPPQKHEVRIKILFTSLCHTDVYFWEAKGQTPLGPRIFGHEAGGIVESVGEGVTDLQPGDHVLPIFTGECGDCRHCHSEESNMCDLLRINTERGGMIHDGESRFSINGKPIYHFPGTSTFSEYTVVHSGQVAKINPDAPLDKVCIVSCGLSTGLGATLNVAKPKKGQSVAIFGLGAVGLAAAEGARIAGASRIIGVDLNSKRFDQAKEFGVTEFVNPRDHDKPVQQVLAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGES

SEQ ID NO: 23066 - protein, 361 aa, Arabis flagellosa
CKAAVAWEAGKPLVMEEVEVAPPQKHEVRIKILFTSLCHTDVYFWEAKGQTPWFPRIFGHEAGGIVESIGEGVTDLAPGDHVLPIFTGECGDCPHCHSEESNMCDLLRINTERGGMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGES

SEQ ID NO: 23067 - protein, 361 aa, Arabidopsis lyrata subsp. kawasakiana
CKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVWIVSCGLSSGLGATLNVAKPKKGQSVAIFGLGAVGLAAAEGARIAGASRIIGVDLNPQRFDQAKEFGVTEFVNPRDHDKPVQQVIAEMTNGGVDRSVECTGSVQPMIQAFECVHDGWGVAVLVGVPSKDDAFKTHPMNFLNERTLKGTFFGNYKPKTDIPGVVEKYMNKELELEKFITHTLPFSEINKAFDYMLKGES

SEQ ID NO: 23068 - protein, 359 aa, Arabis hirsuta
  misc_feature (134)..(134): Xaa can be any naturally occurring amino acid
  misc_feature (255)..(255): Xaa can be any naturally occurring amino acid
  misc_feature (314)..(314): Xaa can be any naturally occurring amino acid
IRCKAAVAWEAGKPLVMEEVEVAPPQKHEVRIKILFTSLCHTDVYFWEAKEQTPLFPRIFGHEAGGIVESVGEGVTDLAPGDHVLPIFTGECGDCPHCHSEESNMCDLLRINTERGGMIHDGESRFSIDGEPIXHFVGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTXGGVDRSVECTGSVQAMIQAFECVHDGWGVAVLVGVPSKDDAFKTHPMNSLNERTLKGTXFGNYNPKTDIPGVVEQYMNKELEIEKFITHAVPFSEINKAFDYML

SEQ ID NO: 23069 - protein, 363 aa, Crucihimalaya himalaica
  misc_feature (17)..(17): Xaa can be any naturally occurring amino acid
  misc_feature (253)..(253): Xaa can be any naturally occurring amino acid
  misc_feature (350)..(350): Xaa can be any naturally occurring amino acid
IRCKAAVAWEAGKPLVXEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSIKGKPIHHFLGTSTFSEYTVVHSGQVAKINPDAPLDKVCIVSCGLSTGLGAVLNVAKPKKGQSVAVFGLGAVGLAAAEGARIAGASRIIGVDLNSKRFDEAKKFGVTEFVNPRDHDKPVQQVIAEXTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSXINKAFDYMLKGES

SEQ ID NO: 23070 - protein, 363 aa, Olimarabidopsis pumila
IRCKAAVAWEAGKPLVMEEVEVAPPQNHEVRIKILFTSLCHTDVYFWEAKGQTPLFPRIFGHEAGGIVESVGEGVTDLQPGDHVLPIFTGECGDCRHCHSGESNMCDLLRINTERGGMIHDGESRFSINGKPIHHFLGTSTFSEYTVVQSGQVAKINPDAPLDKVCIVSCGLSTGLGATLNVAKPKKGQSIAIFGLGAVGLAAAEGARIAGASRIIGVDLNSKRFDQAKEFGVTEFVNPRDHDKPVQQVIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 23071 - protein, 362 aa, Arabidopsis korshinskyi
RCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSKRFDQAKEFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 23072 - protein, 363 aa, Crucihimalaya wallichii
IRCKAAVAWEAGKPLVMEEVEVAPPQKHEVRIKILFTSLCHTDVYFWEAKAQTPLFPRIFGHEAGGIVESVGEGVTDLQPGDHVLPIFTGECGDCRHCHSEESNMCDLLRINTERGGMIHDGESRFSIKGKPIHHFLGTSTFSGYTVVHSGQVAKINPDAPLDKVCIVSCGLSTGLGAVLNVAKPKKGQSVAVFGLGAVGLAAAEGARIAGASRIIGVDLNSQRFDEAKEFGVTEFVNPRDHDKPVQQVIAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGES

SEQ ID NO: 23073 - protein, 363 aa, Arabidopsis suecica
IRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSGYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPKDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGES

SEQ ID NO: 23074 - protein, 350 aa, Brassica oleracea
  misc_feature (227)..(227): Xaa can be any naturally occurring amino acid
PLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGAKIAGAGRIIGVDLNPKRFEEAKEFGVTEFVNPXEHDKPVQQVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGES

SEQ ID NO: 23075 - protein, 506 aa, Pseudomonas aeruginosa
MIYAAPGTPGAVVTFKPRYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAESIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDIDPLGFF

SEQ ID NO: 23076 - protein, 310 aa, Streptomyces coelicolor A3(2)
MPASYAYLGPEGTFTEVALRTLPETATRELVPYVSVQSALDAVRTGEAEAAFVPIENSVEGGITTTLDELVAGQPLMIYREVLLSITFALLVRPGTKLSDIKTVTAHPAAQPQVRNWIKAHLPDVAWESAASNADGARLVQEGRYDAAFAGEFAAERYGLEVLEADIHDAENAQTRFVLVGRPARPAAPTGADKTSVVLWQRDDHPGGLRDLLGEFATRGINLMLLQSRPTGAGIGNYCFCIDAEGHISDRRVADALMGLKRTCLQVRYLGSYPRAEVTPADVDALRPGTSDEAFVAAADWVARCQDGRF

SEQ ID NO: 23077 - protein, 150 aa, Shigella sonnei
VVVQTKDAVLIADRNAVQDVKKVVEQIKADGRHEHRVHREVYRPWGKYDSIDAGDRYQVKRITVKPGEGLSVQMHHHRAEHWVVVAGTAKVTIDGDIKLLGENESIYIPLGAMHCLENPGKIPLDLIEVRSGSYLEEDDVVRFADRYGRV

SEQ ID NO: 23078 - protein, 466 aa, Clavija eggersiana
SVGFKAGVKDYKLTYYTPDYHTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPNAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGAPIIMHDYLTGGFTANTSLAHYARDNGLLLHIHRAMHAVIDRQKNHGMHFRVLAKPLRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 23079 - protein, 327 aa, Schizosaccharomyces pombe
MTSGSPKITNLLTRVKRIIPPLLDTFHKGQAGRVGVFGGCQHYTGAPYYSSMSSMLFGSDQSHIFCEKEAANVIKSYSPDLIVHPFLREKDKAGPEDSVDKCFELIKPMMGRLHAIVIGPGLGRDEWMQEIMAKVIEYARKNDMPMVIDADGLWLIQQRPELVSGYHNVILTPNVIEFKRLCDKLDIKSDGPDACNQLAGKLNLLIIQKGQSDIISDGATAYACSVPGGLKRCGGQGDILTGILATFLAWRHAYLSKEWDTEGNMDAKECLFLAAFGASACTRWCSRLAFKECGRATQSTDLVRHVGKAYNALMEDEIPSVEEKIKD

SEQ ID NO: 23080 - protein, 227 aa, Schizosaccharomyces pombe
MAYYNNPANLQYYDYSYTADNSFNTQSRAAGFYDEPLHEPLSQGWLAAFSTSGYPGEPSLLEELEINFGHIKQKTTHVLNPFKHVDVHIMDDTDMAGPILFCLLFSTFLSLHGRSHFGYIYGIALLGSLSLHFVLRLMSAKNLFFTRTVSVLGYSLLPLVVIAFFKNIFTFNGIAGYALAALACIWCTYAASAMFVGILQVNNMRFLVAYPIALFYGVFAVITVFSK

SEQ ID NO: 23081 - protein, 429 aa, Schizosaccharomyces pombe
MPVESEHFETLQLHAGQEPDAATSSRAVPIYATTSYVFRDCDHGGRLFGLQEPGYIYSRMMNPTADVFEKRIAALEHGAAAIATSSGTSALFMALTTLAKAGDNIVSTSYLYGGTYNLFKVTLPRLGITTKFVNGDDPNDLAAQIDENTKAVYVESIGNPMYNVPDFERIAEVAHAAGVPLMVDNTFGGGGYLVRPIDHGADIVTHSATKWIGGHGTTIGGVIVDSGKFDWKKNSKRFPEFNEPHPGYHGMVFTETFGNLAYAFACRTQTLRDVGGNANPFGVFLLLQGLETLSLRMERHVQNAFALAKYLEKHPKVNWVSYPGLESHVSHKLAKKYLKNGYGAVLSFGAKGGPDQSRKVVNALKLASQLANVGDAKTLVIAPAYTTHLQLTDEEQISAGVTKDLIRVAVGIEHIDDIIADFAQALEVA

SEQ ID NO: 23082 - protein, 351 aa, Streptomyces clavuligerus
VSTAVSPRYAQPATFMRLRHRPDPIGHDVVVVGAPYDGGTSYRPGARFAPRAIRHESSLIHGVGIDRGPGVFDRIDVVDGGDIDLSPFSMDLAMDTATVALTRLLERNDAFLMLGGDHSLSLAALRAVHARHGRVAVLHLDAHSDTNPPVYGGTYHHGTPFRWAIEEGLVDPERLVQVGIRGHNPRPDSLDYARGHGVSIVTAADFTRRSPRGIAEQIRRTVGGLPLYVSVDIDVVDPAYAPGTGTPAPGGLSSREVLTLLDVVGQLRPVGFDVVEVSPAYDPSGITSLLAAEIGAELLYQYARATTSPASAPVDSPLPPGAAADDAENAENAVDAVDAESAVDFAGQRWG

SEQ ID NO: 23083 - protein, 478 aa, Salmonella typhimurium LT2
MRQTKLYPVVMAGGSGSRLWPLSRVLYPKQFLCLKGDLTMLQTTICRLNGVECESPLVICNEQHRFIVAEQLRQLNKLTENIILEPAGRNTAPAIALAALAATRQHTDCDPLMLVLAADHAIANEEAFRDAVRGAMPYADAGKLVTFGIVPDLPETGYGYIRRGDVVPGATDAVAFEVAQFVEKPGLETAQAYVASGDYYWNSGMFLFRAGRYLEELKKFRPDILAACEQAMRGVDPDLDFIRVDEEAFLACPEESIDYAVMERTADAVVMPMDAGWSDVGSWSSLWEISAHTPEGNVHHGDVISHKTENSYVYAESGLVTTVGVKDLVVVQTKDAVLIADRHAVQDVKKVVEKIKADGRHEHHMHREVYRPWGKYDSIDAGERYQVKRITVKPGEGLSVQMHHHRAEHWVVVAGTARVTINGEVKLLGENESIYIPLGATHCLENPGKIPLDLIEVRSGSYLEEDDVVRFEDRYGRV

SEQ ID NO: 23084 - protein, 445 aa, Salmonella typhimurium LT2
MSQQHTTQASGQGMLERVFKLREHGTTARTEVIAGFTTFLTMVYIVFVNPQILGVAGMDTSAVFVTTCLIAAFGSILMGLFANLPVALAPAMGLNAFFAFVVVQAMGLPWQVGMGAIFWGAVGLLLLTIFRVRYWMIANIPVSLRVGITSGIGLFIGMMGLKNAGVIVANPETLVSIGNLTSHSVLLGVLGFFIIAILASRNIHAAVLVSIIVTTLLGWMMGDVHYNGIVSAPPSVTSVVGHVDLAGSFNLGLAGVIFSFMLVNLFDSSGTLIGVTDKAGLADEKGKFPRMKQALFVDSISSVTGAFVGTSSVTAYIESSSGVSVGGRTGLTAVVVGILFLLVIFLSPLAGMVPPYAAAGALIYVGVLMTSSLARVNWQDLTESVPAFITAVMMPFSFSITEGIALGFISYCVMKIGTGRLRDLSPCVVIVALLFVLKIVFIDAH

SEQ ID NO: 23085 - protein, 300 aa, Salmonella typhimurium LT2
MTMVRIACVGITVMDRIYYVEGLPTEGGKYVAKRYTEVGGGPAATAAVAAAKLGAQVDFIGRVGDDDTGNSLLAELESLGVNTRYTRRYTQAMSSQSAIMVDAKGERIIVNYPSPDLLPDADWLNDIDFSQWDVVLADVRWHDGAKQAFTLARQAGVMTVLDGDITPQDISELVALSDHAAFSEPGLARLTGMSEAIDALKKAQMLTNGHVYVTRGSEGCNWLEKAAVRHQPGFTVEVVDTTGAGDVFHGALAFGLASGYAIEEAVRFASGVAALKCTRPGGRAGIPDCEQTRSFLSLFV

SEQ ID NO: 23086 - protein, 512 aa, Catharanthus roseus
MALEKLVLFDFLAAISILILVQKFIQIVFLRSSSRIRLPPGPKGWPIIGALPYLGTMPHSILANMAKKYGPIMYLKLGTNGMVVASTPDAVKAFLRTLDMNFSNRPIDAGATHLAYNAQDMVFAHYGPKWKLLRKLSNLHMLGGKALENWSNVRATELGYMLQAMYESSRKGETVVVPEMLTYAMANMIGQVILSRRVFVTKSLESNEFKDMVVELMTTAGYFNIGDFIPSIAWMDLQGIERGMKRLHKKFDALLTKMLEEHKSSSHKRKEKPDFLDYVLANRDNSEGERLTTTNIKALLLNLFTAGTDTSSSVIEWAISEMLKNPTILKRAQEEMDQVIGRNRRLMESDIPKLPYLQAICKETFRKHPSTPLNLPRIAQKDCQVNGYYIPKGTRLSVNIWAIGRDPNVWENPLEFNPDRFLSGKMAKIEPRGNDFELIPFGAGRRICAGTRMGIVLVEYILGTLVHSFDWKLPFDDINELNMDESFGLALQKAVPLVAMVSPRLPINAYSP

SEQ ID NO: 23087 - protein, 400 aa, Streptomyces rochei
MTRTSLPFPDGFLWGASTAAHQIEGNNVNSDWWRKEHDPAANIAEPSLDACDSYHRWEQDMDLLAELGFTDYRFSVEWARIEPVPGTFSHAETAHYRRMVDGALARGLRPMVTLHHFTVPQWFEDLGGWTADGAADLFARYVEHCAPIIGKDVRHVCTINEPNMIAVMAGLAKTGDQGFPPAGLPTPDEETTHAVIAAHHAAVKAVRAIDPDIQVGWTIANQVYQALPGAEDVTAAYRYPREDVFIEAARGDDWIGVQSYTRTKIGADGPIPAPEDAERTLTQWEYYPAAVGHALRHTADVAGPDMPLIVTENGIATADDARRVDYYTGALEAVSAALEDGVNIHGYLAWSALDNYEWGSYKPTFGLIAVDPVTFERTAKPSAVWLGEMGRTRQLPRAER

SEQ ID NO: 23088 - protein, 342 aa, Pseudomonas aeruginosa
MTLPQTMKAAVVHAYGAPLRIEEVKVPLPGPGQVLVKIEASGVCHTDLHAAEGDWPVKPPLPFIPGHEGVGYVAAVGSGVTRVKEGDRVGIPWLYTACGCCEHCLTGWETLCESQQNTGYSVNGGYAEYVLADPNYVGILPKNVEFAEIAPILCAGVTVYKGLKQTNARPGQWVAISGIGGLGHVAVQYARAMGLHVAAIDIDDAKLELARKLGASLTVNARQEDPVEAIQRDIGGAHGVLVTAVSNSAFGQAIGMARRGGTIALVGLPPGDFPTPIFDVVLKGLHIAGSIVGTRADLQEALDFAGEGLVKATIHPGKLDDINQILDQMRAGQIEGRIVLEM

SEQ ID NO: 23089 - protein, 336 aa, Aspergillus niger
STCTFTSASEASESISSCSDVVLSSIEVPAGETLDLSDAADGSTITFEGTTSFGYKEWKGPLIRFGGKDLTVTMADGAVIDGDGSRWWDSKGTNGGKTKPKFMYIHDVEDSTFKGINIKNTPVQAISVQATNVHLNDFTIDNSDGDDNGGHNTDGFDISESTGVYISGATVKNQDDCIAINSGESISFTGGTCSGGHGLSIGSVGGRDDNTVKNVTISDSTVSNSANGVRIKTIYKETGDVSEITYSNIQLSGITDYGIVIEQDYENGSPTGTPSTGIPITDVTVDGVTGTLEDDATQVYILCGDGSCSDWTWSGVDLSGGKTSDKCENVPSGASC

SEQ ID NO: 23090 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQQFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 23091 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDQGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 23092 - protein, 366 aa, Streptomyces hygroscopicus
MPERDALLTDLVGDRAAEWDTSGELPRDLLVRLGADGLLCAEVAAEHGGLGLGSRENGEFTAHVGSLCSSLRSVMTSQGMAAWTVQRLGDAGQRATFLKELTSGKLAAVGFSERQAGSDLSAMRTRVRLDGDTAVVDGHKVWTTAAAYADHLVVFGLQEDGSGAVVVVPADTPGVRVERVPKPSGCRAAGHADLHLDQVRVPAGAVLAGSGASLPMLVAASLAYGRKSVAWGCVGILRACRTAAVAHARTREQFGRPLGDHQLVAGHIADLWTAEQIAARVCEYASDHWDEGSPEMVPATILAKHVAAERAAAGAATAAQVLASAGAREGHVVERAYRDAKLMEIIEGSSEMCRVMLAQHALALPA

SEQ ID NO: 23093 - protein, 367 aa, Aspergillus oryzae
MHFQLLGLAALGSLAAAAPAPSRTSELVERGSSCTFTSAAQASASAKSCSNIVLKNIAVPAGETLDLSKAKDGATITFEGTTTFGYKEWKGPLIRFGGNKITVTQAAGAVIDGQGSRWWDGKGTNGGKTKPKFIYGHKLQSSTIKGLHVKNYPVQVFSVQGNDVHLTDITIDNSDGDNNGGHNTDAFDVSESNGVYITGANVKNQDDCLAINSGENIEFTGATCSGGHGISIGSIGNRDSNTVKNVKVADSTVVDSDNGIRIKTISGATGSVSGVTYENITLKNIKKNGIVIEQDYKNGGPTGKPTTGVPITDLTVNGVTGSVASKATPVYILCGKGSCSDWTWKGVSISGGKKSDKCQNIPSGASC

SEQ ID NO: 23094 - protein, 287 aa, Pichia angusta
MEVCITTQSIDNGVGAASMFACLFTHPLDLAKVRLQTAKVPGDSLVSLAYKIVKTEGVLAAYAGLSASLLRQATYSTARFGVYEKLKGIMTDPTKGQASTFQLLAASMIAGAVGGVVGNPADVVNIRMQNDNSLPESQRRHYKHALDGLLKITREENITALFRGLGPNLARGILMTASQVVSYDVAKKLLVENLSMDPKTKATHFSASLIAGLVATTVCSPADVLKTRIMNSSGTGQSSFGILKDAISREGLGFMFRGWTPAFIRLGPHTILTFIALEELRRLKIGL

SEQ ID NO: 23095 - protein, 356 aa, Beta vulgaris
MTTMNPFDLLGDNDNDDPSQLLESATAQLQKIAVKKTPTQVAQQPQQQKAAKLPTKPLPPTQAVREAKNDSQRGGGRGGGRGSGRGRGGYNRDYSNNENAFNSTGVTGSQGDDGERERRPYAGPRGPYRGGRRDGFNNEEGRDGERPRRTYERRSGTGRGSEIKREGAGRGNWGAESDEVAPVTEEAGEQNEKKLNPENLPAVEDAADGIKEGQPDETEEKEPEEKEMTLEEYEKLLEEKRKALSALKAEERKVEVDKDFESMQQLINKKKDEDSVFIKLGSDKDKKKEAAEKEKVKKSVSINEFLKPAEGDRYGGRGRGRGRGPRGGGYGGGNRMFSTSAPAIEDPGEFPTLGGK

SEQ ID NO: 23096 - protein, 356 aa, Beta vulgaris
MATTNPFDLLDDDAEDPALLIAAQEQKVSAVVAGDKKTPAVAAKPAKLPTKPLPPSQAVREARNDGGRGGGGRGGRGYGRGRGPGGPNRDSTNNDEIYPNENGGSMGYREDRDKPSERRGGYGGPRGGYRGGRRGGYDNGEAAEGERPRRMYERRSGTGRGGEIKREGSGRGNWGSPTDEIAPETEEPVVENEAAVAADKPAGEGENVDAEKESQEKEVVEAEPEEKEMTLEEYEKVLEEKRKALLSLKGEERKVDLDKEFESMQLVSKKKNDDEVFIKLGSDKDKRKEAAEREERSKKSVSINEFLKPAEGDGYHRRGRGRGRGGRGGYGGGYGMNNASAPSIEDPNQFPSLGAN

SEQ ID NO: 23097 - protein, 454 aa, Streptomyces parvulus
MEKTDVDRLRTLDREHMWYPWTPMTEWMARDQLVVERAEGCWLIDADGKRYLDGRSSMGMNLHGHGRSEIVEALVAQARKAGETTLYRVSHPAAVELAARLASMAPAGLQRVFFAESGSTAVETALKAAYAYWVAKGEPQRSTFVSMEGGYHGETLGTVSLRGTNGEQVDMIRKTYEPLLFPSLSFHQPHCYRCPVGQSSDSDCGLECTDSLENLLTREKGRIAAVIVEPRVQALAGVITAPEGHLAKVAEITRRHGVLLIVDEVLTGWARTGPTFSCEAEGVTPDLMTVGKALTGGYLPLSATLATEEIFGAFRESVFLSGSTYSGYALGAAVALASLDLFEKEDVPARAKALADVLTTALEPFRALTHVGDVRQLGLIAGVELVADRETRAPYPPQERVVDRICTLARDNGVLVNAVPGDVITMLPSPSMSPDDLRFLTGTLYTAVREVTEE

SEQ ID NO: 23098 - protein, 330 aa, Streptomyces parvulus
MKGLMRAAVIRAWGGPERLTLDRVERPSPPPGWIAVRVEACALNHLDIHVRNGLPGVRLELPHVSGGDVVGVVEQATDEAGERLLGSRVLLDPMIGRGILGEHYWGGLAEYVVAPAHNALPVPDQDADPARYAALPISYGTAQRMLFSRARLRPGESVLLFGATGGVGVACAQLALRAGARIIACSGSPAKLARLRRLGVIDTIDTGTEDVRRRVRELTDGGADLVVDYQGKDTWPVSLRSARAGGRIVTCGATTGYEATTDLRYVWSRQLDILGSNAWHRDDLHTLVDLVATDALEPVVHADFPLSRAPEAVAELEERRAFGKVVIRTA

SEQ ID NO: 23099 - protein, 467 aa, Streptomyces parvulus
MPTPAPDHAPAQRAAPLAVVDPATGTVFDEAPDQGPDVLDAVVDRARRAWHGWRADPDARTTALRSAADAVEAAGDDLARLLTREQGKPLAESHAEVARTAARLRYFAGLAPRTRRITDGRPVRSEVRWRPLGPVAAIVPWNFPLQLASAKFAPALAAGNTMVLKPSPFTPLATRLLGSVLATALPEDVLTVVTGREPLGARLAAHPGIRHVTFTGSVPTGRAVARAAAASLARVTLELGGNDAAVLLDDVEVDRIADRLFWAAFRNCGQVCMAVKRVYAPARLHAQVVEALTERAKAVAVGPGLDPRTRLGPVANAPQLARVEQITRRALADGARAAAGGHRLDGPGCFFAPTILTDVPPDSPVVTEEQFGPVLPVLPYRSLDEAVDAANGTGFGLGGSVWGTDLDRAEAVADRLECGTAWVNHHAELSLAQPFAGDKDSGVGVAGGPWGLYGNLRPFVVHRPRGE

SEQ ID NO: 23100 - protein, 372 aa, Streptococcus ratti
MNIQPFGVEEWLNVWENDAIYDIAGSSISSMTLKEILSIGDKPQEVLIDELLKKKMNYGWIEGSPDFKEEVAKLYDHAKPNQILQTNGATGANFLALYALIERGDHIISLYPTYQQLYDIPRSFGAEVDFWEIKEENNWLPSLDDLQHLIKPNTKMICINNANNPTGAVMDRSFLEKLVELARAADIYILSDEVYRPLEEELDVPAIYDLYDKGISTHSLSKTYSVPGVRVGWIVANDELSDLFRKYRDYTMICAGVFDDYIATHILKNKDRVIERNKKIVSENLQIVKDWVAKEPRVSLVVPKKVSTSFIKLDIPEETEPFCIRLLKEKGVLLVPGNRFDLPGYARLGYCTDKATLIKGLSELSEFLRQFD

SEQ ID NO: 23101 - protein, 178 aa, Escherichia coli
GKGTQAQFIMEKYGIPQISTGDMLRAAVKSGSELGKQAKDIMDAGKLVTDELVIALVKERIAQEDCHNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAG

SEQ ID NO: 23102 - protein, 178 aa, Escherichia coli
GKGTQAQFIMEKYGIPQISTGDMLRVAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAG

SEQ ID NO: 23103 - protein, 178 aa, Escherichia coli
GKGTQAQFIMEKYGIPQISTGDMLRAAVKSGSELGKQAKDIMDAGKLVTDELVIALVKERIAQEDCRYGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAG

SEQ ID NO: 23104 - protein, 343 aa, Phytophthora infestans
MFSSSKIAAVCLAVVALTNSAYAEKEAAQTFGLLGAGLHGGAGLYGAGAAGLHGGAGVGAGLYGRGAGYGGAGAGLYGRGAGGVGAGLYGRGAGYGGAGAGLYGRGAGGVGAGLYGRGAGYGGAGAGLYGRGAGGVGAGLYGRGAAYGGAGAGLFGREAGYGGAGAGVGAGVGGAGLGNGYGGVGVGGTTGVGAGAGVGGGVSGNVGAGVGVGGNAAVGAGVGGAANGGVGANAGVGAGVSGNTGAGVGGGASGGANGGVSANAGVGGGVGGSAGVGGSVGVGGAASTGAGGATTTTDGRTSTSTSQNGGPRQLQLPRLQARPRTAGTGASTKQTGYRMLRSQ

SEQ ID NO: 23105 - protein, 336 aa, Mannheimia haemolytica
MSVLTINHLNLNFGSTKVLQNLHLAVNQNEIICLLGASGCGKTTLLKAIAGLLPIEQGDIHLAGECLKSKAVEERQIGLIFQDYALFPHLTVADNIQFGLSKLPKVQQKAITEKMLSVVHLQGFESRFPHELSGGQQQRVAIARALACQPELLLLDEPFSNIDSQTRYAMIQEIKQILKSQNVPAIFVTHSKEEAFAFADKIAVMDQGKIIQFGKPNELYHSPVNPFVADFLGGTNYLNCNVTEDNVLCSPIGEFRLFPEMNVQKGRYRWLLRPEQIILKPNELGLGKVVGKLFLGLYYRYQVEIKGIEIVTYQSQELKIGEQVEVGFQVREFILF

SEQ ID NO: 23106 - protein, 391 aa, Pseudomonas alcaligenes
DLEGVGFDTLAVRAGQHRTPEGEHGEAMFLTSSYVFRSAADAAARFAGEQPGNVYSRYTNPTVRAFEERIAALEGAEQAVATASGMAAILAIVMSLCSAGDHVLVSRSVFGSTISLFEKYLKRFGIEVDYPPLADLDAWQAAFKPNTKLLFVESPSNPLAELVDIGALAEIAHARGALLAVDNCFCTPALQQPLALGADMVMHSATKFIDGQGRGLGGVVAGRRAQMEQVVGFLRTAGPTLSPFNAWMFLKGLETLRIRMQAQSASALELARWLETQPGIDRVYYAGLPSHPQHELAKRQQSAFGAVLSFEVKGGKEAAWRFIDATRVISITTNLGDTKTTIAHPATTSHGRLSPQERASAGIRDNLVRVAVGLEDVVDLKADLARGLAAL

SEQ ID NO: 23107 - protein, 168 aa, Avena agadiriana
VMASSATTVAPFQGLKSTAGLPVSRRSSGSLGSVSNGGRIRCMQVWPIEGIKKFETLSYLPPLSEEALLKQIEFLIRSKWVPCLEFSKVGFIFREHGSTPGYYDGRYWTMWKLPMFGCTDASQVIKEVEEVKKEYPDAYVRIIGLDNIRQVQCVSFIAFKPPGCEESG

SEQ ID NO: 23108 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEDVKKKYPDAYVRIIGFVNIRQVQCVSFIAFKPPGCEESG

SEQ ID NO: 23109 - protein, 168 aa, Avena clauda
VMASSATTVAPFQGLKSTAGLPVSRRSSASLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 23110 - protein, 327 aa, Fortunella margarita
MSNTSLLSLFFFLCLCISPSLSDLCNPNDKKVLLKFKKALNNPYVLASWNPKTDCCDWYCVTCDLTTNRINSLTIFAGDLPGQIPPEVGDLPYLDTLMFHKLPSLTGPIQPAIAKLKNLKTLRISWTNISGPVPDFISQLTNLTFLELSFNNLSGTIPGSLSKLQKLGALHLDRNKLTGSIPESSGTFTGSIPDPYLSHNQLSGKIPASLGSMDFNTIDLSRNKLEGDASFLFGLNKTTQRIDVSRNLLEFNLSKVEFPESLTNLDLNHNKIFGSIPAQITSLENLGFLNVSYNRLCGPIPVGGKLQSFGYTEYFHNRCLCGAPLER

SEQ ID NO: 23111 - protein, 377 aa, Schizosaccharomyces pombe
MATSQVLHILPKPSYEHAFNSQRTEFVTTTATNQVELYEQDGNGWKHARTFSDHDKIVTCVDWAPKSNRIVTCSQDRNAYVYEKRPDGTWKQTLVLLRLNRAATFVRWSPNEDKFAVGSGARVISVCYFEQENDWWVSKHLKRPLRSTILSLDWHPNNVLLAAGCADRKAYVLSAYVRDVDAKPEASVWGSRLPFNTVCAEYPSGGWVHAVGFSPSGNALAYAGHDSSVTIAYPSAPEQPPRALITVKLSQLPLRSLLWANESAIVAAGYNYSPILLQGNESGWAHTRDLDAGTSKTSFTHTGNTVEGREEEGPVSFTALRSTFRNMDLKGSSQSISSLPTVHQNMIATLRPYAGTPGNITAFTSSGTDGRVVLWTL

SEQ ID NO: 23112 - protein, 504 aa, Rhizobium leguminosarum
MSNHLFDAMRAAAPGNAPFIRIDNTRTWTYDDAFALSGRIASAMDALGIRPGDRVAVQVEKSAEALILYLACLRSGAVYLPLNTAYTLAELDYFIGDAEPRLVVVASSARAGVETIAKPRGAIVETLDAAGSGSLLDLARDEPADFVDASRSADDLAAILYTSGTTGRSKGAMLTHGNLLSNALTLRDFWRVTAGDRLIHALPIFHTHGLFVATNVTLLAGASMFLLSKFDPEEILSLMPQATMLMGVPTFYVRLLQSPRLDKQAVANIRLFISGSAPLLAETHTEFQARTGHAILERYGMTETNMNTSNPYEGKRIAGTVGFPLPDVTVRVTDPATGLALPPEQTGMIEIKGPNVFKGYWRMPEKTAAEFTADGFFISGDLGKIDRDGYVHIVGRGKDLVISGGYNIYPKEVEGEIDQIEGVVESAVIGVPHPDFGEGVTAVVVRKPGAALDEKAIVSALQDRLARYKQPKRIIFAEDLPRNTMGKVQKNILRQQYADLYTRT

SEQ ID NO: 23113 - protein, 376 aa, Penicillium griseoroseum
MASSLKLGLIALLGATAVNAAPAAEPVLGTSLLTSRASCTFSGSSGAAEAIKSKTSCSTITLSNVEVPAGTTLDLTGLKSGTTVIFEGTTTFGYKEWEGPLVSVSGTSITVQGASGAQLNGDGARWWDGKGTNGGKTKPKFFYAHSLTNSKIENIYIKNSPVQVFSINGAKELTLSGITVDTADGDSNGGHNTDAFDVGSSNGVYITSPIVHNQDDCLAVNSGTNVHFTGAQCTGGHGISIGSVGGRSDNTVDGVTVESCTIKDSDNGVRIKTVYGATGTVQGVTYKDITLSGIAKYGIVIEQDYENGSPTGTPTSGVPITDLTLDNVHGTVASSGVDTYILCASGACSDWSWSGVSITGGQTSKKCKGIPSGASC

SEQ ID NO: 23114 - protein, 475 aa, Fagopyrum cymosum
MSPQTETKASVGFKAGVKEYKLTYYTPDYEPHDHDILAAFRVTPQPGVPPEEAGAAVAAESSTGTWTTVWTDGLTSLDRYKGRCYHIEPVPGEENQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALFKSQVETGEIKGHYLNATAGTCEEMIKRAVFARELGVPIVMHDYLTGGFTANTTLAHYCRDNGLLLHIHRAMHAVIDRQKNHGIHFRVLAKALRLSGGDHIHSGTVVGKLEGERDITLGFVDLLRDDFVEKDRSRGIYFTQPWVSLPGVIPVASGGIHVWHMPALTEIFGDDSVLQFGGGTLGHPWGNAPGAVANRVALEACVQARNEGRDLAREGNDIIRKAAKWSPELAAACEVWKEIKFEFQAMDTL

SEQ ID NO: 23115 - protein, 475 aa, Fagopyrum tataricum subsp. potanini
MSPQTETKASVGFKAGVKEYKLTYYTPDYEPHDHDILAAFRVTPQPGVPPEEAGAAVAAESSTGTWTTVWTDGLTSLDRYKGRCYHIEPVPGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALFKSQVETGEIKGHYLNATAGTCEEMIKRAVFARELGVPIVMHDYLTGGFTANTSLAHYCRDNGLLLHIHRAMHAVIDRQKNHGIHFRVLAKALRLSGGDHIHSGTVVGKLEGERDITLGFVDLLRDDFVEKDRSRGIYFTQPWVSLPGVIPVASGGIHVWHMPALTEIFGDDSVLQFGGGTLGHPWGNAPGAVANRVALEACVQARNEGRDLAREGNDIIRKAAKWSPELAAACEVWKEIKFEFQAMDTL

SEQ ID NO: 23116 - protein, 258 aa, Clusia minor
CEEIGRGRFGVVYKCTKLSTNETYALKSIVKNSLNDDLLDARCLVTEPKILRHVSPHPHVTQLHDSHEDDCYLHLIIDLCPNGDLYTLLLSTGPIPEAQSKAQFVQLMKAVSHCHKSGVVHRDIKPDNILFDSRESLKLADFGSAECGKGSDLNGVVGTPYYVAPEILEGREYGEKVDVWSAGVVLYVMLAGFPPFYGETVVEIFEAVLRGNLRFPTRAFCTVSSSVKDLLRRILCRDVSRRFTADQVLRHPWVTSGG

SEQ ID NO: 23117 - protein, 260 aa, Clusia minor
CEEIGRGRFGVVYKCTKLSTNETYALKSIVKNSLNDDLLDARCLVTEPKILRQVSPHPHVTQLHDSHEDDCYLHLIIDLCPNGDLYTLLLSTGPIPEAQSKAQFVQLMKAVSHCHKSGVVHRDIKPDNILFDSRESLKLADFGSAEVICGKGSDLNGVVGTPYYVAPEILEGREYGKKVDVWSAGVVLYVMLAGFPPFYGETVVEIFEAVLRGNLRFPSRAFCTVSSSVKDLLRRILCRDVSRRFTADQVLRHPWVTSGG

SEQ ID NO: 23118 - protein, 477 aa, Lycopersicon esculentum
MGLISKIATNDGHGENSAYFDGWKAYENDPFHPTQNPNGVIQMGLAENQLCFDLIQEWIVNNPKASICTYEGVQDFQDTAIFQDYHGLPEFRKAVARFMEKVRGDRVRFDPERIVMSGGATGAHESLAFCLADPGDAFLVPTPYYPGFDRDLRWRTGVQLFPVVCESSNNFKVTKEALEEAYSKAQESNIKVKGLLINNPSNPLGTILDKETLKDILRFINDKNIHLVCDEIYAATAFSQPSFISISEVKSEVVGCNDDLVHIVYSLSKDLGFPGFRVGIIYSYNDAVVNIARKMSSFGLVSTQTQRLIASMLLDTIFVEDFIAKSSMRLLQKHGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 23119 - protein, 321 aa, Dianthus caryophyllus
MANIVNFPIIDMEKLNNYNGVERSLVLDQIKDACHNWGFFQVVNHSLSHELMDKVERMTKEHYKKFREQKFKDMVQTKGLVSAESQVNDIDWESTFYLRHRPTSNISEVPDLDDQYRKLMKEFAAQIERLSEQLLDLLCENLGLEKAYLKNAFYGANGPTFGTKVSNYPPCPKPDLIKGLRAHTDAGGIILLFQDDKVSGLQLLKDGHWVDVPPMKHSIVVNLGDQLEVITNGKYKSVMHRVIAQTDGNRMSIASFYNPGSDAVIYPAPTLVEKEEEKCRAYPKFVFEDYMNLYLKLKFQEKEPRFEAMKAMETTGPIPTA

SEQ ID NO: 23120 - protein, 327 aa, x Doritaenopsis sp.
MESGSFPVINMELLQGSQRPAAMALLRDACENWGLYELLNHGISHELMNRVETVNKEHYRRFREQRFKEFASKTLDTVENVEPENLDWESTFFLRHLPTSNISQIPDLDDDCRSTMKEFALELENLAERLLDLLCEDLGLEKGYLKKVFCGGSDGLPTFGTKVSNYPPCPKPELIKGLRAHTDAGGIILLFQDDKVSGLQLLKDGEWIDVPPVRHSIVVNIGDQLEVITNGKYKSVLHRVVAQTDGNRMSIASFYNPGSDAVIFPAPALVEKEAEEKEEKKKEIYPKFVFQDYMNLYIRKKFEAKEPRFEAMKSMEIVMSSQPIPTA

SEQ ID NO: 23121 - protein, 251 aa, Bifidobacterium longum
MIKVSVVGAKGRMGLHVVEAVNNAEDTQLALALDAGDDLTQITTDNTDVVVEFTVPSVSLNNVLTLIGQGVDVVVGTTGWTDEKLAQVKSAIANGPKPETQKVFIAPNFAISAVLADYFATKAAKYFESAEVIELHHPTKVDAPSGTAIHTAHGIAEARKAAGLAPVPDATETDGGSRGQVVDGIHVHAVRLRGLNAHEEVLFGNAGEQLTIRADSFDRTSFMPGVLLAVRKLAGDAPAGLTIGLDHFLDL

SEQ ID NO: 23122 - protein, 1039 aa, Nostoc sp. PCC 7120
MNNGKVRIYELSKELNLDNKELLAICDQLNIAVKSHSSTISESEAESIRAAAEKLAATNGTSKKELNATSHKPNSAPAGSRNRPAPPQKQQQILEIRKPKILRNTTSNAPEASVANNQIASSEANSPAPPRPFATPVSPMKPTAPSRPVPRNLSETPQKPAAPEAEPEAQSQAPAKIAVEKPEKSAQPRPGKPERQPKPQLVAPPSRPTAEKLDLSEITGAPGEKPILKRDRPRREDERDQAKPRVAKPAQGETSSAPVQKQARPAQGLVKPEQRVNRPGAPSGDGIRPQRPVRPSADAAPVATPPRGVPGGGRGEAGDTAAIAPDLLDLKRPTPPRLAKGGKKWQEEEIIDEIKEKAGKAGVKGKRVKPLVEDDFEDEDLLDEEGLEIPATVQVSLSIARPPKPKAARSASAATAAPISSPTTRGKRSSHNNRDQNRRQETEVKRERPEKVAVTGAMTVQELADLMAVADTEIVKILFMKGMAVSITQNLDIPTITLVGKELEIEVETAEPEAEARKVTEMIEVGDLEHLLRRPPVVTIMGHVDHGKTTLLDSIRKTKVAAGEAGGITQHIGAYHVDIVHDGKEQQIVFLDTPGHEAFTAMRARGARVTDIAVLVVAADDGVRPQTVEAISHAQAAGVPIVVAINKIDKEGAQPDRVKQELTQYGLTSEEWGGETIMVPVSAIRGENLDTLLEMILLVAEVGELSANPDRNARGTVIEAHLDKAKGAVATLLIQNGTLHVGDILLAGSAFGKVRAMVDDRGRRVDIAGPSFAVEVLGLSDVPAAGDEFEVFDNEKEARALASDRADKQRLSRLLQGRVTLTTLSAQAQEGELKELNLILKGDVQGSVEAIVGSLKQIPQNEVQIRMLLTAAGEITETDIDLAAASGAVIIGFNTTFASGARQAADEAGVDVREYNIIYKLIEDIQGALEGLLEPELVEEPLGQTEVRAVFPVGRGAVAGCYVQSGKLVRNCKVRVRRAGKVIYEGVLDSLKRMKDDAREVNAGYECGIGVDKFHDWAEGDIIESYQMVTKRRTLALTR

SEQ ID NO: 23123 - protein, 1009 aa, Caulobacter vibrioides
MSDENENGRPGGRTPMTLKPRQGSVSAGVVKQSFSHGRTKTVVVETKRTRTHAPASGNLAAPSSAERRHGEAPAPRPAPPQGGGGGSAGGLSQEELRARQRVVDAAREAQARQVAEQAAAEARARAAQEAAQREAAAKAAAERAAAAPPPVAQAPAAPAPAAPVTPPPAAPQAPRPVAQAPVAPSAPRQDAPRQDTRAAAPGQTRTYEPSRDRRDDRPSTTTYRPAPQGDRPFNQRAPRPDANANFGQRAPRPEGDRPRGPRPDGDRPQGDRGGYRGDRPQGDRPQGDRPQQTVRYSALAPRPAPGARGPGGPPRGPRPGVPAAAPATPEIQRATRSAPRPGGGAMDRRPDEDDDRRKNAAPNKAVSRVKGAPQRREGRLTIQAVAGDGDSADRMRSLASVRRAREREKEKRRGGAVEQARVAREVVIPDVITVQELSNRMAVRGVDIIKFLMRQGVMLKINDVIDNDTAELVATEFGHTVKRVSEADVEEGFIGADDHDEHMDLRPPVVTIMGHVDHGKTSLLDALRSTDVAAGEAGGITQHIGAYQVRLKDGQRVTFLDTPGHAAFSSMRARGANITDIVVLVVAGDDGVMPQTIEAIKHAKAAEVPIIVAVNKMDKPGSDPTRVVNELLQHEIVVESLGGDTQLIEVSAKARTGLDNLLEAILLQAEVLDLKANPDRSADGVVIEAKLDKGRGAVSTVLVNRGTLKRGDIVVAGSQWGKVRALLNERNEQLQEAGPATPVEILGLDGVPSPGDAFAVVENEARARELTEYRIRLKREKSMAPVGAGASMADMMAKLQDKKLKELPLVIKADVQGSAEAIIGSLDKMATDEVRARIILSGAGAISESDVMLAKGAGAPVIGFNVRASAQARALAEREGVEIRYYAIIYDLLDDIKGVLSGMLAPIQRETFLGNAEVLQAFDISKIGKVAGCKVTEGVVRKGAKVRIIRQDIVVLELGTLQTLKRFKDEVNEVPVGQECGMMFAGFQDIKVGDTIECFTVEEIKRQLD

SEQ ID NO: 23124 - protein, 382 aa, Vibrio vulnificus YJ016
MSDPIIIIGSGFAAYQLVKSVRRLDAHIPIQIFTADDGAEYNKPDLSHVFSKRQTAADLVVKSGEAFATEHNVQLHAHTQVERVLTQQQQVVANGRCYPYSKLVFATGAQAFVPPMRGDGLAKVMTLNSLQEYQAAEQPLSRAQHVLVIGGGLIGVEIALDLATSGKQVTVVEPNARLLANLLPEFIALPLEQQLMKHGIQLALNSRVESVTVQGQTLAIALHDGREFAVDAVLCAAGLKANTAVAREAGLSVERGICVDLQLNTSDPHIYALGDCAQIEGRMLPYLQPIVLSANVLAKQLVGQEARLTLPPMMVKVKTPSYPIQLAGDFSPESHWQVQLSPEGIVAKAQSSLGDFTGFVVTGEYVTQAFPLLRELSQRANG

SEQ ID NO: 23125 - protein, 241 aa, Prochlorococcus marinus subsp. pastoris str. CCMP1986
MRKSVIAGNWKMHMTCADTKKYLEEFLPLIEEIPNDRKIVIAPPFTAISTFSNYTNFDYLNIASQNIHWEDKGAFTAEISPNMLIEHKVKYAIVGHSEPRKYFSESDEQINKRAVFAQSSGLTPIVCVGETLEQRERGEADRVITRQVEQGLENTDPSNLIVAYEPIWAIGTGKTCEASDANKICALIRSLIGFSDVIIQYGGSVKPNNIDEIMSMSDIDGVLVGGSSLDPISFSRIANFE

SEQ ID NO: 23126 - protein, 466 aa, Shigella flexneri
MPHSYDYDAIVIGSGPGGEGAAMGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIESCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 23127 - protein, 278 aa, Rhodopseudomonas palustris CGA009
MTTRIDTRFGELKQQGRPALVTFVMAGDPDLDTSLQILKVLPAAGADVIEIGMPFTDPMADGPAIQAAGLRALKAGTTLKKTLGLVRDFRATDNATPLVLMGYYNPIYIYGVDAFLADAKAAGVDGLIIVDLPPEEDEELCLPAMKAGLNFIRLATPTTDEKRLPAVLANTSGFVYYVSITGITGSASADASAVGAAVQRIKRHTNLPVCVGFGIRTPDAAQAIAAQANGAVVGSALIDALKASLNAEGRATKATVGAVADLVASLAAGVRGAKQAAE

SEQ ID NO: 23128 - protein, 503 aa, Rhodopseudomonas palustris CGA009
MINIATRINPAIAPAVSEVISQLQARHLIGNTLVPSVGGATLDVIDPATGQVIGKAPAASGDDVARAVEAASAAFPGWAATPARQRGKLIAAAASAIAERSDVIATVLALETGKAIRTECRGEVATAIDITTMYAGLASELKGETLPFDPQILTYTSREPLGVVAAILPWNVPLVLMMLKIAPALVAGNTVVVKASEEAPYATIEMARLMARLLPDGVLNVICGTGRDCGAALVEHPAVAKVTFTGSQAVGELIYQMAAKKIIPVSLELGGKSPMIVYPDADMARVVAGAIAGMRFTRQGQSCTAASRIYVHTTLIDAFVAALREAVSKLKIGDPLDEATDIGTVISPRQKAKVESYIDLGARTAGAKVDRCGELPGAAHLKDGLFLQPTIITGVPEDSPLMREEIFGPVVCVQPWDDEDDVIARANDSDFGLAATVWTNDLRSALRTVQRLDAGYVQVNQNLTIQPNLSYGGFRKSGLGKEASLEAMLEHFTKKKTVVIDMR

SEQ ID NO: 23129 - protein, 231 aa, Rhodopseudomonas palustris CGA009
MSGPLLQFRDVQFGYQAPLLRGISFDVAAGSITAVMGPSGSGKSTLLALAAGLLTPDAGAVHRRSARLGMVFQDPALLPWRTALDNVAFPLIALGLRQRERRDRARAMLAAVGLSGDDVGKYPRQLSGGMRQRVALARALVIEPDLLLCDEPFSALDALVRAGLWQVLRDIHDRRGLTMLIVTHDGPEAMQCDRLAILSAGRLEQVGAPAEILRHPASDVVRTFVAAATGN

SEQ ID NO: 23130 - protein, 504 aa, Rhodopseudomonas palustris CGA009
MQSRRPVMLVILDGWGWREDPADNAVLQAKTPTFDALWTNGPHAFLRTSGKSVGLPNGQMGNSEVGHLNIGAGRVVMQDLPRISDAIANGEIERAPGLVAFIDKLKASGGTCHLMGLVSPGGVHSLQDHACALAKILAKAGVKTVLHAFTDGRDTPPKSAVDDIVRLRAELPPNVPIATVSGRYYAMDRDNRWERVSKAYGVIADADGPRFADANAVIADGYAAGVNDEFIVPAVIGDYQGMRDGDGVLCFNFRADRVREILAALLDSAFAGFPRKQVKQIAAAAGMTQYSTALDALMGTIFPPQSLVNGLGQVVADAGLHQLRMAETEKYPHVTYFLNGGEEVPYPGEDRIMVPSPKVATYDLQPEMSAPELGDKAVAAIESGKYDLIVLNFANPDMVGHTGSLPAAIKAVETVDTQLGHIVAAIRKAGGALLVTADHGNCEMMRDPETGGPHTAHTTNPVPVLLVGDNGPLADGQLSDLAPTLLKLMELPQPAEMTGKSLIG

SEQ ID NO: 23131 - protein, 394 aa, Rhodopseudomonas palustris CGA009
MTESSHSPGFATTAIHHGYDPLAHHGALNPPLFLTSTYAFASAAEGAARFAGEAEGFVYSRVGNPTVAVLESRLAALEGGEAALATASGVGALTALIWTLLKTGDGIIADQMLYGCTFGLFEHHLPRFDIEVVFADLTDPANLQAALRPNTRLVFTETPTNPNMRLVDIAACAEICRRADARLVVDNTYCTPYLQRPLDLGADLVTHSATKYLGGHGDLLAGAVVGPKEIIDQVRFVGVKELNGACISAFDAFLILRGLKTLNLRMDRHSATAVKLAHDLEAHPAVAAVYYPGLDSHKQRNLAQRQMRQPGGMIALELRGGLAAGRSFMDKVKLATRAVSLGDAETLIQHPASMTHATYDPAERARHGFTDGLIRISVGLEDYEDLKQDLLGAL

SEQ ID NO: 23132 - protein, 461 aa, Rhodopseudomonas palustris CGA009
MSIAAIDDRPASRAPLIPPTPPRAPENLSALGRLAAIRHNAIASWGDRAYQDDVVRGRFFAHSSYILNTPDAIRHVLVDNTDNYRRTATGIRVLRPMLGEGLLLAEGRAWKHQRRTLAPAFTPRAVATLVPHMASATDEVVEGLRRKTGVPLDLRETMQHLALEIAGRTMFSFEMGTHGQALRGFVIDYGTRLASPRFLDLLLPLGWPTPQDVSRALFRRRWTRFIGELIAARRAAGKAEGAPPRDLFELMLAARDPETGEAFSDAQLGDQVATMILAGHETTATALFWALYLLALDPDAQERLANEVRRVGFGGTEIERLPFTRAVLDETLRLYPPAFLIVREAAGPDRVAGFAVRKHDVMLIAPWLLHRHDKLWSDPNAFVPERFLPGVPSPDRFAYLPFGVGPRVCIGAHFALVEATLALAKIVGTFRIELIDTEPVIPIGVVTTQPDRSPLFRLTPR

SEQ ID NO: 23133 - protein, 297 aa, Rhodopseudomonas palustris CGA009
MSTSPEHKRTALVTGANSGLGKAIVTALAADGLRVGLVARDRGRGEAALADVRAATGNQDLHLFVADLADQESIRALAQDVRARFDRLHLLINNAGTAFPERRLSPQGIERAFAINHLGPFLLTNLLLDLIKASAPARIVNVGTRIDAAIDFDDLNWDKRPYGMMKGYAQSKLGNLHFTFELARRLEGSGVTVNCVFPGVFKSNLGGTDGAQGLFWKLLAKLGGWAIPKPESAAQRVLYLANAPELESVSGQYYANRKTIPAPAQALDAEANRRLWEISERMTGLTQSQTVGDQAAT

SEQ ID NO: 23134 - protein, 332 aa, Rhodopseudomonas palustris CGA009
MEPIPSQMTVVGISKPGGPEVLLPETRDVPKPGPGEILVKVAAAGVNRPDVAQRSGSYPPPPGASDLPGLEIAGEVVALGDGASRHKLGDKVMSLVAGGGYAEYCIAQDAQAMKVPAAYSMIEAGATPETLMTVWHNVFERGGLQPGETLLVHGGSSGIGTMAIQLAVALGSKVITTVGSQDKADACLKLGASRAINYKTEDFVAAVKEATGGKGVEVILDMVGGDYIERNYDAAAMDGRIVQIAFLGGAKANVNFVKLMTKRLHHTGSTLRPRSNADKAAMVAAIEAKVLPLLEQGRIKPLIDGTFALRDAADAHRRMETSQHIGKIVLTV

SEQ ID NO: 23135 - protein, 398 aa, Rhodopseudomonas palustris CGA009
MTKTFRTLDDVDVKGKRVLLRVDLNVPMDAGKVTDTTRLERVMPTITELSGKGAKVILLAHFGRPKGRDDKNSLKPVAAALADVIKKPVGFADDCIGEPAAKAIAAMADGDILCLENTRFHPEEEKNDPAFVAKLAELGDIWVNDAFSAAHRAHATTEGLGHKLPAYAGRTMQAELVALNKALEAPVKPVIAIVGGAKVSTKIDLLENLVTKVQALVIGGGMANTFLHAQGVKVGKSLCEKDLAPTALRILDKAEAANCAIILPVDATVAYHFEANAPSFAYGLDAIPDDAMILDVGPRSIERIHAAIDDAATLVWNGPVGAFELTPFDKGTVEAAKHAAKRTKAGKLVSVAGGGDTVAALNHAGVADDFTYISTAGGAFLEWMEGKPLPGVEVLQVK

SEQ ID NO: 23136 - protein, 486 aa, Rhodopseudomonas palustris CGA009
MNVHQRYAMGDSLAAKHGLWSEEQIDAAARVRRIAEEQGLETIRFSFPDQHGILRGKTLVASEALNCLDNGATITTTMLAKDTSHKTVFPVFQAGGGFGMSEMQGGADVVMLPDPTTFRVLPWAPTTGWVLCDLYFADGRPVQFATRNIYRAALQKLAARGYDYKAGLEVEFHVFKVVDSKMRPEHAGQPGEPPEVSLLSHGYQYLTEQRYDQMEPVLELIRRDVVALGLPLRSIEVEFGPSQCEFTFQPTVGLLPADLMVLFRAAVKQICRRHGYHATFMCRPRIPNVVSSGWHLHQSVVARDGGRNAFMSDSDVLSDFGRHYLAGLMTHARAATVFTTPTINGYKRYRSYSLAPDRAIWGRDNRGVMLRVLGGAGDKATRIENRVGEPAANPYLYMASQILSGLDGVDRALDPGPSADTPYETKADLLPKSLREAIFALRDDPFFRTALGDEFVDYYTFIKNAEIERFQAEVTEWEQREYFEMF

SEQ ID NO: 23137 - protein, 506 aa, Rhodopseudomonas palustris CGA009
MNLITTMHPDASTVFKARYGNFIGGRWVAPVDGRYFDNTTPITGAKLTEIPRSQKEDVELALDAAHTASVTWSKTTTTERSLILNRIADRMEANLDLLAIAETLDNGKPIRETRAADLPLAIDHFRYFAGALRAQEGSISEIDHDTIAYHFHEPLGVVGQIIPWNFPLLMAAWKLAPALAAGNCVVLKPAEQTPASILVWAELVGDLLPPGVVNVVNGFGVEAGKPLASSPRIAKIAFTGETSTGRLIMQYASENLVPVSLELGGKSPNIFFGDVTAEDDPFFDKAIEGFVMFALNQGEVCTCPSRALVQESIYDRFMERALARVAAIRQGDPRDPATMIGAQASQEQLDKILSYIDIGRHEGAELLAGGGRAQLPGGLAGGYYVHPTVFRGHNQMRIFQEEIFGPVVSVTTFKDEAEAIAIANDTQYGLGAGVWTRDGTRAYRFGRAIAAGRVWTNCYHAYPAHAAFGGYKQSGIGRETHKMMLDHYQHTKNLLVSYGTGPLGFF

SEQ ID NO: 23138 - protein, 503 aa, Rhodopseudomonas palustris CGA009
MMALHDFTLADVYRRNAALFPDRTAFMVDGVRLTHRDYLARAERLASGLLRDGVHTGDRVAILSQNCSEMIELIGAVALIGAILLPVNYRLNADEIAFVLGDGAPSVVVAGTDYRDIVAGVLPSLGGVKKAYAIGDGSGPFAPFKDLASDTPFSAPEFGAADGFVIIHTAAVGGRPRGALISQGNLLIAQSSLVDAWRLTEADVNLGMLPLFHVTGLGLMLTLQQAGGASVIAAKFDPAQAARDIEAHKVTVMAEFAPMLGNILDQAAPAQLASLRAVTGLDTPETIERFEATCPNATFWATFGQSETSGLSTFAPYRDRPKSAGRPLFWRTVAVVDAEDRPLPPGEVGEIVLRGPTVFKGYWNNAAATQHAFRNGWHHTGDMGRFDADGYLFYAGRAPEKELIKTGGENVYPAEVEGALKQHPAIADAVVIGVPDPQWSEAIKAVCVCKPGESIAADALAEFVASLIARYKKPKHVVFVEALPKDAKGAIDRAAVKTAHGQA

SEQ ID NO: 23139 - protein, 371 aa, Rhodopseudomonas palustris CGA009
MTKSKLFAPLQVGGLKLENRIVIAPMCQYSAREGQMTDWHLMHLGHLALSGAAMLTIEATAIAPEGRITPFDVGLWDDRTEAAIGRVIDAVRSWSSIPIAIQLSHAGRKASADVPWRGGRHLPPHDPDGWQTVAPSALPLSVGGRTPVALHAESLEQIRQGFAQSARRAARLGVDAVQLHAAHGYLLHQFFSPISNKREDEYGGSLENRMRFPLEVFEGVRAAFPTDRPVTVRISGADWIDGGATIDDAVAFAQALEARGCSALNVSSGGIDPLQRISDGPNYQVPFARAVKQAVSIPVVAVGLITDYEQAEAIIATGDADLVALARGILYDPRWPWHAAAHLDGRVRAPDQYRRSQPYQYKNLFDYRSED

SEQ ID NO: 23140 - protein, 461 aa, Rhodopseudomonas palustris CGA009
MLKTIDTPQVRDATPKLKLYSREEADAFVAKVKAAGYDYVRFEFPDMAGLSRGKTIPIGHVSSYMRSGLNLYGGTVALDSYSIPVRDSGYNEEMNYTDCVMVVDTDTLTPVPWLEKTGRVICDTMWYDGTPQMATPRLLLKKMLNVAASMGYTVKSGHEYEFYVVDHATRAPLFGGQPIFVTSRTHQTPAIDDLIRVLEAQGIDIITWNVEHGPGQIEINYSALDDIAAADRAFVFKGTVKEYLAKHGLLATFMTKPYKGLSGSCSHFHISLLDSKTGENAFLDKEAENGLSRLMRSFIQGILDHTRACMALWSPTPNCYRRIRPRTYAPSNISWGIQDRSASIRVKASYDQATHLEVRVPSALSNPYLVSASVIASGLLGVMQNRELSPAAAGPKEDDARFEKLPTAIEDALEAFEADVALREMLGDEFAKVYLAMKWQEAARLRDEIPAAETNEYFELY

SEQ ID NO: 23141 - protein, 1002 aa, Rhodopseudomonas palustris CGA009
MPSDPPLAEFTAAYAPDDAALAAELLTTATLTPDREAQIDAIATDLITAIRGSEHGLRGVEAMLREFALSTKEGLALMVLAEALLRVPDAATADAFIEDKLGQGDFAHHRIKSDAVLVNASAWALGLSARLVHAGETPQGTLAALTRRIGAPAVRAATRQAMRLIGNHFVLGETIDAALARAQPYAREGSRYSYDMLGEGARTAADAERYYQSYADAITAIGRRAGNAALPARPGISVKLSALHPRFEAISRDRVMRELTPRLLELAQLAKSHDLAFTVDAEEADRLELSLEVFAACFADPSLKGWDGYGLAVQAYQKRAATVIDHVAELARAFDRRMMLRLVKGAYWDTEIKRTQERGLADYPVFTRKAMTDLNYLHCARKLLALRPLLFPQFASHNALTVATILAEAGDGDGYEFQRLHGMGEALYGRLLADHPQAVCRIYAPVGGHRDLLAYLVRRLLENGANSSFVAQAGDDSVPITELLARPATLIGHPENARNSAIPLPRDLYQPQRINSRGIEFGDRSALAALLGDIEGARRPLPTVASTSPEQAAATVTAARKGFESWSRTSGDHRAAILQRAGDLLEQRRGELIALLQDEGGKTLDDGVAEVREAVDYCRYYASEGRRLFGEPQALPGPTGERNTLALRGRGVFVAISPWNFPLAIFLGQITAGLMAGNAVVAKPAEQTPVIAEVAVRLLHEAGVPPAALHLVQGDGRIGAALVEQRDIAGVVFTGSTEVARAINRTLAAKDGPIVPLIAETGGINAMIVDATALPEQVADDVIASAFRSAGQRCSALRLLCVQDDVADRVIAMIAGAARELTIGDPRDPATHVGPVIDAEAKTRLDTHIATMKRQAQLHFAGTAPASGNFVAPHIFELNRASELTEEVFGPILHVVRYKAAQFDDLLDDIATTGYALTLGVQSRIDDTIARVIARLPTGNVYVNRNIIGAVVGVQPFGGSGLSGTGPKAGGPHYLPRFALEQTVSINTAAAGGNAALLTGSE

SEQ ID NO: 23142 - protein, 477 aa, Rhodopseudomonas palustris CGA009
MDQPIGGFGGNALHDSFHRMFEISRAEPPPTLEQRQDRLARLRALIKDNEKRFEQAISADFGHRSSTETLIAETLSLLGDIKHTSRHLKRWMAPRKVSTQLQFLPGKNRLLPQPLGVVGVIAPWNYPLQLTVAPAIGAIAAGNRVMIKPSELSPHFAALLQETVAAKFDASEMMVTGIEAGVAEAFARLPFDHLMFTGSTRVGRIVAAEAGKNLTPVTLELGGKSPTIVDRSADLDEVAPRIAYAKLMNAGQTCIAPDYVLAPQDRVEALAGKIWGAMQQMWGTDPANPDYTSIIAEHHYARLKSLVDDAVARGARLLQPASADDAAWAGKRKFPPTLVLGATHEMKIMQEEIFGPLLPILGYSEPTEPINFINGRDRPLALYWFGTDDTARDQVLERTVSGGVTINDCLVHFAQANQPMGGVGASGTGAYHGEWGFNTFTKMKPIFYRSPYNRFADLYPPYGAKIARLSKVLRLMS

SEQ ID NO: 23143 - protein, 458 aa, Rhodopseudomonas palustris CGA009
MASSLTPPASEPVAGLPVLSHIRKDFIWGVSTASFQIEGAANEDGRGQSIWDVYCRSGYVANNDTGDVACDHYHRYQEDVALMKTLGIQAYRFSIAWPRIFPQGTGAINEPGLAFYDRLIDALEAAGIEPWICLYHWDLPQALEERGGWMNRDIVGWFADYAWVIGERYGKRVKRFATFNEPGIFSLFSRSFGARDRSADEKLHRWIHHVNLAHGAAVDVLRETVADAKIGLVTNYQPVYPSSDKPEDVAEAKLISDYWNRAFADPQYRGEYPDLIRDAIKPYIQPGDMERIHRPLDWFGLNHYSPVYINSDPNAIVGLGWGPKPEGIPRSPIDWTIEPDAFRDTLIEISRRYGKPVYVTENGYGSNIEKPDANGEVVDPGRIGFLRDYITALDQAVAAGADVRGYMVWSLLDNFEWESGYSVRFGLIYIDYATLRRIPKASFKWFADVIRHARGTAA

SEQ ID NO: 23144 - protein, 476 aa, Rhodopseudomonas palustris CGA009
MVNRMQFYIDGAWVDPVVKKSTPVVNPATEEAMYEVALGSKADVDKAVAAAKRAFETFSVTSREERIALLEKVVAIYKSRMKEIGAAISDEMGAPLPMAEKMQAGAGLGHIMSTLDVLKNYQFEEPLGSAMIVREPIGVVGMITPWNWPLNQIACKVAPAIAAGCTMVLKPSEFTPTSALLFAEILHEAGVPKGVFNLVNGLGPEVGAAMSEHPDIDMISFTGSTRAGIDVAQRAAPTVKRVSQELGGKSPNVILEDADLTKAVTGGVMHMFNNSGQSCNAPSRMIVPLSKMKEVAAIAKGVAEKTKAGDPRGEGTTIGPVVNRIQWDKIQTLINKGIEEGATLVAGGPGLPEGVNKGFYVRPTVFADVTKDMTIAREEIFGPVLVIMGAKDENEAVELANDTPYGLAGYVSAGSVDRARAVGRKIRAGNVNLQGVPNERTAPFGGYKQSGNGREWGKFGLEEYLEVKAIAGFNAA

SEQ ID NO: 23145 - protein, 394 aa, Rhodopseudomonas palustris CGA009
MLRPSSKQFFAGEHDLASRSAELFGPLSGARHSALLVTCPSEAADDPTFMLRLAERGVEAVRINCAHDDAAAWQRMINHLHVAEEATGRRMKVLMDIAGPKIRTGDARTPDGRDRIVTGDLVAIVAQGEFERIDLDDEHFAVECTLPDPLTRAAVGARVFVDDGKLCVRIERKTAWGLLGRVTATADTGFRLKPEKGLNFPDTPLDIPALTAKDRADLDFVAAHADGVEFSFVQSVGDVKMLQAALAERRPDDWHKLSLVLKIETPDAVAHLPDILVQAAGRQPTAVMIARGDLAVEIGFARLAEMQEEILWIGEAAHVPVIWATQVLEHLVKKGTPSRGEMTDAAMAARAECVMLNKGPYLFKAITELDTLLGRMADHQHKKTPQLRRLRSWG

SEQ ID NO: 23146 - protein, 483 aa, Rhodopseudomonas palustris CGA009
MLMPSDPGLLAERCLIGGKWCGEPVDAVFNPATGERIGAVPRFGTDEAEEAVRAAEIAFRQWSKLLAKQRATMLRAWFDQIIANRDDLALLLTREQGKPLAEALGEIDYAASFVEFYAEEARRIYGETIPSHRADARTMVIRQPVGVVAAITPWNFPAAMITRKVAPALAAGCTVVIKPAPETPLTALALGVLAQRAGFPPGVLNIITGDAPAIGKAWTEHPTVRAISFTGSTEVGKILMRQAASTVKKVALELGGNAPFIVFDDADLDAAVEGVIASKFRNMGQTCVCANRIYAQDGIYDAFVEKLTAKVATLQVGNGVDAGVTQGPLITTEAIAKVERHVSDAVAKGAKVVLGGKRHKLGRTFFEPTVLAGVTTAMLITREETFGPVAPVYRFTDEADVIAQANDSPFGLASYFYARDLGRVFRVAEALESGMVGVNSALLGADVVPFGGVKQSGLGREGSRHGIEEYVETKYILLGGLDR

SEQ ID NO: 23147 - protein, 465 aa, Rhodopseudomonas palustris CGA009
MSLARLATPKDRTPKGLIDLIGNTPLVQLTRLDAGPCRLFAKLEGQNPGGSIKDRPALAMIEAFERSGELRPGGTLVEATAGNTGLGLALIAALKGYRLVLVIPDKMSREKVLHLKAMGAEVVMTRSDVGKGHPAYYQDLAQKITSETPGAVFVNQFANPANPLAHEYGTAPEIWEQMDRRVDAVVCGIGSGGTLTGIARFFQRASPSTEIILADPKGSVLVDVVEGREPGPVGSWLVEGIGEDFVPSNAELKLVTRGYTVTDAESFHAARELLRREGILAGSSSGTLLAAALRYCREQTRPKRVVTLLPDGGNKYLSKMFNDTWMADQGFVPRRHDGDLRDLIVRRHDEGASITVAPEDTLNFAYSRMKLYEVSQLPVLVDDRVVGIIDESDLLMATIGDPAKFAEPVHSAMSKRVETVEASAPFESLMPVFDRGLVVVVVDGSRFLGLITRIDLINHLRSKVH

SEQ ID NO: 23148 - protein, 240 aa, Rhodopseudomonas palustris CGA009
MNTNKYLAEMIGTFWLTFAGCGSAVIAAGFPQVGIGLVGVSLAFGLSVVTMAYAIGHISGCHLNPAVTLGLAAGGRFPVKQIAPYIIAQVLGAIAAAALLYLIASGAAGFDLAKGFASNGYGAHSPGQYNLVACFVMEVVMTMMFLFVIMGSTHGKAPAGFAPLAIGLALVMIHLVSIPVTNTSVNPARSTGPALFVGGWAIGQLWLFWVAPLLGGVLGGVIYRVLSPEPTGVVEGVKAR

SEQ ID NO: 23149 - protein, 152 aa, Rhodopseudomonas palustris CGA009
MRFAFPAGALLALAVTALSPAAALMSSTPAMSESAKSVTTPSGLQIVDTQVGTGASPARGQICVMHYTGWLYENGAKTRKFDSSVDRNEPFEFPIGMGRVIKGWDEGVASMKVGGKRTLIIPPDLGYGARGAGGVIPPNATLVFDVELLGLK

SEQ ID NO: 23150 - protein, 278 aa, Rhodopseudomonas palustris CGA009
MSLAIGSASGTLQPFIARVLMPVPAVRPLIAGNWKMNGLKDSVAELDAMLKGAAELPQGIDLLVCPPATLVASFAARVAEAQAGKALPFSIGGQDCHANASGAHTGDIAAEMLADAGAAAIIVGHSERRADHAENDAIVRAKAQAVWRAGLVAIVCVGETQGERDAGHTLDVVAGMLAGSLPDGATAANLVVAYEPVWAIGTGRTPTAADVEEVHGFIRKTLSDRFGAAGETMRILYGGSVKPSNARELLAVPHVNGALIGGASLKASDFLAIAAGCP

SEQ ID NO: 23151 - protein, 328 aa, Rhodopseudomonas palustris CGA009
MKQRVLGSSGISVGEIGLGCMGMSPEFYGSSDDASSLRTLEHAYANGVTLYDTADMYGRGHNEQLLSSFLRAHPDVRIASKFGIVRQDNVLERTIDNSPEYIVQACDASLKRLGVETIDLYYVHRIDTNRPIEETIGTMARLVTAGKVRALGISECSAATLRRAHAVHPIAAVQSEYSLWTRDPEAEVLPACNELGIAFVAYSPLGRGMLTGAINSSDSFEANDYRRRSPRFVGDNLDANLKLVDKIRQLAATKGCTPAQLAIAWLLHQSDRIIPIPGTRRIATLDENLGASEVSLSADDLAAIRDALPAGAAVGARYPESALAGLNG

SEQ ID NO: 23152 - protein, 485 aa, Rhodopseudomonas palustris CGA009
MAKASSSFVCQNCGAAFNRWQGKCEACGEWNTLVEEAGDNAVPVSIRAKRRGRTFKLESLAGKSNDAPRLPSGMAELDRVTGGGFVRGSVLLVGGDPGIGKSTLLTQATSLMAKAGHRTVYISGEEAIAQVRLRAERLGLASAPVELAAETSVEDIVATLSEGATPKLIVIDSIQTMWTDTVESAPGTVTQVRASAQALIRFAKKTGAAIILVGHVTKDGQIAGPRVVEHMVDAVLSFEGEGSQQFRILRSVKNRFGPTDEIGVFEMTGLGLREVSNPSELFLSERDLGSPGTAVFAGIEGTRPVLVELQALVAPSTLGTPRRAVVGWDSARLSMVLAVLEAHCGVKLSGYDVYFNVAGGLRINEPAADLAAAAALVSSLANAPLPTDAVYFGEISLSGAVRPVAQTPARLKEAAKLGFARAVLPEQTRGEAPADAGLALQSVGGLSSLVADIAARGTRRGDDDGAPRTKAASNATPARFRRQEA

SEQ ID NO: 23153 - protein, 510 aa, Rhodopseudomonas palustris CGA009
MKHILEALDERRTAAKLGGGEKRINAQHARGRLTARERIDLLLDKHSFEEMDMFVQHRSTEFGMAKTKIPGDGVVTGWGTVNGRKVFVFAKDFTVFGGSLSETHAAKITKIQDMALKARAPIIGLYDAGGARIQEGVAALAGYSYVFRRVVQASGVIPQISVIMGPCAGGDVYAPAMTDFIFMVKNTSYMFVTGPDVVKTVTNEVVTPEELGGASVHATKSSIADGAFENDVETLLQMRRLLDFLPANSSEGVPEWPSFDDIEREDFSLDTLIPDNPNKPYDMKELILKVVDEGDFFELQDTFAKNIITGFGRIAGRTVGFVANQPMVLAGVLDSDASRKAARFVRFCDSFNIPIVTFVDVPGFLPGTAQEYGGLIKHGAKLLFAFSQCTVPLVTVITRKAYGGAFDVMASKEIGADINYAWPSAQIAVMGAKGAVEIIFRQDMHDPEKIAARTKEYEDRFLSPFIAAERGYIDDVILPHATRRRIARALAMLRDKKMEIPQKKHDNMPL

SEQ ID NO: 23154 - protein, 478 aa, Rhodopseudomonas palustris CGA009
MNAVGKSSNDPRCVPLIMCGGAGTRLWPASREVRPKQFLPLFGPRSTFQETLLRVSDPALFGRPIIITNTAYRFMVRDQLAEIGIEADVLLEPARRDSGPAIVAGAVFAEQREPGAVVLALAADHVVRDKDAFIAACRDGLAGVAEGRIVTFGVKPERPATEYGYISPGDAIVGKVRNVAKFVEKPDLATAEGYVAAGYLWNSGNFMFPAAALLEEYNAVDPDSVATITEAVTTAGRDLGFVTLPEASFGKAKPISIDYAVMEKTKRAAVVPVDCGWSDVGSWRAVWELTAKDGGGNAAQGPAVFEDSRNCHVSSEHTLVALEGVDDLVVVATQDAVLVSRQKDGNGLKRLVAKVKTVAPEVTDHHAQVHRPWGSYRSLDSGDRHQVKRIIVKPGERLSLQKHHHRSEHWIVVRGTAQVTVDELVKIIHENESIYIPIGATHRLENPGKITLELIEVQTGSYLGEDDIIRFDDDYRRS

SEQ ID NO: 23155 - protein, 385 aa, Rhodopseudomonas palustris CGA009
MTAIDQFSLNEDQRAIRDMARDFAAEKIAPHALQWDEDKHLPLDVIREAAALGIGGIYIRDDVGGSAMTRFDAALIFEALATGCPSVSAFISIHNMAAWMIDSYGSDAQRQRWLPKLCSMEQVASYCLTEPGSGSDAAALRTRAVRDGDHYILNGQKQFISGAGANDLYVVMVRTGSDGPGGISTLVVEKDTPGLSFGANERKMGWNAQPTRTVIFENARVPVANRLGDEGIGFKIAMAGLDGGRLNIGACSLGGAQAALDKTLAYMKERKAFGKRLDEFQALQFRLADMATELEAARTLLWRAAAALDRKDADATKLCAMAKRFATDAGFGVANEALQLHGGYGYLAEYGIEKLVRDLRVHQILEGTNEIMRLIVSRKLLEANR

SEQ ID NO: 23156 - protein, 508 aa, Rhodopseudomonas palustris CGA009
MNLAEWLAASARLRPGAPALLTGTTVDADYATFASRAASFGAALARDYGIAPGDRVALFAHNCTRYLEALYGIWWAGAVAIPINAKLHGKEVAWICSNAEARLALICDDTADTFNEASYDLPPGLAVLAIDSDGFDRARSGAGSKAPVARDDDDLAWLFYTSGTTGRPKGVMLSHGNLVAMSLSYLADVDAVTPEDAALYAAPISHGAGLYNMIHVRFGARHVVPESGGFDPDEVLSLGKQLGNVAMFAAPTMIKRLVEAAKRRGETGEGLRTIVYGGGPMYLADIREALSVMGQRFVQIYGQGESPMTITSLKRALHADVDHPRYLQRLASVGTAQSVVSVRITGANGEVLPPGETGEIEVKGSTVMLGYWNNPQANAETLKDGWLRTGDVGRLDDDGFLTLSDRSKDVIISGGTNIYPREVEEALLTHPAVREVSAIGVADPEWGENVVACVVLTDGAAADDATLDAHCLATIARFKRPKRYVYLDALPKNNYGKVLKTELRKIVK

SEQ ID NO: 23157 - protein, 1100 aa, Rhodopseudomonas palustris CGA009
MNKMTSIAPSDRPDAETSDELWYKDAIIYQLHVKAFADSNNDGIGDFAGLTEKLDYLQELGVNTLWLLPFYPSPQRDDGYDIADYGSINPDFGTMKDFRRFIVEAKKRNLRVITELVINHTSDQHAWFKRARRSPKDSSARDWYVWSDTDQKYLGTRIIFTDTEKSNWTWDPEAGQYYWHRFFSHQPDLNFDNPRVVSAVVKVMKRWLDTGVDGFRLDAIPYLCERDGTNNENLPETHAVIKRLRAELDAYAKGKLLLAEANQWPEDVQQYFGDGDECHMAYHFPLMPRIYMAIAQEDRFPITDIMRQTPEIPANCQWAMFLRNHDELTLEMVTDVERDYLWKTYAADPRARINVGIRRRLAPLMDNDRRKIELMNSLLMSFPGTPIIYYGDEIGMGDNIYLGDRNGVRTPMQWSPDRNGGFSRADPARLYAPPIMDPVYGYASVNVEAQQRSLSSLLSAMKRLIAVRKSTPAFGRGSITFIRPSNRAVIAYVRQYKDEVILCVANLSRAAQATELDLSPWKDRVPQEMLGRTKFPPIGDPAYMITLAPFGFYWFKLQEPGTAAHVAPVSTVPEFVTLVVPLGSTWMTLGRTRSMFEHEVLPTFLSRTRWFPERNPRAIHPRLTSAIPFANDGDNRPWLAFFEATQRGTTARYLLPMQIDWVRFDRERYNPRAYAAVRQGAREGTLLDVAADPSFIDLLLENVRDAVTVTGDNGDRLEFRPGSKLAERPAGPFQNIRAVETEQSNSTALVDGDYVVKLYRRLQIGINPELEMGRFLTEVAGYANTPALLGSVELIEGDKTSAVAVVHEFARNQGDGWTVTSGYLDRYIDEQRVLSRAEEKTESDQLAPYLHFMQQTGKRVAEMHIALASHPEVPDFAPEPITLDASRDWAETVAASADRMLDELRRRRDTLKEGDRTLVDELLAARDVLMSRIHGLLGDDGGLNIRHHGDFHLGQMLIVKDDIYIIDFEGEPRRTLDERRAKAPAARDVAGLIRSIDYSTTAALERALKAASDEPGRLTEALDLWRIRATGAFLDAYRQTMGDSPVWPADIAAADRVLDFFLIEKALYEIDYEIAHRPDWVHVPLVGILRILSPPPEELP

SEQ ID NO: 23158 - protein, 405 aa, Rhodopseudomonas palustris CGA009
MNDTVLIAGAGHAGFQVAVSLRQAKYPGRIALINDEKHLPYQRPPLSKAYLKSGGDPNSLMFRPEKFFQDQAIELISDRMVSIDREGRKLLLASGTAIEYGHLVLATGARNRMLDVPNASLPDVLYLRTLDESEVLRQRMPDKKHVVVIGAGFIGLEFAATARAKGLEVDVVELAPRVMARVVTPEISSYFHDRHSGAGIRMHYGVRATEIAAEGDRVTGVVLSDGNTLPCDLVVVGVGVIPNVEIAAAAGLPTAAGIIVDQQLLTSDPHISAIGDCALFESVRFGETMRVESVQNATDQARCVAARLTGDAKPYDGYPWFWSDQGDDKLQIVGLTAGFDQVVIRGSVAERSFSAFCYKAGKLIGIESVNRAADHVFGRKILPLDKSVTPEQAADLSFDLKKAAA

SEQ ID NO: 23159 - protein, 232 aa, Rhodopseudomonas palustris CGA009
MSSFALRPLAIAPSILASDFSKLGEEVRAVDTAGCDWIHLDVMDGHFVPNISYGPDVIKAMRPHTKKVFDAHLMIAPCDPYLEAFAKAGCDIITVHAEAGPHLHRSLQAIRALGKKAGVSLNPGTHPSAIEYVLDDIDLVLVMSVNPGFGGQAFIPSAVQKIKQIRAMVAGRPIDIEVDGGVSDKVAGELAAAGANAFVAGSAVFKGGTLEAYKANIAGIRNAAMQARGEVA

SEQ ID NO: 23160 - protein, 351 aa, Rhodopseudomonas palustris CGA009
MSVTFRAAVLHELNRPLSIETVEAPPLAAGQLLVKLAYSGVCHSQVMEARGGRGPDRYLPHMLGHEGSGVVVEIGGGVTKVKRGDRVILGWIKGQGADTQGVRYASGERVINAGAVTTFNEYAVVAENRVTPLPAGLPMDVAVLFGCALPVGAGIVINIAKPQPGATLAIFGLGGIGLAALMACKLFACNQVIAVDVEAAKLKMATELGATTVIDASRIDPVEEIRRLTGGLGVDYAIESAGLTRVIEQAFDATRRFGGLCVFASHPRSGEKIALDPFELICGKRILGTWGGDSKPERDIELLAGLYRDGKLPLDAMFTRRYKLDEINEALDDLEHRRSVRPLIEIDPSLR

SEQ ID NO: 23161 - protein, 259 aa, Rhodopseudomonas palustris CGA009
MDALAQLYAIRVADLVVGFGRQTVLNHLSLDVRRGEILGLVGASGGGKSVLMRTIIGLIPKQSGHIEVMGHDTERGFGRARAAVAATWGILFQQGALFSSLTARQNVQFPLREMLDMSEKLQDEIATAKLEMVGIAPDDWDKYPSQLSGGMTKRVALARALALDPSIVFLDEPTSGLDPIAAGDFDQLIKTLQTTLGLTVFMVTHDLASLNVVCDRVAALADGKIVAVGPMRELLQSEHPWVRAYFHGKRSAMLQPRQD

SEQ ID NO: 23162 - protein, 354 aa, Rhodopseudomonas palustris CGA009
MKPGVACVHIDLNPKLDFRDVLIRPKRSVLSSRFEANIKRSLRFRHSSRAWTGFPLIASNMDTIGTLEMAKAFKPFGALVALHKFHHPDRLAEYLAGDEDANVFVTVGTGSADWERLAAVKAKVKVPMLNIDVANGYTEAFVRAVARLRDENPDAIIMAGTVVTAEMTEALVLAGADIVRVGIGSGSVCTTRDLTGVGYPQLSAVIECADAAHGLKGHVCSDGGCVVPGDLAKAYGGGADFVMLGGMLAGHDECGGELRYAEQNGHKTPTSMVFYGMSSETAMNKYHGGVADYRAAEGKTVEVPYRGEVHATVEKIAGGLRSAMTYIGAENLKEIPKRTTFILVNAQRNTVFDR

SEQ ID NO: 23163 - protein, 381 aa, Rhodopseudomonas palustris CGA009
MAEPVALRAGGFGARGAGSQAAQERQVIGSSIAVREAEKRYGQFHAVDRINLDIEPGEFITLLGPSGSGKTTLLNLLAGFQTLDGGEILVDGKPVHNVPTHKRGFGMVFQSYALFPNMTVTQNVAFPLRMAGVDRATTARRVAETLEIMRLSAHANKSPSEMSGGQQQRVAIARAIVMRPKVVLMDEPLSALDRRLRESIQIEIRDLHQTIGSTILFVTHDQGEALTMSDRIAVLDAGKIVQIGRPLDIYRHPANRFVASFVGESNLIEAEIMQKRGTTVTLKNRSGYVFDAESRDAIDVGRVTVLVRPERIAIADEPTANSTPVTVTSAIFLGETLRIEAQMESGETLLVRCPDSAKRPLPNVGDRLHVGWGPEDCWVLA

SEQ ID NO: 23164 - protein, 495 aa, Rhodopseudomonas palustris CGA009
MADSVSAAITEPPQVPPAATGRVIDTDIPARLDGLLWSRFHTRVVAALGITWILDGLEVTLAGALAGALKDSPSLRFSNLDVGLANSAYLAGAVIGALGFGWLTDRIGRKKLFFITLALYLTATAATALSWSVTSYALFRLLTGAGIGGEYTAINSTIQELVPARYRGWTDLVINGSFWIGAAIGAVCAIVLLDPAVIDPDHGWRLAYLTGAVIGLVVFAMRWWIPESPRWLMIHGQPERAEAIVADIEQSARHAPDRPRVLPKIKLRMRTHTPLLEVAKTLFGTYRQRSLVGLVLMTAQAFFYNAIFFTYALILTDFFGISANHVGWYILPFAAGNFLGPLLLGRLFDTLGRRTMIGFTYGVSGLLLALSGYLFSIGALSAQSQTIAWMVIFFFASPAASAAYLTVSETFPLEVRALAIAIFYAIGTGIGGVAGPALFGALIDTGSRGSVFAGYLFGSVLMMAAAVIGWRYGIAAERRSLEHVARPLAATEDIR

SEQ ID NO: 23165 - protein, 274 aa, Onion yellows phytoplasma OY-M
MNYKPRTKVIAGNWKMYKCKDEALEFIQKVSLQVPDQTQVQTLIFPQLTLLDSLAQLQGTNLQVGAQNMFYESEGAFTGEVSPQNLLSLGVKHVLLGHSERRTFFGETDQTVNLKLLSALKHKLVPTVCVGESLLTKENNQTQVFLDQQLTNIFAGVPEEALQNIIIAYEPVWAIGTGKSATPQDANKVIEQIRDKVTALYSSQASCAMRIIYGGSVSVANIKTILEQPAIDGILAGKASLQTEDFLFFAQIASKQALASTKDIFQKNDCPFCC

SEQ ID NO: 23166 - protein, 398 aa, Onion yellows phytoplasma OY-M
MTKSLTNMNITNKKVLLRADLNVPLENSVITDDNRIKAILPTLKYLVQQKAKVIIFSHLGRVKTEADKAHFSLQVVAEKIAFYLQQKLKFVPETQGNTLNQAVGQMLPGDVLVVQNTRFEDVPFKKESKNDPELGKYWASLGDVFVNDAFGTCHRTHASNVGIATYIKEKCFGFLVEKEISFLKKIVQTPQRPLVAVLGGSKVSDKIGVIRSLLQKVDVLLIGGGMSYTCLKAKCFNIGTSLLEADKIPLVKELLASPEGKKIVLPKDFVCGKEFSPTTQAAVYSYDNISDDVMGLDIGPQTIELFKTYLQTAQTVVWNGPVGVFEFEQFSKGTKALAETISNLSPNTTTIIGGGDSAAAVFKFGLDQNFSHISTGGGAFLEFLEGKPMPGLACMEKL

SEQ ID NO: 23167 - protein, 217 aa, Onion yellows phytoplasma OY-M
MILILLGPPGIGKGTQASVLSDILKINHIATGDIFRKNFKENTELGILIKKIIAQGLLVPDDITNQMIADYLSKDIATKDFLLDGFPRNVLQARFLDDFFKNSHLFLTKVIYFNAGTQDLMKRIVGRRICPECGKVYHIENIPPKTPGICDKDQKTLIQREDDKPETFLKRLKVFNQETLPLVQYYREQNQLFEVDGMQNIDQVTKMILEVLETDRK

SEQ ID NO: 23168 - protein, 426 aa, Onion yellows phytoplasma OY-M
MLKLNLEGIYNFLDWHNYAQTFAPQIKVIHQKLHQDQQLKEKYLGWLELPLHFDFQELEKMKQLKNSHPNLDVLVVIGIGGSYLGAKAGIEFLQTPFKKTKPEILFAGHQASGNYLTNLLHYLKDKNWAINVISKSGITLEPALAFRILKKEIEEKYGKQLAKNRIFVTTDSQKGVLLNLALKEGYQTFVIPDSVGGRFSVFTSVGILPFVFANLDVVSMMKGALQAYHDTFQEDLFQNQAYQYALARYLLHTQQNKKMELLVSYEPHLLSFSEWWKQLFAESEGKEEKGLFVGATNNSTDLHSLGQFIQEGTKMLFETVLNVTSIKDDCVVPHIPNELDNLNYVAGKTYSQINQKILQATKQAHIEGKVPNLEIVIPTLDAYHFGYLAYFFQKACAMSGSLLGINPFNQPGVEIYKQKMFALLKS

SEQ ID NO: 23169 - protein, 430 aa, Onion yellows phytoplasma OY-M
MPYIESILAREVLDSRGNPTVEVEVYTESGAFGRAIVPSGASTGQYEAVELRDGDAQRFLGKGVLQAVKNVIEVIQPELEGYSVLEQTLIDKLLIKLDGTPNKSNLGANAILGVSLACAKAAANYLNLEFYQYVGGVLPKQMPVPMMNVINGGAHASNSVDFQEFMILPTGPTSFKEALRYGAEVFHHLGKILKQKGLPTTVGDEGGYAPDLNSNEEALQIILEAIKSAGYEPGKDIFLGMDVAASEFYDKKLQKYVLASENNKAFSSQELVHYYETLVSKYPIISIEDGLDENDWDGWKYLTQKLGNQIQLVGDDLFVTNTQKLAQGIENKIGNSILIKLNQIGTLTETLETIEMAKKASYTAVISHRSGETEDTTIADLAVATNAGQIKTGSCSRTDRMAKYNQLLRIEDQLVEAPFLGLKTFYNLKK

SEQ ID NO: 23170 - protein, 512 aa, Onion yellows phytoplasma OY-M
MTKKFVGLTILDGLGLTDQKENNAFHLAKTPYLDYLLKNFPNTTLKASGEEVGLPQGQMGNSEVGHLNLGAGRVVYQSLTQINKAIRDKSFFTNKQFLQAIEHVKKNNSKMHLLGLISDGGIHSHLDHFKALFDLLKENNLANNTFLHAFTDGRDTSPHSGINYIKDLLDYGFNIASVVGRYYALDRDNNWNRINLVYNMLTSKQAPVIDLPLEDTIQNFYNQGITDEFITPFITNPNGLINDNDAVIFVNFRPDRAMRLATALSNPCATNAFCSEGKTNFCGTKLLNNLFLVTMTKYSAQVKSVVAFEKITLKNIYGEVIANLGMHQLRIAETEKYPHVTFFFDGGKELQLKNADRILIPSPKVKTYDLKPEMSALEITTHAKTAILSGKYDTLILNFANPDMVGHTGFLDATIKAIQTVDSCLKEVLNAIFAVKGKACIVADHGNAEQMTDNQGNPHTAHTTNLVPFIVTDKNVVLKPGSLCDVAPTMLDLLEIKKPQEMTGNSLIKKLV

SEQ ID NO: 23171 - protein, 446 aa, Onion yellows phytoplasma OY-M
MNKTKIICTLGPASYDKNILQALIQTGLNVARFNFSHAQYEQTKLLMKTIKTISDKLDKNTGLMLDTKGPEIRTHEFDGVVTIQKDSEVKISMTEVLGNAKLFSVSYSNLYNELKVGDMVNIDDGYLSLEVVGKDEAKQQLVTKAKNTHSIKSRRGVNVPKVNLEMDFISPKDYQDIVFAAQQDFDYIAASFVRRAQDVKDIRKILQEQGNSNIQIISKIENQEGVDNLEEIIQESDGIMVARGDLGIEVDGELVPLYQTRMITKCLEYGKPVVVATQMLESMQRNPRPTKAETSDVFNAVREGTTFTMLSGESASGEYPVEAVTYMKKINYQAEKVVNYQALSQVYQPKNSKENLLLSAVELALRTDVKAIVVYDLKDAYNVSKFHPSVPVLALVKTEQEARRLVLNFGVCPFVSETKLQTKLEELTQNQSSNCLVVKDGMLYFK

SEQ ID NO: 23172 - protein, 447 aa, Onion yellows phytoplasma OY-M
MKVIVVGCTHAGTAAVKTIKKNNPQADVVVYERNDNISFLSCGIALYVGGVIKDSLGLFYSNPDELVSMDVCTKLKHEVLKLNFDKKEVLVQSLETGKQFKDNYDKLVIATGSWPVIPPIKGIDCKNVLMSKNFDHAKDIINYSKNVNKITIVGAGYIGIELAEAFAVQKKEVVLVDAEDRIMSKYLDKEFTDVAQKTLTDHGVTLALGQKIAGFETKDGLVTHVKTDKNTFETEMVIMCISFKPNTQLFAHHLETSFNGALVVNEYMQTSDPDVYACGDCVNVYYNPTQEVKYMPLATNAIRMGTLVGLNIEKPCVKYLGTQGTSGIKIIDLSISSTGLTENVAKALGKNYGTVTIKDANRPEFMPDYDAVMLKLVFDKETRKILGGQIVSRVDLTEKMNTLSVCMQNQMTVEQLAFVDFFFQPHFNKPWGLLNLAGLKALEVKSQ

SEQ ID NO: 23173 - protein, 248 aa, Onion yellows phytoplasma OY-M
MHNIIEITNLQKKYGTKVVLKDINLKIKQNEIITLIGPSGAGKSSLLRCLNLLEEPDFGTILFEGTNILNPKYNVYNLRKKIGMVFQHFNLFAHKNVLNNCTLAITEVFKKSKEEAQTIAREKLQKVGLLDVSSQSIQTLSGGQKQRVAIARALCMNPEIILFDEPTASLDPQLTKEVLDIMTNLTHEKITIILVTHEIAFAQKISDRIVFMADGIILEEGTPQQILNNPQSDKLKTFLKDASFNKYK

SEQ ID NO: 23174 - protein, 457 aa, Onion yellows phytoplasma OY-M
MKNYDVLVIGGGPGGYVAAIKAAQMGAKVALVEKHKLGGICLNYGCIPTKAYLKSAKMYKDIKRCADFGIKVQNGVSFDWSSILSRKNKIVAQLTTGISFLLKKNKIDFYHGFASVLSPCEVQVDTNLLHTQKLIIATGSTAFVTPIPGAQEAYQKGILKTSKELLQLESYPSKVTIVGGGVIGVEFATIFNSFGSEVTILERQDNILNGMDRDVVVAYTKKLQADGIQILTQVEVTKINDNQTTYTQKGNAKTITSDVILMAVGTKANLAGLEKLNLALNRNSVQTDNFCQTSIPGVYAIGDVNGKHMLAHVASHEGIVAVTHALEQKAQPINYDRVPACIYGFPEIASIGMTEQQAKEKQMDYKVSKISLGAVGKSLADGEKEGFAKLIVCKKHLEILGMHIYAYNATELISEMAVGMELEGTAYELSQAIHPHPTLSELTFEALLGAVDKPIHA

SEQ ID NO: 23175 - protein, 402 aa, Synechococcus sp. PCC 7002
MYGITSTANSTGNQSYANRLFIYEVVGLGGDGRNENSLVRKSGTTFITVPYARMNQEMQRITKLGGKIVSIRPAEDAAQIVSEGQSSAQASAQSPMASSTKIVHPKTTDTSVPVNIYRPKTPFLGKCIENYELVDEGGSGTVRHVTFDISEGDLRYLEGQSIGIIPPGEDKNGKPHKLRLYSIASTRHGDMEDNKTVSLCVRQLEYQDPESGETVYGVCSTYLCNLPVGTDDVKITGPVGKEMLLPDDEDATVVMLATGTGIAPFRAFLWRMFKEQHEDYKFKGKAWLIFGVPYTANILYKDDFEKMAAENPDNFRLTYAISREQKTADGGKVYVQSRVSEYADELFEMIQKPNTHVYMCGLKGMQPPIDETFTAEAEKRGLNWEEMRRSMKKEHRWHVEVY

SEQ ID NO: 23176 - protein, 152 aa, Neurospora crassa
MSALTSDAQLFEDEFKVERISDPKYDRVDRLYCTSVDGQTSMQLDVNKELFPVKVGEYLRIALATSLSLDGSKDDERGWRDAAKLGSVEQTLADSYEYVCHGKVYKFEDGKDGQTIKAYMSYGGLLMALDGPYKKLTPLRVDYVYLLANRNA

SEQ ID NO: 23177 - protein, 469 aa, Neurospora crassa
MVLIKLNPTVGATDAVASSKHSAVLHRHLDTTFLNMTRSEGNFLILEDDRKIFDASGGAAVGCLGWGDQRVAQAVTNQVLAAPYCATIFYTTRVQEELCRDLVQSTNGAMARAYIVNSGSEAMEAAVKLARQYFLEIDQPQRTRFISRKQSYHGITLGALSVGGHEVRRAKFEPLLIKNVSRVSPCNAFRGKAPGESDEEYAERLAKELDDEFQQVGPENVCAFVAEPIVGAALGCVPAVKGYFKAVRDVCDKYGALLILDEVMCGMGRSGTLHAWEQEGIVPDIQTIGKALGGGYQPVAGLLAGHRVVNALEKGSSVFVHGHTYQGHPAACAAALEVQRIVREENLLSNVRAMGDLLSSRLREILASHPNVGDIRGRGLFWGIEFVADKENMAPFPSEDHVCMEICQLGLTDKYGINVYPGGGSVDGITGDHIIISPAFNISREDVEWIAATVGRLVSDYFAAKAGTQ

SEQ ID NO: 23178 - protein, 294 aa, Geobacter sulfurreducens PCA
MAQHDYYETLGLKKGATEEEIKKAYRKLAITYHPDKNPGDAAAEEKFKEINEAYAVLSDPQKRAQYDQFGSNGFHQRFSQEDIFRGFDVGDMFKDMGVGTDDIFSRIFGGGFRQGGFSFTGTRQRGGDFTMELPVTFREAYAGCEKRVAYRRDGMREEISVKVPAGVETGARLRVAGKGGVGSGGTGDLYLVVKVGGDPQFHREGDDIVVEREIKFTDAALGASLDVPTLEGTKRVKVPAGIQSGTKIRLKGLGFPHMGKTAKGDLYVHINVSVPRSLSADQKAILEKLREAGL

SEQ ID NO: 23179 - protein, 399 aa, Geobacter sulfurreducens PCA
MNTTQWIAKADKYIMKTYGRYPLVPVRGEGCRVWDADGKEYLDFLAGVAVNNLGHCHPKVVEALRTQAAEIIHCSNYYHIPNQIELAELLCAHSFADKVFFCNSGAEANEAAIKLARKHAREKTGDAERYGIITALASFHGRTMATISATGQEKVQKFFDPLLHGFTYVPFDDAAALEAAVTPTTCAVMLEPIQGEGGVVVPSADYFRKVREICDRHGLLLIFDEVQVGIGRTGKLFAHEHFDVTPDIMTLAKALAGGAPIGAMLARDEIAASFSPGTHGSTFGGNPLVTAAGLAAVRAVLEEGLLNRAEEMGEYLVGELERLKGKYDIITDVRGIGLMVGMELSVPAGDIVLKGLERGVLLNVAQDRVLRFVPPLVVTKQEVNDMIAVLDGILEEMTK

SEQ ID NO: 23180 - protein, 450 aa, Geobacter sulfurreducens PCA
MKTVTRYACQKCGYQSAKWLGKCPDCAAWNSFVEEVTGGGRKGAASLPAATRPVPICDVASEAETRLSCGISEFDRVLGGGLVSGSLVLIGGDPGIGKSTILLQVMDHLARTAGPVLYVSGEESARQTKMRGERLGIGARELLVLAETSLELILSQVTALAPRALVIDSIQTVFSANLESAPGSVSQVRECAGRLMELAKRNGIPTLLVGHVTKDGSLAGPRVLEHMVDTVLYFEGDPGHAFRILRAVKNRFGSTNEIGVFEMKEGGLSEVRNPSELFLAERPLGVSGSAVVTTIEGSRPLLVELQALVTPSSLGVPRRTTLGVDHNRLALLVAVLDKKVGLHLSGQDIFLNAAGGARLSEPAIDLGMVAALASSHLDKIIDPHTVIVGEVGLAGEVRAITQAETRVREAAKLGFTRAVIPAGSVRQVGDVPGMNVVGVKSLDEALEQLF

SEQ ID NO: 23181 - protein, 427 aa, Geobacter sulfurreducens PCA
MLTARSKDLFTQAQEFIPGGVNSPVRAFKSVGADPLFIKKAFGCTITDADNNSYIDYVGSWGPMILGHCHPQVVEAVKRAVESGSSFGAPTELEITLARMVIDAVPSIEMVRMVSSGTEATMSAIRLARGYTGRDKIIKFSGCYHGHADALLVKAGSGAATFGVPDSPGVPVDVAKNTLTAQFNDLDSVSKLIDENKNEIACIIVEPIAGNMGTVPPGEGFLEGLRSICDSEGIVLIFDEVMTGFRVAYGGAQELYGVTPDMTTLGKIIGGGLPVGAFGGKKDIMKLLSPSGGVYQAGTLSGNPLAMTAGIETLKLLQADGFYEQLEQTSRRLAEGITEAAKSAGYPIYPTRVGSMFCTFFTSNEVKDWPTATTCDTKAFAAFFRMMLEKGIYLAPSQFETAFVSIAHTEVEIEKTIVAARSCFAAL

SEQ ID NO: 23182 - protein, 307 aa, Geobacter sulfurreducens PCA
MPLLTNDKVIEQIGNTPLLRLAKLERKGSAAVFGKAEFFNPGGSIKDRICLAMIEAAERDGTLKPGATVVEPTSGNTGIGLSMICAVKGYKLILTMPDTMTVERRRLLAAYGAELILTPGAQGMRGAVMKAEELAAQPGHVMMHQFKNPANPDIHRRTTGPEIVETLSGTTIDAFVAGVGTGGTITGVGEVLRTHNSSVRVVAVEPADSPVLSGGQPGPHKIQGIGAGFVPDVLNTKVYDEIITVSNDDAYATVRDLAREEGILVGISSGANVFAALQVAAKLGPGKNVVTILCDTGERYLSTGVFD

SEQ ID NO: 23183 - protein, 330 aa, Geobacter sulfurreducens PCA
MRAMLFEEVGKPLRPVRVPVPEPGPGEVLLKVHACGICRTDVHIVDGELTEPALPLIPGHQIVGSVAKLGEGVERFREGTRVGVPWLGATCGACRYCRSGRENLCDHARFTGYQRDGGFAEFTVADARFCFPIPGGYPDLQAAPLLCAGLIGYRSLVMAGEGERLGIYGFGAAAHIVTQVARFRGWRVYAFTRPDDRAGQAFAREMGAVWAGASHERPPEELDAAIIFAPAGELVPAALRAVGKGGVVVCGGIHMSDIPPIPYDILWGERSIRSVANLTRRDGEEFLALAPKVPVRTEVTAYPLSAANEALDDLRRGRLRGAGVLVIDEG

SEQ ID NO: 23184 - protein, 1010 aa, Geobacter sulfurreducens PCA
  misc_feature (191)..(191): Xaa can be any naturally occurring amino acid
MGISRRQFLQGGALAGAALALSGTPGEASADSPDLRTKGTKVTTTVCPFCSVGCGLIVHTKDGKVINAEGDPQHPINQGSLCPKGGALFQIANNDKRLQKVMYRAPGSDKWEEKSWDWALDRIALRMKETRDKSFKKTELNKKDNKEYVVNRTDGMAFFGGAGLDNEECYLWTKFARAMGVGQLEHQARLXHSSTVAGLAASFGRGAMTNHWIDLKNSDVIFAIGCNPAENHPISFKWIEAALDNGAKLISVDPRFTRTSSKADIYAQIRPGTDIAFLGGMINYAIQNRMIHEEYVREYTNATFIVSEQFDFQDGMFCAFDDQEKVYDLKSWAYSTGADGKPKRDMSMKDPKCVYQLMKNHYKRYDIDTVCAITGTPKEDYLKVVKAFCATGRPDKSGTILYAMGITQSTHGSQNVRAVALLQMLLGNIGIAGGGVNALRGESNVQGSTDYGLLFHILPGYLKSPEFDNVDLKAYVEKWTPKTKDPKSANWWGNTPKYTVSLLKAWYGDNATAENDFCYDYLPKRMGNYSYVKIMEKMAKGELEGLVCMGMNPAVGGPDSVAAREALGKLKWLVTADLWETETSIFWKRPGVDPKSIQTEVFMLPAASSIEKEGSISNSGRWAQWRYAAVHPLGDSRSDLHIIDEFYKRIKALYLKDGGAFPEPLTKLAWNYGTGHEPDVHLVAKEINGYFTKDVTIKEKDKVLEFKKGDQVPMFKYLQDDGSTVSGCWIYCGSYTNEGNQMARRDPSDPTGLGLFPKWTWCWPVNRRIIYNRASVNPAGEPFNPKRPVIAWDALEKKWKGDVPDGPWPPMKDDKEGKYPFIMLPEGHGRLYALDMKDGPFPEHYEPVESPAKNLLSKVQTNPVVKVPSNVSSDTSKFPLIGTTYRVTEHWQAGAMTRSLPWLVELVPDMFVEISETLAKQKGISQGDMVKVSTERGSIQAKALVTSRLKPFNVQGKLIEQVGMPWHFGYAGLATGDSGNVLTPTVGCANTGIPEFKAFLCNIEKGGKAA

SEQ ID NO: 23185 - protein, 257 aa, Geobacter sulfurreducens PCA
MSDVKPLIQLENITKRFKSLTAVNGVNLAVHPGEKLVIIGPSGSGKSTLLRSINFLEEIDEGTIRFEGNEVGYVRRHGKLHLDKQPVICALRAEIGMVFQHFHLFPHMTVLGNVMEGPLTVQKKSAAESREIALAMLAKVGLTDKKDVYPATLSGGQKQRVAIARAIAMRPKLMLFDEPTSALDPELVGEVFDTIHALADEGMTMIIVTHHMGFARELADRVIFMEKGNFLAEGTPQEFFAEGMNNERIQSFLNRIL

SEQ ID NO: 23186 - protein, 248 aa, Geobacter sulfurreducens PCA
MIRLVDVHKSFGSQVVLDGLTMEIPEGKITAVIGPSGEGKSVLLKHMIGLMKPDRGEVFVEGENITTMRRYQMNRVWEKFGMLFQNAALFDSLTVFENVAFPLEEKTHLSRSEISDRVHDALEHVGLRNVDKKFPDELSGGMKKRVGLARALLLNPRIILFDEPTTGLDPIICRAIHELIRETHERFGYTAVIVSHEIPEIFDISENVAMLYRGKIIEQGTSEDIRRSEHPVVRQFISGSLEGPIQFI

SEQ ID NO: 23187 - protein, 444 aa, Geobacter sulfurreducens PCA
MKTVIIGGVAGGLSAASQIKRADRDAEVIVLEKSGDPSYAACGMPYNLFFKDTPVEALYALSLDTIRNGRGIDYRLRHEAVAIDPRRQEVTVVDHEQNREYRERYDFLVYATGNRPAPLPLPGFDDPAVCYFKTLDDTRRVKRLIHDQAPACAILVGAGYTNLEVADVLYNMKIRPVIVEKAPAILPAFAAEIRDKVMEKIAEKGIEFHAGVDVQGKEGATVRTTAGDFDAGLVVVAIGVKPNTGLFAAAGGELGAAGAVKVDQFLQTNLPGVFAAGDCAEHYVRQLGRNSYMPLGPVANKQGRLAGNNIAHRDAMTMFHGIDQTAAFKFFDLTIATTGLNERQLREMGTDFGKIHVDTPTRGSFPGGGTMRTVLLFEKGTGLLLGGQMVGQDVVAKRLDVLAVAVYKQMTVFELAELDLSYAPPYAPVWDPLLIAANQAVKAV

SEQ ID NO: 23188 - protein, 407 aa, Geobacter sulfurreducens PCA
MERHFDIVIIGNSAAGMQALRTIRRHSRSVSVAMVDRENCPAYSRVLTPYYVGGKTLRGNLFIVGSDFYDHYGIATLLGHAAVELDAERHRLLLADGTAVGFGQLLIAAGAEARGLEVTAEGVCTLRHLADADRLERLLKGARSVTAVGAGLVSIPLLSHAGPEVERHLVIGSDRVFSRVVDPEASAILEERFLADGLVLHKRDDIVNLSGTDRLELSLATGKRIVTDMLLVGKGVVPNTDLALRAGLEVREGIVTDERCRTSHPQIFAAGDVAEGKDFVTGEPTIQGNWLTAVEQGEIAALNMLGFDCAYEGSLKNNTTEVFGVDVAVVGYCRDDAPRTATARDPFTGRFRKVFLDGRDRVIGATMIGETNDAGLYYQLVRTRALFPGPTFLRGTGTQAAALARLA

SEQ ID NO: 23189 - protein, 254 aa, Geobacter sulfurreducens PCA
MSGGEQGIRMDKVSYSVGGRTILTEFDLFLAPGVNRTILGRSGAGKTTILRLMLGLIRPQAGTISIDGIPIGSLSESELIRLRKQIAIVFQGGALFDSLTVGENVGYRLLEEGRLGEGEIERIVLEKLSFVGLEHSIDLYPAELSGGMKKRVAIARALAAEPRYIFFDEPTTGLDPVGVYNIQHLMLRLQGEGKTTLMVTHDLETAFAVSERFSFLHEARLLFEGTEEEMRRCAVPDIREFLTPSEASLFRNSD

SEQ ID NO: 23190 - protein, 185 aa, Geobacter sulfurreducens PCA
MSVTLDEIKQVYQEADCLFSEAEVEAAIGRLATAVTERLAEANPLVFCVMNGGLIVTGKLLPRLGFPLEIEYLHATRYGHHIFGKSLDWRVRPTVDLRGRTVLIVDDILDEGATLDAITEWCLQEGAAKVFTAVLVDKEHDRKARPGLKADFTGLVSPDRFLFGYGMDYKGYWRNAPGIYAVKGY

SEQ ID NO: 23191 - protein, 433 aa, Geobacter sulfurreducens PCA
MKHFFQFERYNTTYRKETVAGITTFLTMAYIIIVNPAILEAAGIPRGPSTTATIVAAVFGTVVMALYANRPFAIAPYMSENAFIAFTVVKVLGYSWQTALGAVFVAGVLFTVLTVFKVRSWLAEAIPLSLKCAFAVGIGLFLTFIGLNETGLVTLGVPGAPVKMGNIASPSVLLAVFGYLLTVFLMTRKIHGAIVIGIVATTVLSVACGVTPMPTEFVSMPPDLSPILFQLNIGDALDIRFFPVVLTIFIMAFLDTVGTLIGLSMRADLLDEKGNLPEIEKPMLADALATTVAPLLGTTTTGAYIESATGIEEGGRTGFTALVVAGLFLMSLFFAPLFTIVPPHAYGIALIVIGSFMIEPLRRIDFEDFTELVPAFLTIVLMIFTYNIGVGMSTGLLTYPLLKTAAGKRHQVSAGMWVLAGLAVLLFVFFPKM

SEQ ID NO: 23192 - protein, 475 aa, Geobacter sulfurreducens PCA
MAKRYKVLVGGEWTGDDRPGIEVVNPYDDSVIGVVPEATNEDVDHAIRAAQAGFAEMSALPAYRRSDILDRTSELIKRDREEIAEIIAREAGKSWKFALAEADRSAETFRFASLEARNAHGEIVPMDASPVSAGRFGFYLRTPIGVIGAIAPFNFPLNLVAHKVAPAIAAGNAIVLKPATKTPLSSIKLAELMVEAGLPAGALNLVIGSGRTVGNRLVEDDRLAMVTFTGSPPVGVQIKERSGLKRVTLELGSNSPTIIEDDGDVDAAVARCVVGSFANSGQVCISVQRIFVHQRRYREFVDKFVAATQKLKVGDPMDRDCDIGPMISREELQRAVEWLGEATSLGARLETGGTVAGNCLTPAILSGVTPDMKVVCSEVFAPIVSVIPYETFDQALDMADDSIYGLQAGVYTSDINKAFKAIRRLDVGGVIINDIPTFRVDHMPYGGNKQSGLGREGIRYAMEEMTNIKFVCLNL

SEQ ID NO: 23193 - protein, 357 aa, Geobacter sulfurreducens PCA
MYVVILAGGSGTRFWPLSRKAHPKQLMSVFGGKSMLQRTVERVIPLNPKRILVVTNHLQADETRRQLEYLRGIRIDVIEEPMGRNTAPAISLAATLIARHDPEAVMAVLPADHYIADEDAFCAALQRGREPAMNGWLVTFGILPDRPETGYGYIEADRHLRGDGPYPVKRFVEKPDAATAAQYLAAGGFYWNSGMFMWRADVILDRIANHMPDLARAFAGIAFDADIWEPADLAPQIEAVYAMVSGQSIDYGVMEKADNVLVLPASFGWSDVGSWSALPGLIAPDGDGTVRLAGETVISVDSAGCVVRGEKLVALVGVRDLVVVDTPDALMVCARDGAQDVRKIVEELERRGLKQYL

SEQ ID NO: 23194 - protein, 272 aa, Geobacter sulfurreducens PCA
MHGLAPSFFHKEGCDCRVDLTDTRGVSIRIENLNKYFGEKHVLKDVNLAINAGETFCIIGPSGTGKSVLLRHIVKLDRPDSGEIFIDGHPVFVNAGKDTPSDYRYSMVFQSSALFNSLTVGENVGLWLREKRICKEHRIREIIREKLAMVGLENTEQLKTSELSGGMKKRVAIARSLAMNPDLILYDEPTAELDPVTTDELANTILKLKETTKNTTIIVTHDLNFALYVSDRIAMMHDGRIVDVGTPTEIKASQNPIVRGFIYTTTKGIKGE

SEQ ID NO: 23195 - protein, 436 aa, Geobacter sulfurreducens PCA
MNYVIIGNSVAAVGAIRGIRSIDQQGNITVISRERHNAYGRPLISYLLGGLVSEKRMAYLPEDFYEKNRVNLLLNSEVTGIDTAARQVRIAGGDTIGYDRLLVATGGDPFIPPIEGMADKDRIFTFTTWDDAAKLKGIASDIGRVVVIGGGLIGLKAAEGLHLIGKQITIVELADRILSAAFDRPAGRVVAKKMKANGIDVITEDTVVRIEGEGAEITGVTLRSGDFIPCDTIIVAIGVRPACGFLKGSGVEVNRGIVVDDRMETSVEGIYAAGDVAEAKDFFSGVKNPMPIWPDAYIQGDIAGVSMAGGTKAYEGGLAMNSIELFKVSTISMGITNPAEPKEYEILTYQDLENYQYRKIVIKDGLLAGAVLVGAVDRAGIFSGLIREKIAVVPFKDQLLAPDFGFANLPKDIRTALFAPAGKVTETGRPAVAVGH

SEQ ID NO: 23196 - protein, 2082 aa, Geobacter sulfurreducens PCA
MNVTTLWGGWFKALLAAAFILATLGAPAAGWSAVPHVAAGGNHVLTLRSDGTLWAAGSNQFGQLGDGTGINRTSPVQVPGTWKTVAAGTTHSLGIKADGSLWAWGSNLFGQLGQPLVNGQLATNKFSPIRIGTGNDWVAVSAGELTSFGLKGDGTLWSWGNNLFGELGDGTTVSRPQPVQVVADPLSNGRYVAVAAGGEHALALQADGTLWAWGANLTGQLGTGGTGILPNPTPLKIGTDRDWTAISAGEMHSVALKADGSLWSWGQNLFGELGNGVALPGANVTTPTRVGTGSDWVAIAAGALHTVALHRNGTVSAWGNNAQGAVGDGTVANRSTPTLIVAPVTLVNNVAIAAGTGVSFSVLANGTVFGWGGNGAGQLGNGTFGAVTAPTVLSAGASAWLGVEPGGAFSLGLRSNGTLWAWGGNASGQLGDGTTTPSAIPVPVVGGAGNWRTTATGTAHSVAVRADGTLWAWGDNSSGQLGIGSTVAASTPQQITVTNPASAGNDWTAVAGGGAHSLGLKADGTLWSWGDNTFGQLGDGTGTSNRTTPVQIVTGNPGNFDRNWVAVAAGGVFSLALQADGTIWTWGDNSLLQLGTDPAMLTPATQRNVPAQLAVASPPSTAFNSSWVAIAAGQDHGLSLQADGTLWAWGANSVGQLGNGVTTATFTPVQVINAEGVPYVSLAAGTSHSLAGRSDGTLWAWGNNTSGQLGTGPHPGDADPLNPQPHTVPARILTSNPVSAADDWLVATAGGSHSAALKSNGTLWTWGQNTSGQLGNGTTTEADIPTALLEPRISVSPASLAFGPAPIGIPPSPTRTLTITNLGSAPLSAAIASNNAAFTVNPAACNNLPPAGFCEITVTFVPALPVGVKSATLTITSNDPVTPLVSVGATGTAANPFFITASVDPASPVGSGTISPAGVQAVAAGGGATYTITAASGYAIVDVIVNGVSRGPIGSYTFVNVQQDQSIIALFAASVTISASSGPGGIISPTGTVSLPLGGSQKFTITPNPGYAIAGVNVIEMVEQLDVNGNGTGIFNPVPRALGPVSSFTFFSVRANGSSISATFVPRELHEWSWQNPKPQGQAISRIATDGNGTYVAVGEFGTILTSTDSVNWTVRTFGSVNLNSVAYGGNHTFVAVGSYGRILLSTDDGATWTVQSSGVTASLRGVAHSGTVFAAVGVTENNPNFPYEPRTAILTSPDGVTWTSRFLDQPFNGTLNLFDVAYGGGRFVAVGMEGHVVISEDNGGSWTALPSDPVTRPTNLNGVAFGAGTFVAAGDFGQIVTSTDGSNWVNRPLMSVAELKGVGFGTISDPLFAGNLLQVFTVVGTDGEILTSEDAGTTWTFRTSGLAAGGAGPMLQAAMVGLNRGVTPFVPTVIVAGSEGNLLASSDTIDWTNLFTTITRYPLRSIAWGNGTFVAVGDGDPGTTLHPPISAPTVLTSTNTGLTWTRRYLSPGHNIRGIAYGNGVFVAVGASGYDLDQNASRQAIILTSTNGITWTPRNSGTFLNLNAVTFANGRFVAVSDYNATGDVADEGALILVSTNGITWNTIRKITSTAGNLRSVIAGTNGTTPALVAVGDFGTVLRSIDNGQNWTEVTSGTINFAELNGIAFNNTSNTYAAIGITSEVFTSTDNGATWSMRSLPVDDTLLVRMEGITYAYGSFVAVGNDNHILTSPDGASWTINIGAEYINSSLYGVAAGNGSYIAVGSDGTILQSNRLLDNPPIIGVDPTSLTFDITPEGTLSAGQVITISNLGINDLTIGALGFDGSDAGEFTVSEDFCSQAVIPATGSCTVVVTFAPTGAGVKSAELKIPSNDPDSNDIEVPVSGTAIPRYLLTVTNAGNGTGSIASSPAGISITNSAAGANSSALFVVDTAVTLTATPAVGSIFEGWSGAGAGACSGTTTPCTLTMSQARNVTATFTRKFIITATAGANGSISPAGQVLVNPGANQAFTITPAPGYSVFGVLVNGLSVGAVTSHTFTAVNADQTISATFTGVPPVRLTLQSGNNVFSTIGQAVAATPVNTAATIDAQAVQTADNGLTLNRGITLTFRGGYGAGFSGIVGMTTVTGPVTVTNGSLTVSDMVIK

SEQ ID NO: 23197 - protein, 505 aa, Geobacter sulfurreducens PCA
MSDNFASPHDRDLDERVRPPGWINPSPAPRYDLVVVGAGTAGLVCAAGAAGLGARVALVERHRLGGDCLNYGCVPSKALIRAARAAHDAGNGAPFGVTGCHGTGVDGAAVMERMRRLRAEIGRHDAAVRFRDLGVHVFFGQGSFISRNALEVDGRRLNFVHAAVCTGARAAAPPVPGLAEAGYLTNETIFSLATLPARLAVIGGGPIGCELAQAAARLGSSVTVIEAAPEILPREDTDAAALVRHALERDRVSFLTAAAVVGVERRSGARTLIVRQGDQSHEVTADEILVGAGRTPNIEGLGLERAGIVADPLRGVRVNDRLRTDNPRVYAAGDICSPYRFTHAADAMARIVVANALFGARQRFSTQIIPWCTYTDPEVAHVGLYEREAGERGLAVDTLTVPLTEVDRALLDGEDEGFARVHLKRGTDRIVGATIVARHAGEMLNELTLAMSAGLGLSAIGRSIHPYPTQAEAIKKLADAWNRTRLTPGVKRLMGIMLTLRRLWR

SEQ ID NO: 23198 - protein, 343 aa, Geobacter sulfurreducens PCA
MSIEIANVTKQFGSFTALDNVNLAVPSGELTALLGPSGSGKTTLLRIIAGLETPDAGSIRFDGEETTDRHVRERQVGFVFQHYALFRHMTVEENVAFGLTVKPRRERRPKQEIRERVHELLRLVQLEGLAARFPSQLSGGQRQRVALARALAVEPKVLLLDEPFGALDAKVRVELRRWLRRLHDEIHVTSVFVTHDQEEALEVADRIVVMNRGRIEQVGTPAEVYDQPANPFVFDFLGSVNLFHCRAEQGQARAASPDLPVGYVRSHDIEVERSQTADAVEAQVRHIQSVGPAVRVELLVRGTGKTVEAELSRDGAERLALSPGETVYARPRRIQTFVEDYQI

SEQ ID NO: 23199 - protein, 350 aa, Geobacter sulfurreducens PCA
MKYLPLGSTGLTVSECGFGCIPIIRLPQDEAVRVLRHAFDRGITFFDTANAYRDSEEKMGIAFAGIRHKLVIATKSLLRSAEGVTGHVENSLRKLGTDYLDLYQLHQIAQEKDWAEVTGPSGALEAAMAAKAAGKVRHVGVTSHNLEMALKLVRTGLFDTIQFPFNLIEEGAKDELLGAARDAGMAFICMKPFGGGVIDNAAVAFTYLRSHDGIFPIPGFESCAQVDEVLSFYERDNVVTEQDLAIMEQYRRELGKRFCRRCEYCQPCPQGVMITPAMGYPIVASRMSPAVAAEFCSKAMETVPLCTECGACIARCPYELPISDILKANYAMYRGHVAGSQGGFAGGKSS

SEQ ID NO: 23200 - protein, 365 aa, Geobacter sulfurreducens PCA
MSHLFEPLTIRSLTLPNRIAVSPMCMYSSEDGFANDWHLVHLGSRAAGGAGLVLTEATAVTPQGRISPRDLGIWRDEHIEFLARIVHFITQRGSTAGIQLAHAGRKASTPAPWEQRTATLSGAEGGWPIVAPSPIPFDEGCIVPQELSTGEIDAITAAFVDAARRSLLAGFQIAEIHAAHGYLLHQFLSPLSNQRTDQYGGSFENRTRLLRTVVTAVREVWPEHLPLWVRISATDWVDGGWDIEQSVELVRRLLPLGVDLIDCSSGGSAPHARIPLGAGYQTQFAERIRRETGGRTGSVGQITAPAQADHIIRSGQADLVLLARELLRDPYWPLRAARELGHQSPWPAQYVRAAPHNTPAYLPKD

SEQ ID NO: 23201 - protein, 288 aa, Geobacter sulfurreducens PCA
MLRKVGFLGLGTVGRHMAANLLKGNYELAVYDSDPAAVADLAALGATGAATPREVAKGRDIVIHIRPEKERLRPDIYGPDGIFAGIDPGTILVDMGTHSLTSTMEMADEAAKHRVMFLDAPVWGTKEHAANGLLTILAGGDPSLVGRCRELFSFFGLNIIHVGSIGDATRMKFVVNLVQAELMQALAESIVFGEKLGFTADRILEVLDSGGVASPLFHSKGRSIARGDFTRNLALKYVHEQLELVLEKAEKLGLELPAAKVACATYEQGVKDGRGEEDFSSVVKVLRK

SEQ ID NO: 23202 - protein, 125 aa, Geobacter sulfurreducens PCA
MITIDFQKMGGLIPAIIQDHATNEVLMVAFMDEKTLNLTLESGKTWFFSRSRNKYWMKGEESGNTQEVVEVLTDCDADAVVIKVKQNGPAACHTGNRSCFYVRWEDGQWVEHSEPLFDPAEVYKK

SEQ ID NO: 23203 - protein, 453 aa, Geobacter sulfurreducens PCA
MPDYDTQTLRDWDRRHIWHPFTQMKEWEESEPVVIVEGEGSWIIDSEGKRYLDGVAAIWTNVHGHCRREINEALKAQVDRLEHSTLLGLTNDRAVVLAKRLAEIAPPGLCKVFYSDNGSTAVEVGVKMAFQFWRHEGKPEKSRFISFTSAYHGDTLGAVSVGGIDLFHGVFRPLLFPTIQAPAPYCYRCPMGRDTPAACGMECLTELERIMESHAGEVAGLVIEPLVQGAGGMIVQPEGFLKGVRELCDRHDILMIADEVAVGFGRTGAMFACGREGITPDIMALSKGITAGYMPLAATLATQQVYDAFLGEYREMKTFFHGHTFTGNPLGCAVALASLDLFESDRLLGKLPNKIKLLQEKLKGLIELEHVGDVRQCGMIAAVELVRDRATKEPFDWEERVGVRVCLEARTHGVFLRPLGNVIVIFPPLAITAEEIDFLVDGLEKSIHTVTGG

SEQ ID NO: 23204 - protein, 247 aa, Geobacter sulfurreducens PCA
MRTLVLIRHGESVWNRENRFTGWTDVGLTDKGAAEALRAGRTLKNEGFAFDEAFTSVLKRAIKTLWIVLEEMDQMWIPEHRHWRLNERHYGALQGLNKAETAERHGMEQVHVWRRSYDIPPPPLAAGDPRNPARDPRYAELDPADIPLTESLKDTVARFLPYWHETIAPRILAGRRLLIAAHGNSLRALVKYLDGIGDDAIAGLNIPTGIPLVYELEDDLHPIRSYYLGDPDEVARATQSVADQVKR

SEQ ID NO: 23205 - protein, 327 aa, Geobacter sulfurreducens PCA
MIQKPNIVILDGYTINPGDNPWTPLEKLGDCTIYDRTPPELRVERAKDADIVLTSKVKLDEATLAALPKLRYISMLATGYNNVDVEAAGKRGIPVANIPAYSTESVVQTTFALLLELAVHVGIHDSAVKAREWVRSPDHSFWKTPIVELDGLTLGIVGYGTIGRAVARVGAAFGMKIMAYAPRVPADLGPVPVRFVSLDELFAGSDVVSLNCPQTAENTGFVNSRLLSLMKPSAFFLNVARGGLVNEVDLAAALHSGKLAGAGLDVVAHEPMSPDNPLLGAPNCIFTPHLAWASLAARRRLMGILAANVATFLAGEPQNVVNSRFLK

SEQ ID NO: 23206 - protein, 470 aa, Geobacter sulfurreducens PCA
MTPQEVVSFAKENGALMVDYKFMDFVGIWQHVSVPISEFGEDTFEEGQGFDGSSIRGWQPIHASDMILLPDPATAKMDPFIAVPTLSLICNVFDPITKEDYTRDPRNIARKAEAYLKSTGLGDTAFFGPEAEFFIFDDVRYDSTSNQSFYMVDSVEGAWNTGREEFPNLGYKPRHKEGYFPVSPTDSQNDLRNEMVMELQKVGIRVECQHHEVASGGQAEIDMRFSSLVDMADQLQWFKYVIKNVAYRNGKTVTFMPKPLYGDNGSGMHCHMSIWKDGQNLFAGDKYGGLSQMALWYIGGIIKHAKALCALTNPTTNSYKRLVPGFEAPVNMAYSSRNRSASIRIPMMSTNPKAKRIEYRTPDPSCNGYLAFAAMLMAGLDGIENKIDPGQPLDKDIYGLSPEELKNIPSAPGSLEEALKALEADHEFLLKGDVFTPDVVEKWIEYKMEAEVNPVRMRPVPLEFALYYDI

SEQ ID NO: 23207 - protein, 472 aa, Geobacter sulfurreducens PCA
MHRITFGTSGWRGILCEDFTFENVKVVSQAIADHVKAIGEQDKGIIVAYDTRFMGERFAKETVRVLAGAGVKAYFCRRDTPTPVISFEILRRGTAGAVNFTASHNPPEYNGIKFSPSWGGPALPETTGDIERRANEMMGEVCYREMALDEAVKAGLLEEIDPREEYLKALESKVDFDAIGRVGSVAVNALYGTGRGYLEEPLITRGLDVKAINMHRDPYFGGFPPEPSEKYIQDFIRLVKDDPAIRLGIATDGDADRFGIVDGDGTFIEPNYIIALLFDYLVRVRKMTGAVARSVATSHLVDAVAKKHGIEVIETPVGFKYIGELISQDRIIIGGEESAGLSIKGHVPEKDGILACFLVAEMVAREGLSVKALLARLYEEVGTFVTKRENITLSPAVEEGYAEKQRQAPDSFAGLKVTQKVTVDGSKFILEDDSWLLFRKSGTEPVVRLYAEASSEEKLAAVMAAGKQFILG

SEQ ID NO: 23208 - protein, 422 aa, Geobacter sulfurreducens PCA
MKVVTVGTGMAAAEFVERLRLDGFAGEIVMCGDEEFAPYSPCVIPFYLAGEPLETVYWKGSDFYGRYRVTPRLADPVVEVDAERRLVRTASGRSEQYDRLFYAAGARSWYPRPDWLDTRGVFGFKTLSDMVAIDRYIREHNVGEAVVFGGGFIGVDAALALWHRGLAITLVHRNTRVLSQMTDEEGGQFATAKLVEKTGMDIRLRTTVADIVTTGGELSAVRFSDGTARETKLLIVAIGVSPNSEPLRGDDKGVPSDRQMLAEAGIYAAGDVAVTPHAVTGEAGVYATYPNAMRQARTAARHLLNGDGSYAGSVNTNVLKKHIDFPIVSAGSFTGEPVTWQRGDVWRRVYLKDGMINGYIIIGDTKMSGYVYQLYVSRQRVDGTIRTILSSPRHDAYYRQVTGCGAGRASGRGYGMQGVMAG

SEQ ID NO: 23209 - protein, 491 aa, Geobacter sulfurreducens PCA
MLDELIPEGLTFDDVLLVPAHSQVLPRDVSLNTRLTRNITLNIPLVSAAMDTVTEARTAICMAREGGLGIIHKNLTIEEQAMEVDKVKKSESGMIVDPITMRPNQKIHEALAIMEKYRISGVPVTNSKGKLVGILTNRDLRFETNLDLPISARMTKRRLVTVAVGTTLEEAKEHLKHTRVEKLLVVDEEKNLKGLITIKDIEKVRKYPNACKDALGRLRVGAAVGPSGDMEARVDALVKAGVDVIVVDTAHGHSQGVLDAIRTVKANFPGVELIAGNIATAEAAEALIKAGVDAIKVGIGPGSICTTRVVAGVGVPQISAIAQCAKVARKYDVPLIADGGVKYSGDVTKAVAAGADVIMIGSLFAGTEESPGDTILYQGRAYKSYRGMGSIGAMKQGSKDRYFQSDVESEVKLVPEGIEGMVPLRGPLSANVHQLMGGLRAGMGYTGCRTVRELQEKGHFVRITGAGLKESHVHDVMITKEAPNYRVENVR

SEQ ID NO: 23210 - protein, 403 aa, Geobacter sulfurreducens PCA
MKNIINFRMAAVLASCTLLSACADGDLPYSDSTSISSPAYSHSAVFQNMTTLAVWGNNESGQLGDGTTTSAATPKRLRLGFATYSSGFATGASHTLAIARFDNVSGVRAWGSNSAGQIGRDPATVPTSSTPVKIGGFGGAVQQVAAGGLHSMALAGGTVWAWGSNSAGQLALNPISSATRFAPRQVETAKLPIAPTAIVAGGSHSIAYTSTEAYAWGNNASGQLGNGTTLSNHMPQKVQLPSSITIRKISAGGSHNLALDSTGAIWAWGSNAYGQLGNGTTTNQSTPVQLTLPAGVTGFIDVFAGPSHSVAVASNFTVYTWGFNTLGLLSVGTTGDQLSPAQVRDASNVPFTDVERVVLLGSFFTIVKKNGSGGMWAWGYNGYGQLGDGTTSNRTAPVQVALP

SEQ ID NO: 23211 - protein, 428 aa, Geobacter sulfurreducens PCA
MSEITDVYAREILDSRGNPTLEVEVFLESGVMGRAAVPSGASTGEREALELRDGDASRYLGKGVLKAVDNVNDIIAEQLIGMEATDQVGIDRRMLELDGTEYKSTLGANAILGVSLAVAKAAAEEVGLPLYQYIGGCNARELPLPMMNILNGGAHADNNVDIQEFMIMPAGARSFSEALRMGAEVFHALKSVLKGKGYNTAVGDEGGFAPNLKSNEEALEVIMEAIAKAGYKAGEDILLALDVASSELFKDGKYFLENEAKPEKTADELIDFYENLVNKYPIISIEDGMAENDWEGWKKITDRLGKRVQLVGDDLFVTNTKILKEGISKGVANSILIKLNQIGTLTETLDAIETAKRAGYTTVISHRSGETEDTTLADLAVAVNAGQIKTGSLCRTDRVAKYNQLLRIEDELDVTAQFRGKDVFYNLR

SEQ ID NO: 23212 - protein, 481 aa, Geobacter sulfurreducens PCA
MRYSPLLTDLYQLTMLAGYLDEGMAETPAVFDLFFRHNPFQGGYAVFAGLDTALDFLEHLEFSEDEIEYLQGLGLFRPAFIDFLRSFRFRGRVTAPPEGTVVFANEPLVTVDAPLAQAQLVETALLNIINFQTLVATKAARIVHAAADGTVLEFGLRRAQGPDGGLSEARAAYVGGVRSTSNVLAGKTFGIPVRGTHAHSWIMAFSDELTAFRKYAEVFPDSCILLVDTYDTLRSGLPNAITVARELRAKGHELVGVRIDSGDLAYLSRQARRLFDEAGFPNVRIVASNELDEFVIESIRAEGGCVDIYGVGTRLATCAGEGGGALGGVYKLVRIGDRPRLKVTSDLAKATLPDRKRLLRAVAADGTFIQDVICLDGEEVLPGHTVFDPANPLQHVTIPMKARLEDVRSVAMENGRRTASRSVSLDRMADRSRNQLALLPQGCLRFINPHRYKVSISQGLNDLRLRLMEEVRHGYHDIANP

SEQ ID NO: 23213 - protein, 250 aa, Geobacter sulfurreducens PCA
MIYLFSHAGLRDLRDFIDRSTLFAFDLDGTLAPIVSDPAGIMIPPDVHERLVRLNGTASVAVVTGRARVDAARHLGFAPRFLVGNHGAEGLPGADAAEREFIGLCRGWMTQLGELLPEGEGTGIVMEDKSATLSLHYRNAPDRENAHQRILAAVSRLLPAPRRVSGKLVENLVPAAAPHKGDALRCIMRHLGCARALFVGDDVTDEDVFRLGDEAIFGIRVGNSGGSAARYFIRGQDEMAPLLDEILAVL

SEQ ID NO: 23214 - protein, 1111 aa, Geobacter sulfurreducens PCA
MARRTPLSDDTPLWYRDAVIYQLHVKAFADSDGDGVGDFRGLMGKLDYLQSLGITAIWILPFYPSPLRDDGYDIADYYNVNPSYNTLREFREFLREAHARRIRVITELVLNHTSDQHPWFQRARRAKPGSVHRDYYVWSDTPDRYRETRIIFQDFETSNWSWDPVAKAYYWHRFYSHQPDLNFDNPRVQSEVLRIIDYWLGMGVDGVRLDAVPYLFEREGTNCENLPETHDFLKRLRGHMDASFPNRMLLGEANQWPEDAVAYFGEGDECNMLFHFPLMPRMYMAIEMEDRFPVVDILDQTPAIPEGCQWAIFLRNHDELTLEMVTDEERDYMYRIYASDPKARINLGIRRRLAPLLGKDRRRIELMNALLFSLPGTPVIYYGDEIGMGDNYYLGDRNGVRTPMQWSPDRNAGFSGANPQRLFLPVIIDPEYHYEAVNVDIQERNPTSLLWWMRRIIAVRRRYRAFSRGAMEMLYPANHKVLAFLRRHEDEVILVVVNLSRFAQAINLDLQEFAGISPEDLFSRNRFPVIREATYPLTLGPHDHFWFLLRRREAPLQAEEELPRIRLRGELPWWETLRQTRGDAHLERVTTDYLKRSGWFRGKARAIIGYVLRDTVLLRQGERVFPIFFLEVRYQDGPPETYLIPVAFLTGAGAKRVSAESPRAAIAALSVGDEEGILCDAVHDREFRDALLALALGRRRLHGEENSLIVPVHAGAGRIGSREEMRHLASELPKAEQTNSIITYGDRHVLKLYRKVEPGINSEVEMARFLTAKSSYPNVAPFQGSLELRHPGVEPGAIGLLQGYVQNQGDGWRLSLHLLGQYFERILSCRGELPPPPSRFSSLMDGSACTVPEPAAELIGGFYLEMAGLLGRRTAELHLALAAGGNDPAWRPEEYSTLYQRSVYQSMRNQARRSLQLLAQHHKDLPAEALASADRILSAEKELLACLRPIVGRRIQAMKSRIHGNFRLEKVLFTGKDFMIIDLEGEPDRPLGERRIKRSPLRDVAGMIRSFHNATLTALARHGAGHPGDIPLLEPWAEACWYHVSCRYLAGYLEQMGTSPLVPTERSDLETLLRSFLLDNALHELGYALANRPERVSSYLRGVETVLREFR

SEQ ID NO: 23215 - protein, 128 aa, Geobacter sulfurreducens PCA
MELERGERPWGTYTVLEENKNYKIKRIEVKPGQRLSLQMHHHRSEHWIVVSGTARVTCGDDEYTVNVNESTFIPIGRNHRLENPGKIPLVIIEVQSGEYLGEDDIIRFDDDYHRCEAAAATCAEEEGA

SEQ ID NO: 23216 - protein, 280 aa, Geobacter sulfurreducens PCA
MAWFKRDKAPGAADKKVKVPEGLLTKCVSCKENLLTKDLEKNINVCPKCGHHYRISARQRIDLLLDPGSFTEYDAAMTSVDVLDFKDSKSYKDRIQQAVAKGGSRDAVICGEGAIEGIPVQMAVFDFSFMGGSMGSVVGEKITRAIERGIEKRTPVIIISASGGARMQESILSLMQMAKTSAALAKLKELGLPYISILTDPTTGGVTASFSMLGDINMAEPKALIGFAGPRVIEQTIRQKLPEGFQRAEYLLDHGMVDVIVERKDMRASLARILSMLYRG

SEQ ID NO: 23217 - protein, 264 aa, Geobacter sulfurreducens PCA
MSRIAGTFAELKHNSRKALVTFITAGDPDLAATEALIPLLAESGADIVELGVPFSDPMADGPTIQLSSERALAAGTTLPKILDMVRRVRTRCQVPIVLMGYYNPILIHGLERFAADASAAGVDGVLLVDLPPEEAAEFKACADRHGLDVIFLLTPTSDEGRIRKVARQARGFVYYVSVTGVTGARSGVEASVSSNVAAIREAITVPVVVGFGISTPDQAAQVAASADGVVVGSAIVKLFERFTAAELGREVATFVSALREAIGN

SEQ ID NO: 23218 - protein, 221 aa, Geobacter sulfurreducens PCA
MIIEARDLSKAYTVGDRRIQVLDSVSLAVEPGEFLVIEGESGSGKSTLLSLLSGLDRPDSGRVIIEGRDITDLSEDDLAPLRNETFGFVFQSFHLVPSLSTLENVMFPAELRGDGEAREKAEALLARVGLTGRAASLPHQLSGGERQRCAICRALVNDPRIIFADEPTGNLDSVNGRGILDILLELHRERRTTLVLVTHSPEIARTADRVVRLHDGRIQAP

SEQ ID NO: 23219 - protein, 472 aa, Geobacter sulfurreducens PCA
MAEQTFDLIVIGAGPGGYVAAIRAAQLGMTVAVAEQRETLGGVCLNEGCIPSKALLDSSEFFAQARDGFAGHGILIDPPRLDLARMMARKDDVVKKLTDGIAYLFKKNRITWLKGTARLAGRNGDLLRVEVGGNGTAPAHLLEAGKVLLATGSEAVPVPGLAFDGETVVSAREALAFDRVPEHLLVVGAGYIGLELGSVWRRLGSQVTVVEVLAKPLPATDGQVADALVRSLKKQGISFRMETRVTGIEKREGTAVVTVESSAGGRDAIACDRVLVAAGRRPVMAGLGLEPFNLAMEGGRIRVDDNYLTSAPGIYAIGDLIHGPMLAHKAMAEGEVFAERLTGEASVVDYEYIPGIVYTWPEAAGVGLTEEQLKEQGIPYAAGRFNFMANGRARCMGETEGFVKILAKPDTGRVLGIHVVGPRASDLIAEAVTVMTYGGSAADIAMTFHAHPTLAEAMKEAALDVEKRAIHA

SEQ ID NO: 23220 - protein, 1017 aa, Geobacter sulfurreducens PCA
MPILITALIYLIFFLSGATALVYEVVWVRKLSLVFGGSHLAVTTVLAVVMGGLALGSWLFGRRVRTTRNLLRLYGALEIGIAFFALLFIALLNLYSLMPAYSFESLTEHSHQLPRVALLTLRIVLAAIALIVPTTLLGGTLPVLAAFMVRGRRAVGRGVAYLYALNTFGAVAGCFGAGFYLLGRFGVSNTMAGAITVNVLLGIACFALQGPAARYLEAGEDEAPAPLSAVTLPEEKARIGLVVWGIGVSGFCALGYEVLWTRVLGIVIGTNVYGFTLMLAAFLTGIAAGSGAYGLWARRLRPPEEGGCPVSKLIGGFGVVQIVIGLSALLVTILIRDLPTRVFFLQDLFLSQSTDLFRARQFANFALVFSYLFIPAFFMGVAFPLAGTLDACRRRKVGHAVGEVLTCNTIGAILGTVVSGFVLIQVFGIERSLYLLATVNAGFGLLILARLLRGTPRRLATAGTVLAVVGVMAVAGTMPRIWDAKYFAIYRTNQPEVFRTPDLIAEAKRHTDVLYYAEGIQSIVSSIRIRGGYQAFLRNGRIEASDHNESLQNQYALGHLPMLLHRNPRKVLVIGAGSGITLGAVSLHPSVSEMTLAEVEPKVLGVTRSFAAYNHGVLGDRRLRVAFSDGRNYLATTGERYDVITADPIHPWLSGAGYNYTREYFELAAEHLRAGGIMCQWLPLYDLSADDLRSVVRTFRQAYRHVLVWMTQGDAMLIGSNAPILLSEDELAARIAVPAVAADLARVQMGSATDLLSYFVMGTAGADRFSRTGRINTDDNLYLEFSVPRSTGKSALPEVNVNALARHRESVLAYLDDSVPPADRLARENRWMRLDRAAALALEARAIFLGGRYDSPRFGLLVSELEGNYAAFAPWRFLRSEYLEEMASSPLPLDQLALALLDESGRRVVVNVAAVMSRVSRELTVVDFVDSDERVIIGQADINGRGRDGSAKRLAAEVMEAVRLAYNEELSGAEARGKPLPDQAEFVRRMREIIATMTGRQHGNPYPAQGRPIKESA

SEQ ID NO: 23221 - protein, 433 aa, Geobacter sulfurreducens PCA
MRFDPQQLRIDGVYAQRQPGTFMLRIKVPAGILSAEQAEAVADIADRFAGGLLHLTTRGSIELHGLTEDHLSSVWRGLAAVGLTSRGACGGAVRGVVCGSVTAAAWPLVQSLAHKLHLHFTRNPHFEALPKKFKIGVFTGDNEGRHLIQDLSLVHRENEADAPRYDVWAAGGLGREPSPAFLVEEAVAEDRIIPLVEAIVRVYKERAPKGKRLKHLVRDLGREDFLALVAERRGDQPLPLADSFSGELFPSVAAGGVCVEAPVFAGELTTGGLRSLAAVARDVAGGFMVLTGDQNVRFLLPESVRRQDALDAVAAAGFAADRPEQRVAFRICPGSHECAMGLAPTRDVARAVIGAMGDDAAALRWSISGCPNSCSQPQLARVGIVTAKSVKGEDGQRRPLFDLYRREDDGSLGVVVGSGLELEELVAAVRLER

SEQ ID NO: 23222 - protein, 452 aa, Geobacter sulfurreducens PCA
MQTFDVVVIGGGPGGMTAGMMLKQAGKSVAIIQENHDSFGGVCLNRGCMPTKSMLKAAKVYRDAQNSEKYGLDLSVNPVDLTRLRAVADADLNMLRHMVQGKLTDARIAVFRGKGSFLSEHELQICQADGSSEQIRGEKIIIATGSVPAELPCAPFDGHSILSSDQILKNTDLPHKLLIIGGGAIGCEFATLYNTFGSRVTLVEAMDSLLPREDKEAGKTLQSTFEQQGITVKTGAAIKSISVEAGTVHVHYDGSCATEEFDKVLVGIGRTANIAGLNLDAAGVATEQGAVKVNEMMQTTVPHIYALGDVIGGMTLAHAAEKEGYLLAQNLIQGTRHPLDHRAVPRVVFCHPEVAAVGTHEARAGIKAFTMPQAPNGRAVVDKVAPAFVKLFIEEDTSQIAGAIIIGEGATEMIHEMAVAVENRLTLEQIGKTVHAHPTHSKNVLLAVQHFN

SEQ ID NO: 23223 - protein, 358 aa, Geobacter sulfurreducens PCA
MSATRNLDALRREIDAIDDAILDLLNRRAGLVMEVGQVKTVEKRDFHVPNREREIYERLLAHNTGPFPAEAVKSVFREIISASLALEAPMKVAFLGPRATFTHLATMQHFGLAAELVAQKSIPAVFEEVEKGRALYGVVPVENSTEGMVSHTLDMFMESDLKINAEVLLEVSHDLLSRTGRLDDVKKVYSHPQALAQCRKWLDDNLPGVPVVDVASTALAAQIVSEDYAAAAIASEFAAAQYDLKVVRTRIEDQVNNFTRFLVIGRKMADRSGDDKTSLMFSVKDEPGILYRMLEPFASRGVNLSKIESRPLKKKAWEYIFYLDLAGHITDPVVAEAVQDLGRYCQFVKILGSYPRAK

SEQ ID NO: 23224 - protein, 328 aa, Geobacter sulfurreducens PCA
MKAVLLDGFGGLDVLKVGEAERPKPAEGQVLVKVVATSVNRPDLVQREGKYPPPPGDSEILGLEVSGTIEELGPGVTGWQVGDRVMSLVGGGGYAEYAVAYASHLMRIPESMSFEEAACVCESYITAFLNVFMIGGLKDNNSVILHGGGGGVNTAGIQLCKALVPNTKIVATAHPSKIDRVKALGADLVVDFTQTPDFSEAVKEFTNKKGVDVILDHVGAKYLAPNMNSLAYAGRLVIIGVISGIKAELNLALMMVKRQQIIGSVLRSRPVKDKGEIVAEFTRTALPKFADRTIVPIIEKVFPMDQVVEAHRMMEEDKHFGKIVLKIS

SEQ ID NO: 23225 - protein, 217 aa, Geobacter sulfurreducens PCA
MNLVFLGPPGAGKGTQANLLTRTYEVPQISTGEILRAAVKSKTPMGVKAKEYMDQGALVPDSVVVGIVEERLASPDCASGFILDGFPRTVAQADALKQVLGALGKQIEHVVSFEVDKGVLLERIVGRRVCRACGRAFHVKFDPPLVDGVCDACGGELYQRDDDREDTMRRRLEVYDEQTAPLKSYYEGERLLRKVNALEPIEDVQRQIVKLVESCNG

SEQ ID NO: 23226 - protein, 1136 aa, Geobacter sulfurreducens PCA
MNSTDTGTDTLPSSFKRLNLAQALGALNDNVIKLIIVFFLISHFGQERAATVAAIGSAAFVAPFLFFSALAGSLADRFPKGWIIVRVKALEVGIALLAVAGLLIASPLLLGAVIFLLGTHSALFAPAKYGVVPELVAREELSRANSLLEMWSFLAIVGGTALAPFLVQLAGGRHGVALLAGVAVALCGLLVARTLPETSAAAPERQVVLSPAAYWRTLRSLKHDGYLLLAVLGAAYFLFVGAFCQLNLLPYGMKLLGLPEEQSGYLFVAAAVGIGVGSLLAGRLSGRTVEFGVVPIGAAGLTLCSFLLATLPAHLPSVLVAVTLFGMSAGLFIVPLQSFIQLRAPADRRGEILAASTFLSWVGVLLASALLWTLTGPLGISPAGCFGVLGAITLVLTLATLRVLPDFLLRFVALVAMRLCYRLAVIDDRHVPVEGGALLVANHVSWLDALLLIATQQRRIRFVMEREIYRTPVLKQLCSLMGVIPVSSKDGRKGLLEFIASARGALDQGYLVCIFAEGAITRNGMLNQFKGGFERIVRGTSHPIIPVYIGGAWGSILSYAHGKLLSRFPSLLPYRVTVLFGAPLRAGSSVHDVRRAVMELSCAWFQTRKSRRRPLGELFAETARENWHRLAVADTGGRELTYGRALTGAVALAARLKPFTAGQEMAGVCLPPTVAGALVNLALTLNGTVPVNLNYTASADGIRSSLDQCGIKVTITSRRFQEKLGSLPEFPGVLYVEDLLAGLTGGDKCQAFLKARFLPLRLLAGKAGFSADQPATVIFSSGSTGEPKGVMLSHHNIISNLEALRMVFRATRRDNICSALPFFHSLGFTGTLWLPLLSGFSVVYHANPLDGETIAATVRERRSTLLIATPTFLMAYLRRAKPEDFASLRLVITGAEKLKPKLADSFQEKFGIRPMEGYGATELSPVISLSLPDVEIDGVRQAGFREGSVGLPVPGVVVKIVEPETLEPVAEGVTGLILVKGPNVMLGYLGKPEKTAEVIRDGWYVTGDLGYLDDHGFLHITDRLSRFSKVAGEMVPHGAVEDALHVRLGQAGLVAVTGVPDERKGERIVVVYTPEAGDAETLHRFMTESELPNLWKPARDCYVAVETLPVLGTGKLDLRGVRAVALAAVGLGGGSV

SEQ ID NO: 23227 - protein, 470 aa, Geobacter sulfurreducens PCA
MSTGMTTRERLAIDRVHMVELDADSRSRNFDEVNRGLTPEEAVREAQRCIRCTNRQCVAGCPVGVSIPEFITALADGNLREAARILTRDNALPAVCGRVCPQETQCEARCVRGIKGEPVAIGYLERFVADWATANVAELGDEPLPPPTGRRVAVVGCGPAGLTAAGELARKGHGVTIFEALHDTGGVLRYGIPEFRLPKTIIDAEVARLLALGVTVECNVIIGKTLTLAQLREEFDAVFIANGAGLPVMLSIPGENLKGVYSANEYLTRVNLMGAGRDPGSTTPIIAGKRVAVIGGGNTAMDCVRTARRLGAERAMIIYRRSEEQMPARVEEIKHAKEEGVEFVMLTAPIAIGGDKDGWVATLRCLRMELGAPDSSGRRSPVPVEGSAYDIAVDVVVNAVGTRANPLLTATAPELKLNRWGNIATDDNGATSVAGVYAGGDIVRGGATVILAMGDGKQAAAAIHDWLNRR

SEQ ID NO: 23228 - protein, 352 aa, Geobacter sulfurreducens PCA
MYKARAYSAASAASPLALDTIPRRETTERDVQIEILFCGVCHSDLHTVRDEWNSVMPTVYPCVPGHEIVGRITRVGSAVTKFKPGDLAGVGCLVDSDHTCPSCQSNLEQFCPDATFTYNSPDKHQAAPVTYGGYSESIVVDERFVLHVPATLDLAGVAPLLCAGITTYSPIRRWGDIRGKKAGVVGLGGLGHMGVKFARAFGAQVVVFTTSPGKKEDALRLGAHEVIVSTNAEEMQQHAGTFDFILDTIAADHDINAYLNMLGRDGTITLVGAPEKPLEVSAFALLFGRRSLSGSIIGGIAETQEMLDFCGQHNITADVEVIPIQKINEAYERLLKSDVKYRFSIDMASLKG

SEQ ID NO: 23229 - protein, 334 aa, Geobacter sulfurreducens PCA
MHKRLLGKSGLEVSALGLGCMGMSFSYGPPKDREEMIALLRTAVERGITFFDTAEVYGPFINEELVGEALAPLRERVVIATKFGFDTSVDPRAMKGQGPVLNSRPEHIRAVAEASLRRLRTDVIDLFYQHRVDPAVPIEEVAGAVKELIREGKVKHFGLSEAGIETVRRAHAVQPVACVQNEYSLWFRRPEEGLLQALEELGIGLVAYSPLGKGFLTGKIGGDSTFDSTDFRSTLPRFAPEALKANQALVDLLGRIAEQKNATPAQIALAWLLSRKPWIVPIPGTTKLDRLNENIGALAVELTAADLSAIETAAAQIAIQGNRYPEKLEQLTGR

SEQ ID NO: 23230 - protein, 308 aa, Geobacter sulfurreducens PCA
MEHPPFSLAGSIGATPLVELRHLNPNPRVRILAKLEGNNVGGSVKDRPALYMLAKAEESGELVPEKTILEPTSGNTGIALAMLGTVKGYRVKLVMPACVSLERRAVLEAYGAELVLSPHDEATDGAIRLAHRILEEEPDRYYMPNQYANPNNPLAHYETTAPEIFRDTGGAVDFFVAGMGTGGTLMGTSRYFREKKPSVRIVGVEPRLGHKVQGLKNMQEAIVPPIYHPEALDLKLTVHDEPAFDTARELAAREGLFVGMSSGAAVAGAVQVARDAPAGSTIVVLLPDRGDRYLSTVLFRSVCGKCPP

SEQ ID NO: 23231 - protein, 469 aa, Geobacter sulfurreducens PCA
MQITFGTDGWRGIIAREFTFDNLSRVAQATMDYLKREGLAARGLVVGYDRRFLSRDFADRVAEIAAGNGIRVWLTDGPAPTPAISWAVHEMKAGAGVMITASHNPPAYNGFKVKESFGGSARPATTRILEEITAANTAAGRGIEERPLAAALADGTVTIFDPREGYCRQLARYVDLDLIRQAAIPLAVDPMHGAGAGVIPELVPGALEIHGDENPGFRGVPPEPTEEHLQELATLVRDGVCRVGLALDGDADRIGAVDENGEFFSSHRIFTVILRHLVERKGLTGGVVKTVSTTRMIDLLAQKYGLPLHETPIGFKHICELMLEHDILMGGEESGGLGVKGHIPERDGVLMGLLLLEAMAMSGKGLRRLLDETMDEIGVFHYQRLDLPIEDAPKAALITRLREERIDAIAGRPVAGTNFRDGFKFMFEDGSWLLIRPSGTEPVLRLYSEAGTPGTVGELLAAGREIAGV

SEQ ID NO: 23232 - protein, 374 aa, Geobacter sulfurreducens PCA
MRKVFDETKINHMVLANRLVRSATWEGMCGEDGCPSEKLAGYYATLARGGVGLIITGYAFVRPDGKQLPGQMGVHEGSFAAAARQVTGAVHREGGKICLQLVHCGGQAPSRAAGCQPVAPSAIKAVQYPELPRELPMAEVVELAGLFADGARRAREWGFDAVQLHAAHGYLINQFLSPLTNHRTDHYGGNLESRALFLLETCRAVRRAVGKEFPVMVKLNGSDNLAGGFDLDEAVQVARMLDEEGIDAIEVSGGTPASGARTAVRQGIETREQEAYNLPSAYRIKNAVSCPVMVVGGFRSFELVEGVIRREEADYVALSRPLIREPHLPLRWQQGDESRARCISCNGCFKPGLKEGGICCVVDKMERESREFSL

SEQ ID NO: 23233 - protein, 480 aa, Geobacter sulfurreducens PCA
MDTLSRKTKIIATLGPVSSSPDMIRQLMDAGVDVFRLNFSHGSNDQRREVIAAIRRLSAERGKEIGILADLQGPKIRTGRMENGAIPLVRGDSLDITTDEVLGRPGLISTIYQSLPHDVKPGSRILLDDGLIELRVQSVSGATVRCTVVQGGMLKDLKGINLPGVKVSAPSLSEKDLRDLDFCLEVGVDYIALSFVRTAADVEGLKRILFERDVQVPVVAKIEKPEALRNFKSILKVADAVMVARGDLGVEISPEKVPLFQKKIIRACNEAGKPVITATQMLESMISHPRPTRAETSDVANAILDGTDAVMLSGETASGQFPLEAVRTMDKVALDVERFAQVEDGSGPRRHSVSIAEAVAEAACHAAVILKAKAVACMTQSGSTAARISRYRPPLPILAFTGSVDTMRRLSLYWGVKAYPIGTMAGTDEQIVAVESTLLSGGYRKGDVVVITMGVPVEARGSTNLMKVHKLGTGQFFEIF

SEQ ID NO: 23234 - protein, 221 aa, Geobacter sulfurreducens PCA
MKKIAPSILSADFSRLGDEVRAVAAAGADYIHVDVMDGHFVPNITIGPLVVEAVRRVTELPLDVHLMIEHPDRYIPDFAAAGSDIIVVHAEASTHLHRTIQLIKSLGKKAGVSLNPATPLNCLDYVLEDLDLVLLMTVNPGFGGQSFIEACIPKIQSLRAMLDRRGCEAELEVDGGVKIDNIARIAHAGADVFVAGSAIFGSPDYEATIKELKRRAKEPIL

SEQ ID NO: 23235 - protein, 1004 aa, Geobacter sulfurreducens PCA
MLNSELNTKIVNRGKEFFGSISGEKPSLFNKGAWMGKAMDWSMQNEQFKIQMFRFVDVFPSLTTSKLLTEHIREYFGNEQDMPAFMSTGAKVAGMLGSFGGAVLNKVLTSNIEEMARQFIVGETTKEAVKNLEKLRKDGFAAVVDVLGEATLSEEEAEVYTNTYLELLEALKKEQGSWKGLPGKGGDPGLDWGHAPKVNIAVKPTALFCLANPQDFEGSVVAILDRMRRIFKKVMELNGFLCIDMESYRHKEIILEVFRRLKLEYRDYPHLGIVLQAYLKDNDKDLDDLLAWAKEHKVQISVRLVKGAYWDYETVKAKQNDWEVPVWTIKAESDAAYERQARKILENHQICHFACASHNIRTISAVMEMARELNVPEDRYEFQVLYGMAEPVRKGILKVAGRIRLYAPYGNMVPGMGYLVRRLLENTANESFLRQSFAEDAQIERLLEDPAVTVERERAARAAKPKKERKGLGGLPPFNNEAMVDFTRADHRAAFPKHIAQVRTQLGKTYPLFINGKEVRTNDLIPTVNPNKPSEVLGQICQAGTTEVGDAIAAAKAAFPAWRDTDPRTRAEYLLKAAQAARKRLFELSAWQVLEIGKQWDQAYADVTEAIDFLEYYAREMIRLGQPQRVGHAPGELNHYFYEPKGVAAVIAPWNFPLAISMGMASAAIVTGNCVVFKPSGITSIIGWHLVELFREAGLPEGVFNFTPGRGSVMGDYLVDHPDISLIAFTGSMETGLRIIERAAKVHPGQANVKKIISEMGGKNAIIIDDDADLDEAVPHVLYSAFGFQGQKCSACSRVIVLDAVYDKFIERLVSMAKATKVGPSEDPANYMGAVADDKAMKSIKEYAEIGKREGHVLYESPVPAGEGYFVPMTIIGGIKPEHRIAQEEIFGPVLAVMRAKDFDQAIEWANSTQFALTGGIFSRSPEHLAKARREFRVGNLYINRNNTGALVERQPFGGARMSGVGTKAGGPDYLLHFMDPRVVTENTMRRGFAPIEEDDDWVD

SEQ ID NO: 23236 - protein, 240 aa, Geobacter sulfurreducens PCA
MVEVRDVSKNFGGLRALDRVTFDVKEGEKVVIIGPSGSGKSTLLRSLNKLEQIDTGRIVVDGIDLYGQGTDINKLREEVGMVFQSFNLFPHKTVLQNITLAQCVVRQRSASEATEKAMGLLRKVGLEEKAGAYPAKLSGGQQQRVAIARALAMDPKLMLFDEPTSALDPEMIGEVLDVMKSLAREGMTMVVVTHEMGFAREVADRVIFMDAGRIVEEGTPEHFFRNPTHERTKLFLSQIL

SEQ ID NO: 23237 - protein, 468 aa, Geobacter sulfurreducens PCA
MSDKHDLIILGSGSTAFAAALRAHSRGARVLMVEKSVLGGTCINWGCVPSKTLIHGALFYQEGRLGARLGLGECGNAVDLAPLMTRKEEVVKHLRTTRYLDILRNTPGLELAKGTGRFLGSGRLEVVDQVYRCDRYLVAVGGTPRIPKIPGLESTPFLTSRGALLLKRFPASLIIIGGGVIAVELGQMFQRLGTRVTILEHGPRILAPIEPEPALAIRNVLRDEGMEIICHSPVCAVSGDGSAVSVEVEREDGRRTYTAEKLLLAVGTTPATRGIGLELAGVETDGRGFVTVDERMRTTAPGIWAAGDCTGGMMIATVGAREGIIAVDDMFATGCGCAMDHLSVPMAIFTDPEVGAVGYTEQGARDAGLDPIVSILPVSAIPKAHVTGHTAGVIKLVAERATGRLLGAHLACHRGAELINEAALAIRLKATFEDLANALHVYPSIGEGLRLCAQGFTRDVSKLSCCAE

SEQ ID NO: 23238 - protein, 492 aa, Pseudomonas putida
MKQYKNFINGRFVESDKRFAGINPATGVRFADVHEATREMVDEAVSAGHRAVRGWGSASVSDRADMLYRIADEIDRRADDFLTAEVSDTGKPVSLASKLDIPRGAANFRIFADILKTAPLDTFRTDLPGGSHAINYAVRKPLGVVGIISPWNLPLLLFSWKVAPALACGNAVVAKPSEETPGTATLLAEVMQTVGLPAGAFNLVHGFGPNSAGEFITTHPGINAITFTGESKTGTAIMHAAAEGVKPVSFELGGKNAAIIFADCDFDKTVAGMTRAAFLNSGQVCLCSERIFVERPIYDRFVKALAERAKQIKLGDPTDEATCMGPVISAAHRDKVLSYYALAREEGAEFITGGGTPSFGNQLDGGFWVEPTLLAGLPDDARCVTEEIFGPIGHVTPFDSEAEVIQRANATPYGLAATIWTSNVNKAHRVAQSMNVGVAWVNAWFLRDLRTPFGGSGLSGIGREGGLHSLNFYSELTNVCIHVDAPDGSHDR

SEQ ID NO: 23239 - protein, 445 aa, Geobacillus stearothermophilus
MAISFDYSNALPFMQENELDYLSEFVKAAHHMLHERKGPGSDFLGWVDWPIRYDKNEFSRIKQAAERIRNHSDALVVIGIGGSYLGARAAIEALSHTFHNQMNDTTQIYFAGQNISSTYISHLLDVLEGKDLSINVISKSGTTTEPAIAFRIFRDYMEKKYGKEEARKRIYVTTDRTKGALKKLADQEGYETFVIPDNIGGRYSVLTAVGLLPIAVAGLNIDRMMEGAASAYHKYNNPDLLTNESYQYAAVRNILYRKGKAIELLVNYEPSLHYVSEWWKQLFGESEGKDQKGLFPASVDFTTDLHSMGQYVQEGRRNLIETVLHVKKPQIELTIQEDPENIDGLNFLAGKTLDEVNKKAFQGTLLAHVDGGVPNLIVELDEMNEYTFGEMVYFFEKACGISGHLLGVNPFDQPGVEAYKKNMFALLGKPGFEDEKAALMKRLSK

SEQ ID NO: 23240 - protein, 394 aa, Ipomoea batatas
MVDANHPKVVCVTGAAGFIGSWLVMTLLQRGYHVHATVRDPGNTKKVKHLLELPKADTNLTVWKGVMEEEGSFDEAIAGCEGVFHVATPMDFDSKDPENEVIKPAINGVLNIINSCVKAKTVKRLVFTSSAGTLNVQPQQKPVYDESCWSDLDFIYAKKMTGWMYFASKILAEKEAWKATKEKKIDFISIIPPLVVGPFITPTFPPSLITALSLITGNQAHYSIIKQGQYVHLDDLCEAHIFLYEHPKAEGRFICSSHHTTIHGLAEMIKQNWPEYYIPSEFKGIEKDLPVVYFSSKKLQDMGFQFKYSLEDMYRGAIETLRKKGLLPYSTKEPAAIEEEQETAPLKVQEPTKQEATTVPLKPAAIEQKQETVPLKFEEPTAIEQKQEVVPLKA

SEQ ID NO: 23241 - protein, 406 aa, uncultured bacterium 106
MDKMGMTEKNFIEDLNLNGLRVLTRVDFNVPLNKDLQITDNGRIEAALTTIRYIVEQRGKAILMSHLGRPGGERVESLSLKPAAEELSLLLGQPVTFAKDCIGEEVEALIEGMQNGEVLLLENLRFHKAETKNEPEFCGALGKLGDVYVNDAFGTAHRAHASTAGVTGFIPESAVGYLIRKELQFLGGAVMNPARPFTAILGGAKVSDKIKVIDKLLNKVQTLIIGGGMSCTFLKAQGYKIGASLLEEDSLDFAKELIQKAQEKGVELLLPVDAVIADSFDKSASTRSVSVEEGASDGWLILDIGPKSAEIFCDSVRKSGTVLWNGPMGVFEMEPFALGTFAIAQCLAEVTDKGVVTIIGGGDSAAAIQQFGLSERITHVSTGGGASLEFLEGKELPGVTAIQQSK

SEQ ID NO: 23242 - protein, 285 aa, uncultured bacterium 311
MSLVEGKNCLITGATSGIGRSTALALSEKGANIFFIARNQQKAEELTEEVERVSGKSPNAIIADLSSFKQIERAAEEFKSLNKPIDVLLNNAGIMNTERRVTEDGLEEVFAVNHLAYFLLTNLLIEKILESGLKRVVNVSSDAHRFLKSMNFDDLQSEKEFKMFAAYGQSKLANILFTRKLSSLYQEEGLTTNCLHPGFVSTSIGAQNENLAFFARLIRWVSPLIAKPSDKGAETSIYLCSSEEVSSTSGEYFIDCKKAPITKAAESKEDAEKLWQISLELTGLK

SEQ ID NO: 23243 - protein, 502 aa, uncultured bacterium 311
MTMNLYTSQETKKLDSLAIRSQKVPAFTLMQKASEFSFNVLLNNWPNTKKVFVFCGKGNNAGDGYLISHLAKEMGLESFIIQASPSNKISGASRKAFKLALESKVKRISIAAFKKKSLKDSVIVDALLGIGIKGNVRSNLSKLILEINKKSTNIPVLSVDIPSGICSNTGINLGVHIQADVTATFVGRKRGCFTSTGRTASGNVVFDDLGISSSLKSQIKTNCYLLDTEKSLLKLKNRKGDAHKGDFGHVLVIGGDKGFGGAAILASKAAVFSGAGLVSLATRSIHVEAALSSCPELMVNGIESGQDVEEILAKSTVVVLGPGLGQSAWSEQMLQRTFMEAKKRNLPVVLDADGLNLLTKLKLKSGIPRKMVITPHPGEAARLVNKEVNKIQEDRFKSVTALEKKFGSVSVLKGSGSLVCYKRGGKQRIGVCEAGNPGMAKGGMGDVLAGLIGSFLSQGLGLVEATEVAVDLHSKSADIASLELGMTITPTDVIRNIRYFLR

SEQ ID NO: 23244 - protein, 307 aa, uncultured bacterium 313
MRTGIVTTDTYLNHDTGQGHPERADRVTVVINHLKKIKSKSLIWKKATKFDLKYLEFAHDENYLNNVKDSFPKQGLNFLDGDTIVSPGSKEATRDAVGSILTAIDGVMKKDLDNAFCAVRPPGHHAEKQKAMGFCVYNNIAVGAYYLLEKYKLKKVAIIDFDVHHGNGTQDIFYDNEKVLYISSHQYPYYPGSGAANEKGSKDNVLNVPLSAGTQSHEFLNAYDSIFKKLKTFKPEFILLSAGFDAHKDDPLAQINLESKDYYTLTKRILSLAKELCDGKVVSILEGGYDLNALKESVDYHVKSLLE

SEQ ID NO: 23245 - protein, 479 aa, uncultured bacterium 314
MSDKMLKFVNVGMQMPAKRAGGLRTKDFKEIYDQFIHEKAKEQSSRCSQCGVPFCQVHCPLHNNIPDWLKLTAEGRLQEAHELVHSTNNMPEICGSICPQDRLCEGNCVIEKAGHGTVTIGSVEKYITDTAWEKGWIKPIKVLKEIDQSVGIIGAGPAGLACAEELRKSGYKITIYDRYDRPGGLLIYGIPNFKLEKFTVERRTNLLKESGIKFKQDFEVGKDISLDELRKKHDTILIATGVYKPREIDLPGSDLKNIFPAMEFLTASNRKGLGDRVNNFDNGTLNAEGKNTIIIGGGDTGMDCVRTAVRQNAKSVKCLYRRDRENMPGSAREVHNAEEEGIEFIWLSNPKKFIGTSQISSVLVERMKLGKTDSSGRKKPEPIPNSGFEMKADMVINALGFDPEDLPKLFNSPDLSISKLGTIKINLKTMETNLSGVFAAGDIVRGASLVVWAIRDGRDATISIRKYLEHKRSKNVKAA

SEQ ID NO: 23246 - protein, 411 aa, uncultured bacterium 314
MNKIIKEQINQLKPSATLAINEESNKLKKSGKKVYKFGFGQSPFPVPESIVSALKNNANKNTYLPMQGLEELRSAIANQLNQSNNNDFVAEDIIVGPGTKELMLLTQIAFAGEILLPAPSWVSYQPQAVIAKNKVHWIQTSSNSNWFPTAEQLENKIKSIKNQNLILFMNSPNNPSGIVCKNLQEITEVAKKHKLIILSDEIYSRLTFDNQYKSISNFYPEGTIVSTGLSKWCGAGGWRLGFFAIPKQLEELKNSLKILCSESFTSVSAPIQYAAVEAYKGDHSAYLNAVRKILSFTGNYVYENLKSNVINVTKPEGGFYLFPEFTNAKFSSSSEMCKDILNKTGVALLPGSDFGVDSKKMLTRLSYTDFDGSNFLANTIGGKKLDHATIKKYAPNIVEGVAKLKDWSKSL

SEQ ID NO: 23247 - protein, 461 aa, uncultured bacterium 442
MARWECIVCGLIYDEKEGWPDDGIPAGTKWSDVPDDWLCPDCGVGKDDFELIAGSEDEPVGETDTTTSADESSVATNNRHIVIVGSGLAGYGLVSALRKLDPEVAITLITRDGGESYSKPMISTGYTKNLSAEKLAAQSSEAMAEQLAVTMLTRKTVVSIDPSSNQLNLDDETVIAYSELVLTLGAELIRPPMGGDAAGDVMGVNDLDDYRSFRDTLEAKGVRKVAVIGAGLIGCEFSNDLLNGGFEVEAVDPMSWCIPTLLPEPAGRAVQAALEAKGARFHFGPLATEVNRSATGYQVQLNNGEHIEADAVLSAVGVRPRTQLASSAGLDVGRGIKTNRLLETSSPGIYALGDCAEVAGHVLVYVAPLLAAGRALAATLTGNPTEVSYPAMPVTIKTPACPVCVSPVAKDTEGSWTLSGEGSDIKGLFHSPNGQLLGFALTGAAVKERMALTKELPPILN

SEQ ID NO: 23248 - protein, 359 aa, uncultured bacterium 442
MNYAHLYSPLEMGDLRLRNRIVMAPMTRSRARQDDDAVSELQANYYGQRGDAGLIVTEGVHPSADGKGYNRTPGIYNDTHTKAWSTVTDRVHGRGGLIACQLMHCGRVGHALNKGRNTRFLAPSALAANAEIFTESGMMPMPTPEAMTLAEIKTVVADYQAAAARALKAGFDAVELHCASGYLPAQFLATGSNLRDDQYGGSLENRLRFVEEVLQAIKVETGAGRIGLRISPGNPYNDHVDDNPTETYAALLEVADRLGLAWVHAIRMASTGIDSLALSREYFSGALIGSDSFNAAEADQFIAEHCVDAVSFGRAYIANPDLVTRFACDAPLNTLDKRTIYAGEGSGGYTDYPSLTASG

SEQ ID NO: 23249 - protein, 409 aa, uncultured bacterium 442
MLARAYTPLQVGPVTLPNRFIKAGANENMSLRGMPTLAMLKHHESMAAGGVGMTTMAYLSVNKVGRTLPDQIWLHDGVLDELRAVTDAVHAKGGKIAAQITHGGSFVTGVFVPKRLQSSVSGFNPAGLLRGNVLRRGMTEDDMQNMVDDFVTAAEHCVSAGFDAVEIHMGHGYLLNQFLSPMDNKRKDAYGGSAENRARFPTRVLAAVKQRVGQDIAVLAKINVSDGRRRGANVEDAIVTAKLLEAAGADMLVLSGGRNVESGWFMFGSNMNLEAMYRVLGKWSLSGMAIGATAKSAPSIDFRELYFWEYSKKIREAVSLPLTYLGGVKSADNVAQCMAAGFEAVALARALLREPDLVNKWQVHPEEPSLCDNCNSCVAYIYHPAGTWCIHRPANVLEDNQLLASSGGA

SEQ ID NO: 23250 - protein, 457 aa, uncultured bacterium 442
MSYSNHFVPPHPKPLPALPALARVLWHGDGNLLELMPGEAYRFDFGNLGYSRRSTVLFNQPELVREILRDDGSRFPKSDLMVNALEPLIGQSIFVTDGARWKRQRGMIDPAFSQLRVSHAFDAMQSAVLDHLDVLDGHADSGDSFSLDMAMSHLTADVICRTIFSTPLAAGVSSDVFEDFTEFEQSVAQVDIFRLIFQKAWAKMPQPPGVLAACQRIRGHLGDLVDPHLENPGAFNDIASDVIAAKDSDTGEAFTREELIDQLGVFFLAGHETSASALTWVFYLLAEQPTLVLRLRNELEHVVGSGPINFNHVKQLPLVRAVFRETLRLYPPITFIPRVALEDCEIGPRKLRRGALVMVSPWTIHRHQRYWSDPDAFIPDRFLVEGESSIQEGAYIPFGVGPHTCIGAGFAQAEAVLIIAELVRRFDFSRADRQSVRPAARLTTRPAQQIKLHCQRL

SEQ ID NO: 23251 - protein, 495 aa, uncultured bacterium 443
MTDKCGWFPRVANGDDRTALIDGDQILSYSALSARVNRVVGGLLNGAESLHEERVGFLYPASFDYAALIIGVVAAGGIAVPLSVHATTDELAHCLSVTGVKRLVLPETLRSEAFNDVCAGLSVTQLTIDALPSAVAPDAWPIRSEQGALIVFTSGTTGKPKGVVHTVASVSAMVTSLIEAWGWLEDDAIPLFLPLHHVHGIVNILLCALWRGATVHLYARFDPERVSQAVAEDRFSVFMAVPTIYVKLIAYLKTLSDSECDRITEGFANMRLTVSGSAACPVSLFEAWEGLTSQRFLERYGMTELGMALSNPYMGERRPGHVGQPLPAVVVKRVDESGTEVVDPATPGELAVRSPTVFREYWGDPEATRAAFSDGWFLTGDIAVREDGTYRILGRASIDIIKSGGYKLSALEIEATLLEHPSMTEVAVIGVPDDEWGEIVAAAIVLDTPTEEATLIAWSREKMSGYKVPRKWVVTDALPRNALGKVTKPALKAWF

SEQ ID NO: 23252 - protein, 458 aa, uncultured bacterium 443
MDETLYTPPKPNSLPAVIALIRSLWKGDGNLLELLPAEAYHFDIGHLGRSRRGTVLFNKPSAVKEIMRDQQGVFPKSDLMVGALDPLIGESMFVTDGPKWRRQRAMIDPAFSLMRLNVAYGAMCAATDDHVAMISRLADTQSPFSLDLAMSHLTADVICRTVFSTPLASDIAEEVFDDFTLFEKSVAQVDILGMILKPAWSETKQVPEVLEACQRIRHHIGGLIDTHLDSHDGEFNDIASAVIEAKDKDTGLPFTREELIDQLGVFFLAGHETTASALTWVFYILAERPEWMVRLREELDPVMVDGALSFDDTKKLPLTRAFFKEVLRLYPPITFVPRVALENVEIEGKRLPRGALVMIAPWTLHRHSKYWENPHAFIPERFLPENEKSLTAGAYIPFGQGPHLCVGAGFAQVESLLIMSELITKFDFEMMPNQQVVPAARLTTRPAEQVMMRVRHRN

SEQ ID NO: 23253 - protein, 492 aa, uncultured bacterium 560
MIKMPDGKLFIGGEWETGTGKEIVSIFPADGSINCSLYGASKNDVLRAVKLAKSAQSQPSWRSLKPHERARYLYAIADGIEANIDRISQIQTRDTGKTLRETAILASSASGTFRYFGALLESSDDLLTAQRNDSLTMSVYEPLGLVSAITPWNSPIASDAQKIAPALAAGNAVLLKPSSWSPLVSLELAKLVESSGLPKGLFSVLPGSGEEVGNLLVEHPDISKVTFTGSTKTGRSLAIKAAKKLMPISLELGGKSPVIVFKDSDIDIAIAGVMFGIFSSTGQSCIAGSRLFVQKDIYNEFVERLVKATKKLKVGSPYNLDTQVSTMIHPQHRDSVAAYVDLARNEGAKILCGGKSPSGAEYKKGAYYLPTIITQVDNSAQICREEVFGPVLVVMPFDDEADVIEQANENEYGLACGIWTSDFPKAWRVGRAINAGTVWVNTYKQFSISTPFGGEKNSGMGREKGRNGIRAFMSQKSLYFDLTGNSHPWAET

SEQ ID NO: 23254 - protein, 369 aa, uncultured bacterium 560
MAQRDYYEVLGVKKGSAEAEIKKAYKRLAMKYHPDRNAGDKASAEKKFKEVRKAYDIISDPQKRSAYDQFGHAGVEQQGAGGFGGGNPFGGGAGGFGDIFGDIFGGGNTKPDNRGPDLRYDLEIDLKQAAKGDTVRIRVPKNDTCDTCSGTGAKPGTKVKTCGNCHGSGQIQMQQGFFSIQRPCNQCHGTGEKIDTPCRTCGGQGIVRKQKTLSVKIPAGVDTGNRIRLSSEGEAGLRGGPSGDLYVQIHIKDHQIFQREGNDLYCEVPIDFAKATLGGSIEVPTLDGKLKINIPSGTQTAKLFRLRGKGMPAMRYNGSGDLLCQVKLETPVNLNSKQKQLLKDFSSSCNAKQYPESNSFFGKMKSFFE

SEQ ID NO: 23255 - protein, 425 aa, uncultured bacterium 560
MTIKQIKAREVLDSRGNPTVEADVILSNGVFGRAMVPSGASTGQREALELRDGDKNRYLGKGVTQSVNNINHEINNALVGMKISNQQAIDQKMIDIDGTETKSRLGANSILAVSLACAHANANNNKQSLFRSFDFSETYQLPVPMMNIINGGEHANNSIDIQEFMIIPAGAPNFREALRYGAEVFHHLKKLLDQEGLNTAVGDEGGFAPDLSSNEEALKIIIKAIKSAGYKAGKDIFIGIDAASSEFYNNGTYNLSSEGLKLSNEEFTSYLASWVEKYPIISIEDGMDENDWSGWEMLTKKLSDKVQLVGDDLFVTNSKILARGIENNIANSILIKVNQIGTLTETFNAMKMALNAGYTCVMSHRSGETEDTTIADLSVATGCGQIKTGSLSRSDRLAKYNRLLRIEEELGDDAFYPGINAFKHL

SEQ ID NO: 23256 - protein, 487 aa, uncultured bacterium 561
MNIELTNPTLFRTEAYVNGEWIGADNGARLPVTNPATGALITDVAKTGAAETRRAIAAAETAMLSWRQKPAKQRAQVMRRWFDLIMANQEDLARIMTLEQGKTLAESRGEVAYGASYIEWFAEQAKRIDGDVIPAPSGDKRIICIKQPVGVCAAITPWNFPNAMITRKAAPALAAGCTIVIKPASETPLSALALAELAHQAGIPPGVLNVLAGSSSDIGAELTSNPTVRKLSFTGSTPIGKMLEAQCVPTLKKTSMELGGNAPFIVFDDADIDSAVQGALISKYRNSGQTCVCSNRLLVQAGIAEEFTAKLVAATESLKLGNGLDENVDLGPLVNAKAVNDVHELVQGSISAGAKLVLGGAPSNLGVCFYQPTILTGVRPEMPVFRNEIFGPVAPIISFETEAEAIELANDTEFGLASYFYTRDIGRVWRVAEALEYGIVGINEGIISNEMAPFGGVKESGSGREGSKYGIDDYLEIKYMLMGGLNQ

SEQ ID NO: 23257 - protein, 454 aa, uncultured bacterium 561
MLLGQAMTAMIYPTTNPAATEVMVVSRGEGPYIYDQAGKQYLEGMAGLWCTSLGYGNQEIIETATRQMEQLSFSHMFSGKTHPSAIELADKLAAMAPIDDARVFLGASGSDANDTLVKLIRYYAVASGQPDRVKIIARDKGYHGVSVASAALTGLHANHAHFQLPFDALGVLRTGAPHYYRCAEAGETEADFVARRASELEALILDEGPDTIAAMIAEPVNGAGGVIIPPEGYFEAVQAVLDKYGIMLWDDEVICGFGRLGAAFGAEKLNMKPRMMACAKALTSAYVPLSAAIVAGDIADAIAGPAADMGVFGHGYTYSGHPLGCAVASKVLDIYVRDRLFEHAATLGAYMSKRLDEFSDHPLVGEVSAMGLLGALELVANKDSKQPFEGMRVAQFCAKAAEDNGLIIRPLGGNRMALCPPLIIQEAHVDEIMDKLSRALDSTLDFVTAEGLTV

SEQ ID NO: 23258 - protein, 477 aa, uncultured bacterium 561
MREYKQFYIDGEWVAPSAPSDFEVFDPATEEVCATISLGNETDVDKAVAAAKAAFETFSQTSVEERVALLERICEIYQRRLGDIAEAIRLEMGAPIKLASTAQAFAGLGHIAEAAKVLKTYAFTEDLGEHRVVKEPIGVCGLITPWNWPLNQVSCKVAPAIAVGCTMILKPSEIAPLSSYIYAEILHEAGVPAGVFNLVNGDGPTVGTALSVHPDVDMMSFTGSTRAGSLVAQNAAPTVKRVTQELGGKSPNIILEDADLEAAVTRGVLHMYNNTGQSCNAPSRMLVPRDKLAAAEAIAAKVTETMVTIGDTADDKTTMGPVVSKVQWDKIQGLINKGIEEGAKVVCGGAGLPDGIDRGYYVRPTVFSEVNNNMTVAREEIFGPVLTMIPYDSEEEAIKIANDTPYGLAGYVQGENIDHARQVASKIRAGNIHLNGASGGMDVPFGGFKQSGNGREWGSHGFTDYLEIKAIEGYSAA

SEQ ID NO: 23259 - protein, 382 aa, uncultured bacterium 561
MNQAVNLDEMQLFRDMARRAFEKEISPHYEQWEEEHMVPRELWNTLGSAGLLCPDVAEEYGGAGTTPHVTLAMIEELSYMCFGGFASAYGIHSNIIAPYLSRHGTPEQKAHWLPRMVTGECVGALAMTEPGAGSDVQSIRTNAVRDGDEWVLNGSKIFITNGIHADLVIVAAITDPGKGAKGTSLFLVDAHAPGFEKSKKIEKIGQHTSDTALLFFTDVRLPADALLGEANKGFAILMDELPRERLGIAAQAVAASEGALDVTVEYVKEREAFGQKIGGFQNTRFKLADVKTDIAINRAFYEKCTEKYANDDLSSEEAAMLKLASCEMQCRVADQCLQCFGGYGYTTEYPISRFYVDARIQPIYGGTSEIMRELVARSILGR

SEQ ID NO: 23260 - protein, 437 aa, uncultured bacterium 561
MDRKTLEAHWMPYTGNRQFKKDPRIITSAEGVWYTDDKGRKVLDGHSGLWTSGLGHGRKEISAAVSQQINTLDFAPSFQFGHPPAFELADRIKGLMPEDLDYVFFTNSGSESADTSLKMARAYWRLMGQPTKTRFVGRMKGYHGVNFGGISVGGIAANRKFFGQGVEADHLRHTMLPQNRFCRGMPQDGAELADELNEMIALHDASTIAAVIVEPMAGSAGVIPPPVGYLQKLRDICDANDILLIFDEVITGFGRCGAMTGADAFGVVPDILNVAKQITNGAIPMGAVIARAGIYDTFMAHGGPDYALEFAHGYTYSAHPVACAAGLAALDVLTGEALPQRVADEAPFFEALLHDALSDKPHVSDVRNYGFAGAITLEPYPGEPLRRPFEVAMKMWEKGFLVRYGGDTIQLAPMFVMERPEMESLVGALADSLQELA

SEQ ID NO: 23261 - protein, 212 aa, uncultured bacterium 561
MRIILLGAPGAGKGTQAKFLCEQFDIPQISTGDMLRAAVAAGTELGLQAKSIMDAGGLVSDELIIGLVKDRLQQPDCVTGCLFDGFPRTIPQAQAMVDADISVDHVIEIAVDNEEIVGRLSGRRVHPASGRIYHLVHNPPEVDGVDDATGEMLIQRDDDKEATVRKRLDVYQQQTRPLVDFYQKLDGPAYHKIHGVGNVENISAEIKKLLQN

SEQ ID NO: 23262 - protein, 301 aa, uncultured bacterium 561
MNPAENSYPTIESVVGETPLVRLQRLTQNSSNHVLCKLEGNNPAGSVKDRPALSMIVEAEARGDIRPGDTLIEATSGNTGIALAMAAAIRGYHMRLIMPAHMSSERKLAMAAYGAELIQVTREEGMEGARDLAEAMQARGEGTVLNQFGNFDNPLAHYRGTGPEIWRQTGGQVTHFISSMGTTGTIMGVSAFLKEQNPDIEIIGLQPQDGSQIPGIRRWSEAYRPTIFQSAKVDRTIDISQAESEVMMRRLASEEGIFAGVSSGGSISAALQVSQEVEGATIVAIVCDRGDRYLSTGVYGI

SEQ ID NO: 23263 - protein, 468 aa, uncultured bacterium 578
MIKTQVLVIGSGPGGYTAAFRAADLGKEVVLVEKYKSLGGVCLNVGCIPSKSLLHTAQIINEAKHASQLGISFGDTKIDINGVRKNKESIVNKLTAGIQALAKARKVKVVTGHAKFLSKNQVGLEGTDEVIEFEHCIIAAGSRVTKLPMFPFNDERVMDSTDALMLDDIPKRLLVVGGGIIGLEMATIYDALGSEITIVELEGQIIPAADKDIVSPLLKRIKKNYANIFLNTKVTKMTASKKRIKVNFEGKDAPKTDTFDKVLVAVGRSPNGQMIGAENAGVNVDQNGFISANNQMQTNVDNIFAIGDIVGQPMLAHKATHEAKVAAEVICGQKSGFDALTIPSVAYTDPEVAWTGKTEKELTEEGIKFDKGVFPWAASGRSLSIGRSEGVSKGLFDAKSGKILGMGICGTNAGDLISEASLAIEMGCDMSDIALTIHAHPTLSETTAFAAEMVEGTITDLMPPKKKK

SEQ ID NO: 23264 - protein, 243 aa, uncultured bacterium 578
MSDQILEVKNIYKKYARREVVKDVSFSVKGGEIVGLLGPNGAGKTTCFYITCGLVRSNKGEVILNNKSIGHMPMHKRANLGLGYLPQEPSIFRKLSVEDNIMAVLEMNKLVPVKLRKDRLEELLLEFRVEHVRHIKGITLSGGERRRVEIARSLAMDPKFILLDEPFAGIDPISVGDLQEIIYQLRDKGIGILITDHNYREMLDTCNRSYVLHDGKIIAQGNREAILANEEVKKVYLGETLGG

SEQ ID NO: 23265 - protein, 385 aa, uncultured bacterium 578
MKDNKFNTKAIREGYQPTQEQEHSAAIFLTSSFRFDSAEQAAKRFDNKDQGNVYSRFTNPSVVAFEEKLAVLEGAEQCLATASGMSAIFATIMTLLKPGEHMVASRGMFGTTIVLLNTIIQKFNIEVTFVDLPDLNDWKNSVQTNTKLFMLETPSNPLGEVVDLRALSAISKKNNIILAIDNCIMTPALQKPLALGADLVIHSATKYIDGQGRCLAGAIAGNNKLIDEISSFARSTGPTLSAFNAWIIFKGLETLSLRMQAHCENAKKLAVWLNEQEFVKKVHYLGLDSHPHHSIAKEQQSDYGGIVSFEVIGGRKEAFRLINNTKMISITANLGDTKSTITHPATTTHVRLSDEEKQQSNISENLIRISVGLEDIEDIIADIKP

SEQ ID NO: 23266 - protein, 163 aa, uncultured bacterium 580
MTQNYFELFNLPEKFQIDLEMLQENYRAIQKEIHPDRFATSSENEKIQSMIKSTQTNDAFQTLKSPIKRAKYILSLHKSVEKITLPPDFLMQQMEWEEHFEAIEKNNNELAQFKSTINKKYEEYSLLISTQIDDDQNWSDAAISIDKLYFIEKLLQKINNALN

SEQ ID NO: 23267 - protein, 439 aa, uncultured bacterium 581
MAAPEYPGLDTLALHAGSQPDPATGARATPIYQSASFCFPDSDYAASLFNIERAGHVYSRLSNPTNAVLEERIAALEDGVGAIATASGQAALTLAIMTLMGAGSHIVAAAALYGGSHNLLAYTLPRLGIETTFVDARDPQAFAAAIQDNTRLVFAETVGNPGLDVLNIPEVAAVAHQAGLPLMVDSTFTTPYLIKPFEHGADIIMHSATKFLSGHGIVIGGLLVDGGRFDWDAFGKFPTLTEPYAGFHNLVFSEEFGPAAFIQRARKEGLRDFGACMSPTTAFHILQGVETLGIRMHRHVENTRRIVEFLNQHEQVSRVGYPELEGHPDQALASALLPKGCSAVFSFDLVGGREAGIAFVDALNLFSHLANVGDAKSLVIHPASTTHHRMDAAALAAGGIGEGTIRLSIGLEDAKDLIADLKQGLRAAGKVAAKQSVTP

SEQ ID NO: 23268 - protein, 485 aa, uncultured bacterium 582
MREVKGYWQNYIDGAWVDGGAGRIDVINPGTGEKIAEQALADARDVDLAVQAAKRVHSTGVLTDMRPVERGRIVQAMGRYLLEHLEEIAALLSLEQGKPIWEARIEVTGAARYFEYYGNQAETLEGRSIPLGAGYFDFTTDEPYGVSAQIIPWNFPVEMTARSLSAALTTGNTVVVKPPEMTPLSNAWFAHAAEAVGLPKGAVNLVCGYGHQAGAALSAHPDINQVVFTGSVATGIAIASAAAKNVVPCVLELGGKSAAIVHSDADLVAMETDIRKGIFINAGQVCSAMSRIIVHESRHDELVQRAVSIAESLSVGPGADRQTFGANMGPMVSVKQRDRAAGLVSEAVSQGAKLVTGGRAMNIPGAFLQPTVLAEVTPEMTIAQTEVFGPVLSVLRFREDAEAIEIANGTDYGLVGGVFTRDLDRATQVARKIRAGQVFVNEWFAGGVETPFGGYGKSGYGREKGREALWNYVQTKNIAIKLKRT

SEQ ID NO: 23269 - protein, 475 aa, uncultured bacterium 582
MTLITPVLLAGGYGTRLWPTSRKGYPKQFSKLLGDETLFQSSAKRLVSSQTVQFDAPITMTNSDFRFIVVEQLQRASVDPGAVLIEPEGRNTAPAVLAAAIYASNRNPDANILIAPSDHIIPDTLAFHAAICKGVKETANGRIVTFGITPTRPETGYGYLELSAPSSGCAVPLKRFVEKPDLASAKAMLDAGTYLWNAGIFLFRAKDMIAAFKALAPELIGPVSDAIEQGHADLGFFRLAAAPWTKCQNISIDYAIMEKINTLSAVPYSAGWNDLGEWDSVWLELGPNAEGVVTSENATAIECQDVLLRSENESQHLVGLGLENIIAIAMPDAVLVAHKSRAQDIKLVVSTLKTNGVPQAETFPKDHRPWGWFESLIIGGRFQVKRIHVLAGAALSLQSHHHRSEHWIVVEGTAKVTVDDNVTLLTEGQSTYIPLGAVHRMENPGKVPMVLIEVQTGVYLGEDDIKRYKDNYART

SEQ ID NO: 23270 - protein, 367 aa, uncultured bacterium 583
MAQRDYYEVLGVKKGANEAEIKKAYKRLAMKYHPDRNAGDKASAEKKFKEVRKAYDVISDPQKRSAYDQFGHAGVEQQGAGGFGGGNPFGAGGFGDIFGDIFGGGNTKPDNRGPDLRYDLEIDLRQAAEGDTVKIRVPKNDTCDTCSGTGAKPGTSVKTCGNCHGSGQVQMQQGFFAIQRPCNQCHGTGEKIDSPCRTCSGQGIVRKQKTLSVKIPAGVDTGNRIRLSNEGEAGLRSGPSGDLYVQIHVKDHQIFQREGNDLYCEVPIDFATATLGGSIEVPTLDGKLKINIPSGTQTSKLFRLRGKGMPAMRYNGSGDLLCQVKLETPVNLNSKQKQLLKDFSSSCNAKQYPESNSFFGKMKSFFE

SEQ ID NO: 23271 - protein, 425 aa, uncultured bacterium 583
MQIKQIKAREVLDSRGNPTVEADVILNNGVFGRAMVPSGASTGQREALELRDGDKNRYLGKGVTQSVININHEINDALVDMKISNQQDIDQKMIDMDGTETKSRLGANSILAVSLACAHANANNNKQSLFRSFNFSETYQLPVPMMNIINGGEHANNSIDIQEFMIIPAGAPSFKEALRYGAEVFHHLKKLLDQGGFNTAVGDEGGFAPDLSSNEEALKVILKAIESAGYEAGKDIFIGIDAASSEFYNNGTYNLTSEGLKLSNEEFTSYLASWVEKYPIISIEDGMDENDWVGWEMLTKKLSDKVQLVGDDLFVTNSKILAKGIENNIANSILIKVNQIGTLTETFNAMKMASNAGYTCVMSHRSGETEDTTIADLSVATSCGQIKTGSLSRSDRLAKYNRLLRIEEELGDDAYYPGLSTFKHL

SEQ ID NO: 23272 - protein, 475 aa, Valeriana edulis
KSPQTETKASAGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQSETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRAACKWSPELAAACEVWKEIKFEFEPVDTV

SEQ ID NO: 23273 - protein, 476 aa, Valeriana sorbifolia
MSPQTETKASAGFKAGVKDYKLNYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTINPKLGLSAKNYGRAVYECLRGGLDFTKDDENVNSQPFMRWRDRFLFCAEAIYKAQSETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRAACKWSPELAAACEVWKEIKFEFEPVDTCN

SEQ ID NO: 23274 - protein, 476 aa, Valeriana officinalis
MSPQTETKASAGFKAGVKDYKLTYYTPDYQTKDTDILAAFRVTPQPGVPPEEAGAAVAAESSTGTWTTVWTDGLTSLDRYKGRCYHIEPVAGEEAKFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKSQSETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQLRNEGRDLAREGNEIIRAACKWSPELAAACEVWKEIKFEFEPVDTCN

SEQ ID NO: 23275 - protein, 475 aa, Valeriana celtica
MSPQTETKASAGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQSETGEIKGHYLNATAGTCEEMIKRAVFARELGVPIVMHDYLTGGFTANTTLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRAACKWSHELAAACEVWKEIKFEFEPVDTV

SEQ ID NO: 23276 - protein, 475 aa, Valeriana urticifolia
TSPQTETKASAGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQSETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHSGTVVGKLEGEREITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLAREGNEIIRAACKWSPELAAACEVWKEIKFEFEPVDTV

SEQ ID NO: 23277 - protein, 214 aa, Bacillus methanolicus
MIKIAPSILSANFARLEEEIKDVERGGADYIHVDVMDGHFVPNITIGPLIVEAIRPVTNLPLDVHLMIENPDQYIGTFAKAGADILSVHVEACTHLHRTIQYIKSEGIKAGVVLNPHTPVSMIEHVIEDVDLVLLMTVNPGFGGQSFIHSVLPKIKQVANIVKEKNLQVEIEVDGGVNPETAKLCVEAGANVLVAGSAIYNQEDRSQAIAKIRN

SEQ ID NO: 23278 - protein, 418 aa, Streptomyces coelicolor A3(2)
MSDITVTNWAGNITYTAKELLRPHSLDALRALVADSARVRVLGSGHSFNEIAEPGDGGVLLSLAGLPSVVDVDTAARTVRVGGGVRYAELARVVHARGLALPNMASLPHISVAGSVATGTHGSGVGNGSLASVVREVELVTADGSTVVIARGDERFGGAVTSLGALGVVTSLTLDLEPAYEMEQHVFTELPLAGLDPATFETVMAAAYSVSLFTDWRAPGFRQVWLKRRTDRPLDGFPYAAPAAEKMHPVPGMPAVNCTEQFGVPGPWHERLPHFRAEFTPSSGAELQSEYLMPREHALAALHAMDAIRETLAPVLQTCEIRTVAADAQWLSPAYGRDTVAAHFTWVEDTAAVLPVVRRLEEALVPFAARPHWGKVFTVPAGELRALYPRLADFGALAGALDPAGKFTNAFVRGVLAG

SEQ ID NO: 23279 - protein, 236 aa, Sphingomonas sp.
MSKKIYSNPGAALEGLLFDGMTIMSGGFGLSGNPESLIPEIRASRANNLTVISNNAGADGFGLWMLLETRQIRKMISSYVGENKLFEQQYLSGELELELNPQGTLAERIRAGGAGIPAFYTRTGVGTVVAEGKPVEQFDDEDYVRETWLRADLAIINAWRADPAGNLMFRKTARNFSPKVATAAKVTVVEVEEIVEPGTFDPDCIHTPGIYVDRIVVSTINEKRIEKMTTRPRETV

SEQ ID NO: 23280 - protein, 468 aa, Loropetalum chinense
KASVGFKAGVKDYKLTYYTPEYATKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 23281 - protein, 468 aa, Shaniodendron subaequale
KASVGFKAGVKDYKLTYYTPEYETKDTDILAAFRVTPQPGVPPEEAGAAVAAESSTGTWTAVWTDGLTSLDRYKGRCYHIEPVAGEESQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACELWKEIKFEFEAMDTL

SEQ ID NO: 23282 - protein, 468 aa, Mytilaria laosensis
KASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELTAACEVWKEIKFEFEAMDTL

SEQ ID NO: 23283 - protein, 465 aa, Rhodoleia championii
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 23284 - protein, 465 aa, Trema micrantha
VGFKAGVKDYKLTYYTPEYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 23285 - protein, 341 aa, Solanum chacoense
MAELLSNWSSTLEAVPPSHCIPVHERPSDPVEIVDSIPVIDLGKANGEERSAVVKDLLKAFEEYGFFQIINHGVPVDLMDEAMKVYKEFFSLPAEEKAEYAKDAANDTNRGAATLYSSSAKHYDSEEHRYWRDVLEHSCNLDGKDKKTWPSNPPRYREVIGAYGDELRRVSKVILGLLAEGLGLEAGFFDKELGQRMLVNHYPACPDPSLTLGVGGHCDPNLITIIQQEVYGLQILKDDKWIGVQPIRNAFVVNSGLPITVVSNGKLTSVAHRVVTNTTHSRTSIGTFICPHDIVEPAKALVGPENPPQFKSFNWGIDFMPHYLSKKSVYHASLEPFKIDA

SEQ ID NO: 23286 - protein, 371 aa, Methylovorus sp. SS1
MAKKDYYEVLGVNRDASDEEIKKSYRKLAMKYHPDRNPDNPKAEESFKEAKEAYEVLSDEQKRAAYDQYGHAGVDPSAGPGPRQGFGNFADAFGDIFGDIFGGGGGNRRSNVYRGADLRYNMEISLEDAARRTETKIRIPVMSECETCHGSGARPGTQPVTCTTCGGHGQVRMQQGFFSVQQTCPKCHGSGKMVKEPCPSCQGAGRVKKHKTLSVKIPAGVDEGDRIRLSGEGERVNGGPPRDLYVVVHLKQHDIFQRDGGNLHCEMPISFTTAALGGEIEIPTLDGHAKMKIPPETQTGATFRLRGKGIKPLRTNDPGDLMCHVVVETPIKLTERQKELLREMEEINLQDSDKHSPRAKGWMDKVKDFFQ

SEQ ID NO: 23287 - protein, 2166 aa, Oryza sativa
MSAAQGMAYKLRTDAAPTGAGRRARRSHSSVAAPYRAARLVQGGVSIEGGLVGGCQLTEERVAARPPRAAARDAEPVRPLSTLPESSIGLYDPSRERDSCGVGFVAELSGDYKRATVNDALEMLERMAHRGACGCEKNTGDGAGILVALPHNFFREVTKDAGFELPQPGEYAVGMVFLPIDEKRRERSKAEFQKVAESLGHVILGWRRVPTDNSDLGESALQTEPVIEQVFLTKSSSSEADFEQQLYILRRLSILSIRAALNLRRGGKRDFYMCSLSSRTIVYKGQLKPCQLKGYYYADLGHENFTSYMALVHSRFSTNTFPSWDRAQPMRVLGHNGEINTLKGNKNWMKAREGLLECEKLGLTKDQFSKILPIVDATSSDSGAFDGVLELLIRGGRSLPEAVMMMIPEAWQNDVNMEPEKKALYEFLSALMEPWDGPALISFTDGRYLGATLDRNGLRPGRFYVTHSGRVVMGSEVGVVDVPSKDVLRKGRLNPGMMLLVDFENHTVVDDEALKAQYSKAHPYGEWLKRQKIYLKDIVESVPETERVAPGISGSLTQKNEKKEHAGVNGIVTPLKAFGYTVEALEMLLLPMAKDGVEALGSMGNDTPLAVMSNREKLTFEYFKQMFAQVTNPPIDPIREKIVTSMECMIGPEGDLLETTEKQCNRLALEGPLVSIDEMEAIKKMNYRGWRSKVLDITYPKKSGRKGLEETLDRICTEARGAIKKGYTVLVLSDRGFSSDRVAVSSLLAVGAVHQHLVANLERTRVGLVESAEPREVHHFCTLVGFGADAVCPYLAIEAIWCLQNDGKIPPNGDGKPYSKEELVKKYFYASNYGMMKVLAKMGISTLASYKGAQIFEALGLSSEVIRKCFDGTPSRIEGATFEMLARDALRLHELAFPSRAPPPGSADAKALPNPGDYHWRKNGEVHLNDPLAMAKLQEAARVNSRAAYKEYSRRIQELNKTCNLRGMLKFKDTADMISVDEVEPASEIVKRFVTGAMSYGSISLEAHTALAMAMNKLGGKSNTGEGGEQPSRMEPLANGSMNPKRSAIKQVASGRFGVSSYYLTNADELQIKMAQGAKPGEGGELPGHKVIGDIAVTRHSTAGVGLISPPPHHDIYSIEDLAQLIHDLKNSNPRARISVKLVSEAGVGVVASGVVKGHADHVLISGHDGGTGASRWTGIKNAGLPWELGLAETHQTLVANGLRGRAILQTDGQLKTGKDVAVACLLGAEEFGFSTAPLITLGCIMMRKCHTNTCPVGIATQDPVLREKFAGEPEHVINFFFMLAEELREIMSQLGFRTITEMVGRSDMLEVDPEVVKSNEKLENIDLSLILKPAAEIRPGAAQYCVEKQDHGLDMALDNKLIALSKAALEKEVRVFIETPIQNTNRAVGTMLSHEVTKRYHMKGLPAGTIHVKLTGSAGQSLGAFLCPGITLELEGDSNDYVGKGLSGGKIVVYPPRDSTFIPEDNIVIGNVALYGATIGEAYFNGMAAERFCVRNSGAQAVVEGIGDHGCEYMTGGTVVILGKTGRNFAAGMSGGIAYVYDIDGKFSVRCNHELVDLYHVEEEEDITTLKMMIEQHRLNTGSVVARDILSNFDTLLPKFVKVFPRDYKRVLDNMKAEKAAAKLAKEPKISNGVSVTTKKVQPEQSTNRPTRVSNAKKYRGFISYERESISYRDPNERVKDWKEVAIESVPGPLLNTQSARCMDCGTPFCHQESSGAGCPLGNKIPEFNELVHQNRWREALDRLLETNNFPEFTGRVCPAPCEGSCVLGIIENPVSIKSIECAIIDKGFEEGWMVPRPPLQRTGKKVAIIGSGPAGLAAADQLNKMGHFVTVFERADRIGGLMMYGVPNMKTDKIEIVQRRVNLMAEEGITFVVNANVGSDPLYSIERLRSENDAVILACGATKPRDLGIPGRELSGVHFAMEFLHANTKSLLDSNLEDGRYISAKGKKVVVIGGGDTGTDCIGTSIRHGCTSIVNLELLTKPPSKRAADNPWPQWPRIFRVDYGHQEASSKFGNDPRTYEVLTKRFIGDENGNVKALEVVRVKWEKVDGRFQLKEIEGSNETIEADLVLLAMGFLGPEATIAEKLGLEKDNRSNFKAQFGNFATSVDGIFAAGDCRRGQSLVVWAITEGRQAAAAVDKYLSRNEQDAAEDITPSGAGFVQPVAA

SEQ ID NO: 23288 - protein, 485 aa, Streptomyces coelicolor A3(2)
MTQQSVEPEITAEDAGAGSRVPGGRSWLDRYFHISHRGSTVAREVRGGITTFMAMAYIVLLNPVILSGKDAAGDTLGQKALITATAFAAALTTLLMGFVGKVPLALAAGLSVSGVIAGQVVPQMTWPQAMGMCVMYGVVIMLLVVTGLREMIMNAIPLALKHGITMGIGLFIAIIGLVKGGFVHAGEATPLTLGPAGELAGWPVLLFAGTLLLIFMLQARNMPGAILIGIVTGTIVAAILNATGVIDPEQWANGAPELHGSAVSMPDFSLFGDLEFGGWGEVGAMTVGMIVFTLVLAGFFDAMATIIGVGTEAKLADDKGRMPGLSKALFIDGAGGAIGGVAGGSGQTVFVESATGVGEGARTGLASVVTGLFFAACLFFTPITAIVPQEVASAALVVIGAMMMMNARHVDWADRATAIPVFLTVVLMPFTYSITAGVAAGVISYVAIKVAQGRAREIGAFMWALTVIFVVYFALNPIESWLGVH

SEQ ID NO: 23289 - protein, 497 aa, Cuscuta reflexa
MERREGGRDNSSCSNVNQLFGVKDSESLLYDDVFIVRDRNGDSYFAYWDIEKNTFLSEPFYSYRSRNSSYLPKIKAFMSEDRSQIHEVKNGFRSEDHSKINKINGVENLFHNYNMNVLTDDYNFKMGMNGFHRPQSKIHINRFIDSYLQSQICIATTPGSGSDNDSYIHGSRVYGESESYTRSEGRSSSIRTRTKGVELTLRERPGILDRTKKYMYLWLQCDNCYGLNYKKVLKSKMTICEQCGYHLQMSSSDRIELSIDPGTWDPMDEDMVSRDPIKFDSGGGEAYKDRLYFYQRKTGLTEAVQTGIGQLNGIPVAIGVMDFKFMGGSMGSVVGEKITRLIEHATNKFLPLIIVSASGGARMQEGSLSLMQMAKISSALYDYQSNKRLVYVSILTSPTAGGVTASFGMLGDIIIVEPRAYVAFAGKRVIEQTLNQTIPNDSQEAEFLFHKGLFDLIIPRHLLKSVISELFTLHDLFPLNQNSNQYSQYRALLNPIF

SEQ ID NO: 23290 - protein, 203 aa, Schizosaccharomyces pombe
MSAFKKSGSKSETSKKLVVVGDGGCGKTCLLIVFSSGTFPERYVPTVFENYITDITYGPNSKVIELALWDTAGQEEYDRLRPLSYPNSNVILLCFSIDCPASLNNVTEKWYPEVQHFCPRTPIVLVGLKADLRKDRNATEVLRTQGLTPVTYQQAQSVALSMNAPYVECSAKENTGVNEVFQLAVGLTIKKSFSFSKKSCVIL

SEQ ID NO: 23291 - protein, 338 aa, Populus tomentosa
MPVDASSLSGQGQTICVTGAGGFIASWMVKLLLDKGYTVRGTARNPADPKNSHLRELEGAQERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCHGKAVAEQAAWDMAKEKGVDLVVVNPVLVLGPLLQPTVNASIVHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQERGHLPIPKQAAEESVKIQ

SEQ ID NO: 23292 - protein, 101 aa, Capsicum annuum
MATVYKIQGAFLKSCVFLGVVLVLAVSVKGNSEGDALYALRRSLSDPDNVLQSWDPNLVNPCTWFHVTCNGDNQVTRVFEHNPRLEGPELLGLASYDTNCS

SEQ ID NO: 23293 - protein, 180 aa, Capsicum annuum
MASSVMSTATVATGANAAQASMIASFNGLKSAASFPVTRKQDLDITSIASNGGRVQCMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEGY

SEQ ID NO: 23294 - protein, 362 aa, Kluyveromyces marxianus
MLFSNTLLIAAASALLAEASPLEKRDSCTLSGKTAGGGLSNCATVTVNNVEVPSGKTLDLTGLQDGATVNFVGQVTFDYDEWVGPLVSISGNNIKVVGKSGHLLDGDGARWWDGKGDSGKKVKPKFMSLKLTGNSDVGGLQIKNTPIQAISVNSCSDTVIHDVTIDNSDGDKDSLGHNTDGFDVGSVNNVTIENCHVYNQDDCIAVNSGTGVYFKNNYCSGGHGASIGSVGLRSNNVVDTVYFENNQIVNSDNGLRIKTIQKATGSVNNVHFLSNTISGIRKFGIVVETDYSNGSTTGTPGSKVPITNFEVDGLTGSVDSSAYRVKILVAGASKWTWKDVDITGGCSFGSCTGIPSGSGAFC

SEQ ID NO: 23295 - protein, 499 aa, Aspergillus awamori
MMVAWWSLFLYGLQVAAPALAATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWFDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 23296 - protein, 400 aa, Psychrobacter sp. Ant300
MTIKLASTDRIDNDIREENGTQENRLTVKQKVLSYNPLTTCQPHTLHYAMKGVGYLPTPLLESLVGYLKGPSSKQYLHADAHLRLILAVNSKLVHWEDKVIANADDGDMTIRCYQSDASSHGLGFKKADTHNSDETVLLYFHGGGFCIGDVNTHHEFCHAVCEQTGWPIVSVDYRLAPEHPAPAALKDCITAYAWLAEHCHTLGALPSRIVLAGDSAGGGLSTLIAQQLSAPSQVAWSDLGSAGQKMFDLLERLPKPLAQMPLYPVTDIETDYPSWELYGEGLLLDHADVAVFDAACLDNSPLPRQHILNCPMLGDNSKVCPTYIVAAELDVLRDEAFAYAKQLKVHGIAVKTHTILGAPHGFIHFMSIHQGIGQKTGDIIKGFASFVRDVINTQSQLAA

SEQ ID NO: 23297 - protein, 323 aa, Pisum sativum var. macrocarpon
MENFPIVDMGKLNTEDRKSTMELIKDACENWGFFECVNHGISIEMMDTVEKLTKEHYKKCMEQRFKEMVATKGLECVQSEIDDLDWESTFFLRHLPVSSISEIPDLDDDYRKVMKEFALKLEELAEELLDLLCENLGLEKGYLKKAFYGSKGPNFGTKVSNYPPCPKPALIKALRAHTDAGGIILLFQDDKVSGLQLLKDEQWIDVPPMRHSIVINLGDPLEVITNGKYKSVMHRVIAQTDGARMSIPSFYNQGGDAVISPASTLLKEHEPSEVHPKFVFDAYMKISMGLKFQATEPRFELAEIMSIVKVGPVVRLWICVWLS

SEQ ID NO: 23298 - protein, 482 aa, Agrobacterium vitis
MFIRNNRRSKIVATVGPASSSPDMLRSLFLAGVDTFRLNFSHGARADHAEVYRNIRALEQEHDAAIAVLQDLQGPKIRIGVLAHGRLDLARGSTIGFILGREGGEGMNDIPLPHREIFEVAVPGMDLLIDDGRIKVRIMEVMDGRLVCEVLNGGALSNRKGVNVPGAVLDISPLTAKDREDLEFGLELGVDWVALSFVQRARDMIEARSLVGDRAGLIAKIEKPSALDDIEDIVRLSDSVMVARGDLGVEIPPEDVPGKQKEIIRACRLAAKPVIVATQMLDSMVSSPTPTRAEASDVAGAIYDGADAVMLSAETATGAYPVEAVEIMNRIIEKTEKHKHYRPILEATEPDVAQSPPHAVATAAANVAVALGSPVVVAYTSSGTTAARISRARPALPILALTPSEQVARRLNMFWGVVGVRSQDVHTYEASLIHAQQAVQEAKLASPSDHIVIVAGFPFAQQGSTNNLRVVQIAATDNLEIA

SEQ ID NO: 23299 - protein, 401 aa, Pseudomonas sp. 101
MAKVLCVLYDDPVDGYPKTYARDDLPKIDHYPGGQTLPTPKAIDFTPGQLLGSVSGELGLRKYLESNGHTLVVTSDKDGPDSVFERELVDADVVISQPFWPAYLTPERIAKAKNLKLALTAGIGSDHVDLQSAIDRNVTVAEVTYCNSISVAEHVVMMILSLVRNYLPSHEWARKGGWNIADCVSHAYDLEAMHVGTVAAGRIGLAVLRRLAPFDVHLHYTDRHRLPESVEKELNLTWHATREDMYPVCDVVTLNCPLHPETEHMINDETLKLFKRGAYIVNTARGKLCDRDAVARALESGRLAGYAGDVWFPQPAPKDHPWRTMPYNGMTPHISGTTLTAQARYAAGTREILECFFEGRPIRDEYLIVQGGALAGTGAHSYSKGNATGGSEEAAKFKKAV

SEQ ID NO: 23300 - protein, 466 aa, Fouquieria columnaris
SVGFKAGVKEYKLTYYTPDYETKDTDILAAFRVTPQPGVPPEEAGAAVAAESSTGTWTTVWTDGLTSLDRYKGRCYHIEPVAGEENQYIAYVAYPLDLLEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 23301 - protein, 466 aa, Pouteria eerwah
KASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRVPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMD

SEQ ID NO: 23302 - protein, 359 aa, Salicornia herbacea
MSAFVGKYADELIKTAKYIATPGKGILAADESTGTIGKRLASINVENVESNRQTLRELLFTSPGALPFLSGVILFEETLYQKTSQGKPFAQLLQENGVIPGIKVDKGVVELSGTNGETTTQGFDSLGARCQEYYKAGARFAKWRAVLKIGPTEPSELSIQQNAQGLARYAIICQENGLVPIVEPEVLTDGNHDIKKCAAVTETVHAACYKALNDQHVLLEGTLLKPNMVTPGSDSPKVAAEVIAEYTVTALRRTVPPAVPGIVFLSGGQSEEEATVNLNAMIKLEVLKPWTLSFSFGRALQQSTLKTWGGKKENLSKAQSVFLVRCKANSEATLGKYVAAGNSDNGAASESLFQKDYKY

SEQ ID NO: 23303 - protein, 1118 aa, Hordeum vulgare subsp. vulgare
MDCLRLAVAAAALLLAALAAAADDAQLLDEFRMALPSQAPLEGWTAREGACRFPGAVCRGGRLTSLSLAAVTLNADFRAVANTLLQLSAVERLSLRGANVSGALAAARCGGKLEELDLSGNAALRGSVADVAALAGSCGALRTLNLSGDAVGAAKPAGGGGGGQGFAALDALDLSSNKIAGDADLRWMVGAGLGSVRWLDLAWNKISGGLSDFTNCSGLQYLDLSGNLIAGDVAAAALSGCRSLRALNLSSNHLAGAFPPNIAGLTSLTALNLSNNNFSGEVPADAFTGLQQLQSLSLSFNHFSGSIPDSVAALPDLEVLDLSSNNFSGSIPDSLCQDPNSRLRVLYLQNNYLSGSIPEAVSNCTDLVSLDLSLNYINGSIPESLGELSRLQDLIMWQNLLEGEIPASLSSIPGLEHLILDYNGLTGSIPPELAKCKQLNWISLASNRLSGPIPSWLGKLSNLAILKLSNNSFTGKIPAELGDCKSLVWLDLNSNQLNGSIPPELAEQSGKMTVGLIIGRPYVYLRNDELSSQCRGKGSLLEFSSIRSEDLSRMPSKKLCNFTRMYMGSTEYTFNKNGSMIFLDLSFNQLDSEIPKELGNMFYLMIMNLGHNLLSGAIPTELAGAKKLAVLDLSHNRLEGQIPSSFSSLSLSEINLSSNQLNGTIPELGSLATFPKSQYENNSGLCGFPLPPCESHTGQGSSNGGQSNRRKASLAGSVAMGLLFSLFCIFGLVIIAIESKKRRQKNDEASTSRDIYIDSRSHSGTMNSNWRLSGTNALSINLAAFEKPLQKLTLGDLVEATNGFHNDSLIGSGGFGDVYKAQLKDGRVVAIKKLIHVSGQGDREFTAEMETIGKIKRRNLVPLLGYCKIGEERLLMYDFMKYGSLEDVLHDRKKIGVRLNWAARRKIAIGAARGLAFLHHNCIPHIIHRDMKSSNVLVDENLEARVSDFGMARMMSVVDTHLSVSTLAGTPGYVPPEYYQSFRCTTKGDVYSYGVVLLELLTGKPPTDSTDFGEDHNLVGWVKMHTKLKITDVFDPELLKDDPTLELELLEHLKIACACLDDRPSRRPTMLKVMTMFKEIQAGSTVDSKTSSVATGLSDDPGFGVMDMTLKEAKEEKD

SEQ ID NO: 23304 - protein, 209 aa, Buchnera aphidicola
MLSKKENLLKLDWIKTNGLIPAIIQDFASNLVLMHGYMNKEAFLKTQKEGFVTFYSRTKKRLWTKGEESGNLLKVIDIVTDCDYDTILIIVEPLGKTCHLNRKSCFFLKENTLNFLSKLEDLIEDRKNFNTDNSYTARLYKSGTKRIAQKVGEEAIETILAAMKNDGDELINESSDLIYHLIVLLHDQNLNFNLIIENLKKENRKIINL

SEQ ID NO: 23305 - protein, 473 aa, Buchnera aphidicola
MLKQQVGVIGMAVMGRNLALNIESKKYTVSIFNRTQSVTEEVINNNKEKKIFPYFSIKDFVNSLRKPRCILLMVKSGQPTDETIQFILPYLNKGDILIDGGNTFYKDSIRRSNDLMKCGINFIGMGVSGGELGALNGPSIMPGGSREAYDLVSSMLKNISAKFKNEPCVSYIGPNGAGHYVKMIHNGIEYGDMQLISESYFILKNVLNMKNEELSNTFSQWNKGELNSYLIEITKNIFLKKEKDGIHYLIDSILDHAEDKGTGKWISQDALELHEPLSLITESVFARYLSSLKDQRLIASKILKGPILKCISSQNKELFVEEVTKSLYLGKIISYAQGFSQLKKASEIYSWNLQYGKIAKIFRAGCIIRADFLERITDAFKSNNVTNLLLTPYFSEISNKYEKSLRYITSYAIKYGIPVPTFASAISYYDNYRTMSSSANLIQAQRDYFGAHTYRRTDKKGYFHTNWLTKKEL

SEQ ID NO: 23306 - protein, 471 aa, Rhizobium etli
  misc_feature (204)..(204): Xaa can be any naturally occurring amino acid
  misc_feature (453)..(453): Xaa can be any naturally occurring amino acid
MRVRDEEMGKVTGFLEIDRQVAKYQPASDRIRHFREFTIPMSDPEVQKQAARCMDCGIPYCHGPTGCPVHNQIPDWNDLVYNNNWEAAIQNLHSTNNFPEFTGRVCPAPCEEACTLNLEDAPVAIKTVEQAIADKAYELGFIRPQPATVHTGKKVAVIGSGPAGMAAAQHSAAPATKCMSMNVRQPGGCCLRLPIQMEKLLIPXGEMKGRGVHLPLGRSISVLKSRLSSCLPIMTPSFTAAVPRRRVRPAFRVLTLPACMMPCPIWSSRTAASGARTLTASAGRRIQFLLAPNMSSLSAAAIRRRTVSARRSARVPSKSPSSTSGRSRRRRKTSSPSGPSGRRRCARPPRRPRVPSASSRWRRSNSSAKTACYRRQVLRGRRAPAAGRRHGHSRRSRLHRHRFPRPVHNKRAEGIEGKLTLNTDKRGSTNVVANDRDYETSVDKLWTAGDVRXGSHWWSGRSEKPTGGARH

SEQ ID NO: 23307 - protein, 468 aa, Asteranthos brasiliensis
KASVGFKAGVKDYKLTYYTPDYKTLDTDILAAFRVTPQPGVPPEEAGAAVAAESSTGTWTTVWTDGLTSLDRYKGRCYHIEPVPGEDNQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTSEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDYIEKDRSRGIYFTQDWVSMPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 23308 - protein, 465 aa, Galax urceolata
VGFKAGVKDYILTYYTPDYETKDTDILAAFRVTPQPGVPPEEAGAAVAAESSTGTWTTVWTDGLTSLDRYKGRCYHIEPVVGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAEAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIRQAGKWSPELAAACEVWKEIKFEFEAMDTL

SEQ ID NO: 23309 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFSAFRPPGCE

SEQ ID NO: 23310 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYSDAYVRVIGFDNLRQVQCVSFIAFRPPGCE

SEQ ID NO: 23311 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 23312 - protein, 165 aa, Aegilops speltoides
VMASSATTVTPFHGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGWE

SEQ ID NO: 23313 - protein, 165 aa, Triticum timopheevii subsp. armeniacum
VMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 23314 - protein, 165 aa, Triticum aestivum
VMASSATTVAPFQGLKSTAGLPVSRRSSGSLGRVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 23315 - protein, 165 aa, Secale cereale
MMASSATTVAPFQGLKSTAGLPVSRRSSGSLGNVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 23316 - protein, 165 aa, Hordeum vulgare subsp. vulgare
VMASSATTVAPFQGLKSTAGLPVSRRSSASLGSVSNGGRIRCMQVWPIEGIKKFETLSYLPPLTTEALLKQVDYLIRSKWVPCLEFSKVGFVFREHNSSPGYYDGRYWTMWKLPMFGCTDATQVLNEVEEVKKEYPDAYVRIIGFDNLRQVQCVSFIAFRPPGCE

SEQ ID NO: 23317 - protein, 165 aa, Avena sativa
VTASSATSVAPFQGLKSTAGLPVGRRSNAGLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCE

SEQ ID NO: 23318 - protein, 165 aa, Aegilops speltoides
VMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 23319 - protein, 154 aa, Aegilops speltoides
VMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCV

SEQ ID NO: 23320 - protein, 165 aa, Aegilops speltoides
VMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLSEVEEVKKEYPDAYVRVIGFDNLRQVQCVSFIAFRPPGCE

SEQ ID NO: 23321 - protein, 165 aa, Aegilops sharonensis
VMASSATTVAPFQGLKSTAGLPVSRRSSASLGSVSNGGRIRYMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 23322 - protein, 164 aa, Aegilops bicornis
VMASSATSVAPFQGLKSTGGLPVSRRSRGSLGSVSNGGRIRCMQVWPIEGIKKFETLSYLPPLSTEALLKQVDYLIRSKWVPCLEFSKVGFVFREHNSSPGYYDSRYWTMWKLPMFGCTDATQVLNEVEEVKKEYPDAYVRVIGFDNLRQVQCVSFIAFRPPGC

SEQ ID NO: 23323 - protein, 165 aa, Aegilops tauschii
VMASSATTVAPFQGLKSTAGLPVSRRSSGSLGSVSNGGRIRCMQVWPIEGIKKFETLSYLPPLSTEALLKQVDYLIRSKWVPCLEFSKVGIVFREHNSSPGYYDGRYWTMWKLPMFGCTDATQVLNEVEEVKKEYPDAYVRVIGFDNLRQVQCVSFIAFRPPGCE

SEQ ID NO: 23324 - protein, 165 aa, Triticum urartu
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHYSSPGYYDGRYWTMWKLPMFGCTDATQVLNEVEEVKKEYPDAYVRVIGFDNLRQVQCVSFIAFRPPGCE

SEQ ID NO: 23325 - protein, 165 aa, Triticum timopheevii subsp. armeniacum
VMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 23326 - protein, 165 aa, Triticum turgidum subsp. dicoccoides
VMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAYRPPGCE

SEQ ID NO: 23327 - protein, 165 aa, Triticum aestivum
VMASSATTVAPFQGLKSTAGLPVGRRSSGSLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLIEVEEVKKEYPDAYVRVIGFDNLRQVQCVSFIAFRPPGCE

SEQ ID NO: 23328 - protein, 165 aa, Triticum aestivum
VMASSATTVAPFQGLKSTAGLPVSRRSSASLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCE

SEQ ID NO: 23329 - protein, 165 aa, Secale cereale
VMASSATSVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCV

SEQ ID NO: 23330 - protein, 164 aa, Bromus catharticus
VMASSATSVAPFQGLKSTAGLPVSRRSTGLGSVSSGGRIRCMQVWPIEGIKKFETLSYLPPLSTEALLKQIDYLIRSKWVPCLEFSKVGFVFREHNASPGYYDGRYWTMWKLPMFGCTDASQVIKELEEVKKEYPDAYVRIIGFDNLRQVQCVSFIAFKPPGCE

SEQ ID NO: 23331 - protein, 331 aa, Lactobacillus sp. MD-1
MKLIVYNVRDDEIPFVEKWGRDHQIEVTTTTTTLNTETAAEAAGFDGVSCLQTIPYSKELFAALQRLGIHYLALRNVGTDNIDIQAAKANNVKITNVPAYSPESIAEFAVMMALYLSRKVGYMQQQLQEQHEFHFSPAFMGRLISEQTVGVIGTGRIGRHAIQLFRGLGANVIAYDKYPQKITGGAFKYVDHLEDIIKQSDIISLHMPATADNFHLFNHEVFEEMKPNAILINTARGTIVDTNDLIFALESGEIAAAGIDTLEDESIDLQDSRSTKKITDADLIKLSMMPNVILTPHSAFHTTESVKNMVNISLNNLKTMAEGGKPADLVD

SEQ ID NO: 23332 - protein, 232 aa, Brassica oleracea var. botrytis
MASSSYAPFSAVFSGFAATKPNPPPTCSAFLVPKRRSNSRNLKNGVSLKSWNKHGFQFKSRNLSVYARATEEKTVHDFTVKDISGKDVSLDKFKGKPLLIVNVASKCGLTSSNYTELSQLYDKYRNQGFEILAFPCNQFGGQEPESNPDIKRFVCTRFKAEFPIFDKVDVNGPSTAPIYQFLKSKSGRFLGDLIKWNFEKFLVDKKGNVVQRYPPTTPPLQIEKDIQKLLVA

SEQ ID NO: 23333 - protein, 2530 aa, Mycosphaerella zeae-maydis
MSSIHMSADGSTPIAIVGLSFRGPGDATSAENLLRMVAESRESRSPIPSQKWNASGHYHPDPSRQGSHIVEYGHWFQQDVYEFDAPFFNLSAVESAALDPQQRMLLECTYEAFENSGMPLNKLVGTDTSVFTAVFCTDYTDMLWRDPEMVPMYQCTNSGATRANMANRVSYSFDLKGPSITVDTACSGGLTALHLACQSLVTGESTQAVVSGSSLILGPETMVTMSMMRFLSPDGRCYAFDDRANGYARGEGVTVLLLKRLDDALANGDTIRAVIRGTGRNPDGKTTGIAMPSGLAQEALIRSVYAKTGLDLLDTAYIECHGTGTQAGDTTEARAISNVFGPGRQVPLAIGSVKTNIGHLEAASGLAGVLKCILMLENEIILPNRNFKHANLNIPLEEWKLRVPTTVEPWNSMTTRRASVNSFGYGGTNVHAILESADNFLRARGLDQTKFTRRPMHRIMAIRNALELEPEQNGNPFSSSGAKYMGQRADPQVFAVSAFDPTAGEACAKNLAYYVEERQDMADATFLSSLAFTLSDRRTVHPWKATVTASSSAELISGLRKVRFSSVKSTHNLAFVFTGQGAHWCGMGKELIKVYPAFRKSLEKCGAMLKRFGAPFDVIDELEAGFETSQLDKALYSQSLCTALQIALIDMLSDWDIQPKSVTGHSSGEIGAAYAAGALKLEDAMLVAYARGLAMSDLSTKGPKGAMVAVGMDRQELNLILVGLKSGKAVIACSNSPKSFTVSGDKCALDELQGALRQRGVYNRRLNVEVAYHSHHMELVADSYRNTINNIKVLADSPVRFFSSVMGELTDKSKLGPDYWVSNLVGEVKFAESLHALVTHSNTDSTEQIQTIIEIGPHSALAGPIRETLEAAEFSHKTSIDYLSVLVRRKDAVVTALTLASKLFVAGFAVRLAAVNQNACSTVPPLNDLPSYAWNHSKSYSAESRISRSYRERPHTRMSLIGVLDVQSSALEPRWRQILRISELPWLRDHNIQSNVVYPAAGYLTMAIEAAAQRNAVRAPGTKIEGFQFREVNISSALIIPETPGEVEVFITLKAFSESLRSPSNLWDEFSVSSVSESNRWTEHCRGLIAVKTVSRSPNLVSGEAQEASDVEVYKGHVDDFEAACQSSWDAKEMYNGLWQTGMHFGPTFANISDLRIAPDKCIGRVQIPDTAAVMPMKYQEAFVVHPATLDSIIQTFLPALAAQTRKFNDAIVPVSIDDLFVSHEITRSPGHAFDCYTSTYRKDHRFTFVDITVFATPFVPGSKPVITVGSMTVATLQRQDPSENNDQVPSRAYNLEWAPDIEYLTPEQLVNVTSSSTGAEHQVTKQKLDRASVELIREALARTHEQQSVEVGGSAHVLRKLLDSRAEHATSDSSTDRDSSLTSASATIAQAAERLPNLLVGGAEQDDPAQLYDLMDVATTPGLFAKNHSIATYLQLLSHKKPDLTVLTIGPQSGPASLNLLLLLSDLGCDAGPFKAFHHSDAELNIDHAAKTRFPSWANSITFVDLKIKDSVALESSSNVEQTYDVVVAFNMAGSSIQLAATLSAASALQTYRGKVLLADHAVQSPLATLVWSSLPSFVSSQKEGAELDLSDAHDVAQEKGYQAHAMLADRVHVMQKAREEHEVETAIDTLIVATDQDLESVDIALLQRLCEEQGSAVQLVSLEAAHPEPKQACIVLNELSQPVLVEPTDGEWEALKRITHCGAGVLWVTRGAGSDTCADPQAALIQGLARTVRAEVGDRPMATLDLDEEVRLNAVEAAKCIAGVFRHVMRAASAELELRERNGVVHVPRLIEDLDASRQLQAEDGIAAATETLTLQQAGSCRLFAGTPGLLDSLHFAPDERVSVELAAGDIEVEVQAAGINFKDVMMAMGQIPIEDLGLECSGMVTSVGSQVQCFAVGDRVVTMGPGSFCTRLRVDARLAYRIPDSMSWETAAALPITHVTAYHAVRHLGRIVRGDTVLVHAAAGGLGQALVELSIMAGARVLVTVGSADKKHFVMERFGIPEHHVLYSRDTSFASHVMRLTQGVGVDVVMNSLAGEALRQSWTCIAANGRFVELGQRDITVNSRLDMAPFARNASFIAFNLAKMLRQDPQMACEMLGEVLKLYDRGTLRGYQSLETYTYSHLGDAFRKMQTGRHMGKLVAVARPADIVRFQGTPALSPPLFDPDAAYLLVGGLGGLGSATALWMAERGARHLVLLSRSGASPSQDSILARLRATNCATTVLACDVAERDLLASALATVKDTLPPIRGVIQGAMVLRDGMLAQLSRSDYLAVLRPKLHGTWNLHALLPDLDFFIVESSISGIVGNAAQAAYAAANTFLDAFARYRRSLGLPATAIDIGAVEGIGYLARNPELKRAMERQGFSFTDEARLMRLLDFSISHPARQPRRSHIITGLGAWHPDCSLPVLGAPLFSRHRLLSSRGISAPAAINSLRNTLKHATTHDAEIALLAALVDHVVARTDIPVENVDTSKGLQDYGIDSLAAVELRNWLSRETDSVIPILELLGAESLTDLAAKIVARSRPITVANGAA

SEQ ID NO: 23334 - protein, 341 aa, Glycine max
MSSTAGQVIKCKAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNG

SEQ ID NO: 23335 - protein, 219 aa, Rhodospirillum rubrum
MTRAIRIAPSLLSADFAISRPRCPSDGRTGADILHFDVMDNHYVPNLTVGPLVCAALRPHTSLPIDVHLMTRPVDPLIDSFAEAGADMITFHPEASDHVHRSVQMIRKRGLKAGVALNPASPLSLLDHILEDLDLVLIMSVNPGFGGQSFIPSALPKIAALANGRRRACRGDRVDGGVNPADARALARPGPISWSGWRSSERVTGPRPSPPSGAPRKVD

SEQ ID NO: 23336 - protein, 273 aa, Schizosaccharomyces pombe
MSVYQTREGLPSGWVAQWDAEYGTYFYVNESAQNPQPQWEPPVENLKLAPPPGATSVNTAVYNNNNNTSAANTNAAYNANTAANANANTATTTNAAATTSAAYNPNAPANTNAAYYPNAAATTTTNADGSDKGLFSGLTSSNGYTTGNSYSRPSYVAPVAAGLGGLALGGLASHALGNLFHHRGHNGGGFGGFGGGSGGPPPGPGGFGGFGGFGGEGHHHGGHGGFGGGPGGFEGGPGGFGGGPGGFGGGLGGFGGGPGGFGGGPGGHGGPGW

SEQ ID NO: 23337 - protein, 474 aa, Schizosaccharomyces pombe
MGGSDFEDDELFKDLYGEENEKKVESASGNQETSNVTPTKENEGYEELEKSGEAGAERTKENPFREEPGADFDRSGSDQQYSAEAEANQEDDLNETSQQAPDPSSYDIRGQALSSATWDNAEDGENSKNDNYNENQSALTGSGAMESNEDNAEETSPFNREDGKMFIGGLNWETTDDSLRDYFEQFGEVLDCTVMRDSTTGRSRGFGFLTFKNPKCVNEVMSKEHHLDGKIIDPKRAIPREEQEKTAKMFVGGVPGDCTEEEFRNFFNQFGRVLDATLMMDKDTGRPRGFGFVTYENESAVEATMSQPYITIHGKPVEVKRATPKASLRDSHDRHQHGYHGNANPYYAQNMNMYGGMTPAMMAQYYRQMQQYMEAMRNMPAAAGAVPYPQPVMPAGMADWQQQQQQGAAYFDPSKMNQGTGDGVPFSPSMPSGSSRGGYHGRNPGGPNRQRYRGRRDGRGGNTGGGHSFHPYRR

SEQ ID NO: 23338 - protein, 492 aa, Schizosaccharomyces pombe
MSQKEVADFGLIGLAVMGQNLILNGADKGFTVCCYNRTTSRVDEFLANEAKGKSIVGAHSLEEFVSKLKKPRVCILLVKAGKPVDYLIEGLAPLLEKGDIIVDGGNSHYPDTTRRCEELAKKGILFVGSGVSGGEEGARYGPSLMPGGNPAAWPRIKPIFQTLAAKAGNNEPCCDWVGEQGAGHYVKMVHNGIEYGDMQLICETYDIMKRGLGMSCDEIADVFEKWNTGKLDSFLIEITRDVLRYKADDGKPLVEKILDAAGQKGTGKWTAQNALEMGTPVSLITEAVFARCLSSLKSERVRASKKLTGPNTKFTGDKKQLIDDLEDALYASKIISYAQGFMLMREAAKEYGWKLNNAGIALMWRGGCIIRSVFLKDITEAFREDPNLESILFHPFFTNGVEKAQAGWRRVVAQAAMLGIPVPATSTGLSFYDGYRSAVLPANLLQAQRDYFGAHTFRVLPEAADKSLPADKDIHINWTGHGGNISATTYDA

SEQ ID NO: 23339 - protein, 370 aa, Scherffelia dubia
MFGKAVTARPACAPCAPAPSPCAPGKFDEELIKTAKHIASPGKGILAMDESNATCGKRLDSIGVGNTEENRRTYRELLLTAPGLGNYISGAILFEETLYQKASNGKSFVDVMRSTGIAPGIKVDKGLVPCGTATTSWCTGLDGLAGAAEYYKQGARFAKWRSTVAVGAGPSIIHARHAYGLARYAAICQDNGLVPIVKPEILLDGDHTIDETLDVAKATWAETFKYMADNKVMFEGILLKPSMVTPGAECKVRADPQTVASYTLGLSQPRAPPVPGIMFLSGGQSELEASLNLNAMNQSPNPWHVSFSYARALQNTVLKTWKGEPGNVKAAQEALIVRAAANSAAQMGKYDPAKEAESAKAGMFEKGYVY

SEQ ID NO: 23340 - protein, 475 aa, Welwitschia mirabilis
MSPKTETKASVGFQAGVKDYRLTYYTPEYQTKDTDILAAFRVTPQPGVPPEEAGAAVAAESSTGTWTTVWTDGLTSLDRYKGRCYDLEPVPGEDNQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSMPGVMPVASGGIHVWHMPALTDIFGDDAVLQFGGGTLGHPWGNAPGAVANRVALEACVQARNEGRDLAREGNEVIREAAKWSPELAAACEVWKEIKFEFESVDTL

SEQ ID NO: 23341 - protein, 367 aa, Oryza sativa (japonica cultivar-group)
MDSRLVAFSHRRRRWILLAAGGAAAVFGAYKIYHHPAVAARRRRLARLAGAVAAFLDAAAASADAAALVASDLSDFVRSGSDELPRSVTQLAKLAASPEVSATVSAISEAITAGILRGVGSDSGPGSGGGVALSDRLVDRLFSESGERLAAAIAGSFARHLVAAIYSASSTPGETSSPMKWVNLIATGKGQKAISNWVEVFVSTAVGVFVDKTIHINTYDQLFQGLTNASHDAKVKELLVSVCNGAVETMVKATHHVMSNANYKSVGSGSNGAGEGWVETVSSTLAVPSNRKFVLDVTGRVTFETVRSFLEFALWKMHAGAKKGGNTVMDSGLRAMQYMTDKSMVIATICITLCLHVLNGTRLLVTA

SEQ ID NO: 23342 - protein, 380 aa, Sclerotinia sclerotiorum
MVNLSAPLILGGLSALASALPAAAPAPTAAPDLAKRATTCTFSGSSGAASASKSKASCATIVLSALAVPSGTTLDLTGLTQGTKVIFEGITTFGYEEWSGPLVSVSGTDITVTQSGSAYLDGKGASYWDGEGSNGGKTKPKFFAAHNLISSTIENIYILNPPVQVFSIDNANGLTINNVTINASAGDTGSLGHNTDGFDIGDSTSVTITGANVYNQDDCVAINSGTGITFSGGVCSGGHGLSVGSVGGRDDNIVQTVNFENSEIKNSQNGVRIKTISGDTGTVSGVTYSGITLSGITDYGIIVNQAYNGNAGSPTNGVAISKFILDNVTGTVESGATNIYIECGSGSCTNWTWSGVSVTGGKTSTSCLNVPTSGGVSCSL

SEQ ID NO: 23343 - protein, 204 aa, Paracoccidioides brasiliensis
MAQQQLQQLQTENVMRRKLVIIGDGACGKTSLLSVFTLGYFPTHYVPTVFENYVTDCRVDGRSVQLALWDTAGQEDYERLRPLAYSKAHVLLIAFAVDTPDSLENVRNKWIEEANERCPDVPIILVGLKKDLREDPLAIEEMRKKSLRFVSSKEGHDTAAQVGARKYLECSSLTGEGVDDVFEAATRAALLTFEKDRGSCCVIL

SEQ ID NO: 23344 - protein, 236 aa, Salmonella enterica
SIIVTTLLGWMMGDVHYNGIVSAPPSVTSVVGHVDLAGSFNLGLAGVIFSFMLVNLFDSSGTLIGVTDKAGLADEKGKFPRMKQALFVDSISSVTGAFVGTSSVTAYIESSSGVSVGGRTGLTAVVVGILFLLVIFLSPLAGMVPPYAAAGALIYVGVLMTSSLARVNWQDLTESVPAFITAVMMPFSFSITEGIALGFISYCVMKIGTGRLRDLSPCVVIVALLFVLKIVFIDGH

SEQ ID NO: 23345 - protein, 473 aa, Pentaphragma ellipticum
PQTETKASVGFKAGVKDYKLTYYTPDYETKDTDILAAFRVTPQPGVPPEEAGAAVAAESSTGTWTTVWTDGLTSLDRYKGRCYHIEPVPGEENQYIAYVAYPLDLFEEGSVTNMFTSIVGNVFGFKALRALRLEDLRVPTAYIKTFQGPPHGIQVERDKLNKYGRPLLGCTIKPKLGLSAKNYGRAVYECLRGGLDFTKDDENVNSQPFMRWRDRFVFCAEALNKAQAETGEIKGHYLNATAGTCEEMIKRAVFARELGAPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDAVLQFGGGTLGHPWGNAPGAVANRVALEACVQARNEGRDLAREGNEIIREASKWSPELAAACEVWKEIKFEFQAMDTL

SEQ ID NO: 23346 - protein, 397 aa, Bacillus cereus
MDMKQYLEPSQYKMYQNFLDFVCENIEPHANRWEIEQGIPSDIIKTCAKNGYLGGTLPAEYGGLEWDYVTYGLFTEAIARGSVSLSGLFNVHTMVTETILKWGTENQKNQWLPLLASGNQIAALALTEPGAGSDLNMIKTNFDQHGDKLILNGVKKWITFGAAADVFLVFGKLNGEQPIACLVPKDSVGVNVTHIRDMLGFKAAYLAEIEFNNVEIPFENIIGRPGFAFTYLAPYALEFGRISIAFAALGVLRTCLEICGNHVLHRSAFGNSLIDHGMISHMVTDMGVDLEASILLSLEACKAKNEHRADATEKIMIAKYFASRSGTRHSTNAVQIMGALGCNDNYSISRCFRDSKTMEIVEGSNQIHQLLLGKGFAKKAKRAIEKIPVTKGVIQPG

SEQ ID NO: 23347 - protein, 320 aa, Solanum chacoense
MEKNQEAEVMWKRGRTLGQGGFGFVSLACTTHSDDSPLIPSLIAVKSCMLSHSESLEDEIEFLRMCQDCPHVIRSFGVKVTQEDDILLYNLLLEYASAGSLADRLLNNDQLGLPEFQVQNHTKSVLLGLRFIHRKGIIHCDIKPHNILLTSTDDDDAEEVAKIADFGLSLTLEQSWTQTQGMRGTKRYMAPESLLKQEYGPEADIWALGCTVYELITGTPLWESSNSDPEFDDVLHRIMYEEPNLENDKLSTEAKDFMSYCLIKNPKSRWSAGLLLNHSFLKSADSVLPPKKRKRQQVTCPGYRGERKHSGHSHTFVIWL

SEQ ID NO: 23348 - protein, 304 aa, Solanum chacoense
MASIRWSRGRTIGKGAEGTVTLATTHNNFSIAVKSSLFSCSKSLQKEREFLNEFQDCSQIIRCFGADVTEEDNNILYNILLEYAIGGSLAHRIGKKSGLPDFEVKKYSKPILLGLRVVHGKGFVHGDIKPHNILLVGTEKRAKIADFGFASKVGIGSKKRKLRGTPMYMAPESVLDDEYGTPADIWAFGCTVFEMITGKKVWDCTGINDPLHLLCKIGMQSPDLHDDKMSKQAEDFLNKCVDRDPHSRWTADLLLNHPFLSSDNNDVHQRKRKELNLVDLCNSTELKPMKLLTNKRRRKLVERC

SEQ ID NO: 23349 - protein, 314 aa, Geobacillus stearothermophilus
MDVVTIGESMAVFTPTSVGLMRQATTFTMRIGGRESNVAVGLARLGHRVGWISKVGSDEFGKAILSFLKGEGVDVSRVKWMGNTDRHLLKEQRRLNDTRVYYYRKGSAASRLTPADLDEKYIAEAKYLHITGITPALSENCRDTVFAAMAMARRHGVKIVFDPNLRLKLWNEADRAKEVMLRMAAESDVVLPGEAEASFLFGKHSVEEWGSRLLDMGASLVVIKLGANGAHYFTNAHHEYVQGFLLKGYDPVGAGDGFVEGYPDCLKDFVLTEAVQRANAVGALVTMVEGDADGMPERDDVERLINQRRKMLRR

SEQ ID NO: 23350 - protein, 489 aa, Escherichia coli
MVSETKTTEAPGLRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMNWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPAKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 23351 - protein, 150 aa, Mycoplasma genitalium
CNYLTMIDHLKRTKIIATCGPALTKSLVSLKMLDDNEYAAIKKVAYANIEAIIKSGVSVIRLNFSHGTHEEQQVRIKIVRDVANNWNIPVSIMLDTNGPEIRIVETKKEGLKITKDSEVIINTMSKMIASDTSLLSVMLVAKYNMVNDVI

SEQ ID NO: 23352 - protein, 448 aa, Bacillus sp.
MASIQFPKDFVWGTATASYQIEGAYNEDGRGMSIWDTFSRTPGKVVNGDTGDIACDSYHRYEEDIALLKNLGVKAYRFSIAWPRIYPDGDGELNQKGLDYYAKVIDGLLAAGIEPCVTLYHWDLPQALQDKGGWDNRDTIRAFVRYAETAFKAFGGKVKQWITFNETWCVSFLSNYIGAHAPGNTDLQLAVNVAHNCMVAHGEAVKAFRALGISGEIGTTHNLYWFEPYTTKPEDVAAAHRNRAYNNEWFMDPTFKGQYPQFMVDWFKGKGVEVPIQPGDMETIAQPIDFIGVNFYSGGFGRYKEGEGLFDCEEVQVGFDKTFMDWNVYAEGLYKVLSWVHEEYGDVPIYITENGACYEDELTQEGRVHDAKRADYFKKHFIQCHRLIESGVPLKGYFAWSLLDNFEWAEGYVKRFGIVYTDYKTLKRYPKDSYRFIQSVIENDGFEA

SEQ ID NO: 23353 - protein, 282 aa, Pseudomonas putida
MTDTERLLQSRSFVELGARQRARAMLDPGSFRELLGPFDRLMSPWLPRQGIVPQADDGVVIAKGRLNGRNAVVAAIEGGFQGGSMGEVGGAKIAGALELAIEDNRNGIPTCAVLLLETGGVRLQEANLGLAAIAEIQAAIVELRAWQPVIGVIAGSVGCFGGMSIAAGLCSHLLVTREARLGLNGPQVIEQEAGIGEYDAKDRPFIWSLSGGEQRHASGLVDGYVADDIDALRERLLQLLDAPSRDRASQHAWFLDRLARLGDDCPQLDAAAVRALYQGEAQ

SEQ ID NO: 23354 - protein, 357 aa, Chlamydomonas reinhardtii
MAAANQKPGPAGRPEPLIGHPRYEKIKDLNSGTFGFVQLARDKLTGETWAVKFIERGDKITKYVEREIINHRCLVHPHIVQFREVFLTPTHLCIVMEFAPGGDMFEYVVRKNGLREDEARWFFQQLIVGLDYCHRMGVVNRDIKLENTLLDSSPRPLVKICDFGYSKHEKFQSAPGSRVGTPAYLAPEVILTTKGKTYDGKIADIWSCGVMLYVMLVGAYPFERPEDKHDNQKLQKMIQRILHVDYHIPPHVRASEDCKDLLAKILVADPHKRITVDGIYNHKWYLKGLPPGVREMNDRVQPPPEGLQSVEEIKRLIEEARHVGVGAPGYVNPVETDEYIDDAMDNMYDEGSLDYND

SEQ ID NO: 23355 - protein, 511 aa, Triticum aestivum
MDAASLLPFAIALVAIPISLALLDRLRLGRLPPGPRPWPVVGNLRQIKPVRRCFQEWAERYGPIISVWFGSSLTVVVSTSELAKEVLKEHDQQLADRPRNRSTQRFSRNGQDLIWADYGPHYIKVRKLCNLELFTQKRLEALRSIREDEVTAMVESVHRAAAGPGNEGKPLVVRNHLAMVSFNNITRLAFGKRFMNANGDIDEEGQEFKIIVNNGIKIGASLSVAEYIWYLRWLCPLNEELYKTHNERRDRLTKKIIEEHAQALQERGAKQHFVDALFTLREKYDLSDDTVFGLLWDMITAGMDTTVISVEWAMAELVRNPRVQKKLQEELDSVVGRDRVMSETDFPNLPYLMAVVKESLRLHPPTPLMLPHKASASVKVGGYSIPKGANVMVNVWAVARDPKVWSSPLEFRPERFLEESIDIKGSDFRVLPFGAGRRVCPGAQLGINLVASMIGHMLHHFEWSLPEGARPEDISMMESPGLVTFMGTPLQAVATPRLENEELYKRVPVEI

SEQ ID NO: 23356 - protein, 151 aa, Actinobacillus pleuropneumoniae
MFRAAIKEGTELGKQAKALMDEGKLVPDELTVALVKDRIAQPDCANGFLLDGFPRTIPQADALKDSGVKIDLVLEFDVADEVIVERMSGRRVHQPSGRTYHVVYNPPKVEGKDDVTGEDLIIRQDDKPETVLERLAIYHKQTKPLIAYYTA

SEQ ID NO: 23357 - protein, 151 aa, Pasteurella multocida
MLRGAIKAGTDLGKQAKTLMDAGQLVPDDLIISLVKERVAQADCAKGFLLDGFPRTIPQADALKTVGIQIDYVLEFDVPDEVIVERMSGRRVHQASGRTYHVVYNPPKVEGKDDVTGENLIIRADDKPETVLDRLKVYHSTTKPLVDYYQA

SEQ ID NO: 23358 - protein, 151 aa, Haemophilus parainfluenzae
MFRAAIKAGTELGKQAKALMDEGKLVPDELTVALVKDRISQPDCANGFLLDGFPRTIPQADALKDSGVKIDYVLEFDVPDEVIVERMSGRRVHQASGRSYHIVYNPPKVEGKDDVTGEDLIIRADDKPETVLDRLSVYHKQTSPLIDYYQA

SEQ ID NO: 23359 - protein, 151 aa, Haemophilus segnis
MLRSAIKAGTELGKQAKTLMDAGQLVPDDLIISLVKERVAQPDCTKGFLLDGFPRTIPQADALKSAGIAIDYVLEFDVPDEVIVERMSGRRVHQPSGRSYHIVYNPPKVEGKDDVTGEDLIIRADDKPETVLDRLKVYHNTTKPLVDYYQA

SEQ ID NO: 23360 - protein, 151 aa, Haemophilus segnis
MLRSAIKAGTELGKQAKTLMDAGQLVPDDLIISLVKERVAQPDCAKGFLLDGFPRTIPQADALKSAGIAIDYVLEFDVPDEVIVERMSGRRVHQPSGRSYHIVYNPPKVEGKDDVTGEDLIIRADDKPETVLDRLKVYHNTTKPLVDYYQA

SEQ ID NO: 23361 - protein, 151 aa, Haemophilus influenzae
MFRAAIKAGTELGKQAKALMDEGKLVPDELTVALVKDRIAQADCTNGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQA

SEQ ID NO: 23362 - protein, 151 aa, Haemophilus parainfluenzae
MFRAAIKAGTELGKQAKALMDEGKLVPDELTVALVKDRISQPDCANGFLLDGFPRTIPQADALKDSGVKIDYVLEFDVPDEVIVERMSGRRVHQASGRSYHIVYNPPKVEGKDDVTGEDLIIRADDKPETVLDRLAVYHKQTSPLIDYYQA

SEQ ID NO: 23363 - protein, 151 aa, Actinobacillus actinomycetemcomitans
MLRSAIKTGTELGKQAKTLMDAGQLVPDDLIISLVKERVAQPDCAKGFLLDGFPRTIPQADALKSAGIAIDYVLEFDVPDEVIVERMSGRRVHQPSGRSYHIVYNPPKTEGKDDVTGEDLIIRADDKPETVLDRLKVYHTTTKPLVDYYQA

SEQ ID NO: 23364 - protein, 151 aa, Haemophilus haemolyticus
MFRAAIKAGTELGKQAKALMDEGKLVPDELTVALVKDRIAQPDCANGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQA

SEQ ID NO: 23365 - protein, 151 aa, Haemophilus segnis
MLRSAIKAGTELGKQAKTLMDAGQLVPDDLIISLVKERVAQPDCAKGFLLDGFPRTIPQADALKSAGITIDYVLEFDVPDEVIVERMSGRRVHQPSGRSYHIVYNPPKVEGKDDVTGEDLIIRADDKPETVLDRLKVYHNTTKPLVDYYLA

SEQ ID NO: 23366 - protein, 151 aa, Haemophilus parainfluenzae
MFRAAIKAGTELGKQAKALMDEGKLVPDELTVELVKDRISQPDCANGFLLDGFPRTIPQADALKESGVKIDYVLEFDVPDEVIVERMSGRRVHQASGRSYHIVYNPPKVEGKDDVTGEDLIIRADDKPETVLDRLAVYHKQTSPLIDYYQA

SEQ ID NO: 23367 - protein, 151 aa, Haemophilus pittmanii
MFRAAIKAGTELGKQAKALMDEGKLVPDELTVALVKDRISKPDCANGFLLDGFPRTIPQADALKDSGVKIDYVLEFDVPDEVIVERMSGRRVHQASGRSYHIVYNPPKVEGKDDVTGEDLIIRVDDKPETVLDRLAIYHKQTSPLIDYYQA

SEQ ID NO: 23368 - protein, 151 aa, Actinobacillus lignieresii
MFRAAIKEGTELGKQAKALMDEGKLVPDELTVALVKDRIAQPDCANGFLLDGFPRTIPQADALKDSGVKIDLVLEFDVADEVIVERMSGRRVHQPSGRTYHVVYNPPKVEGKDDVSGEDLIIRQDDKPETVLERLAIYHKQTKPLIAYYTA

SEQ ID NO: 23369 - protein, 151 aa, Haemophilus pittmanii
MFRAAIKAGTELGKQAKALMDEGKLVPDELTVALVKDRISKPDCANGFLLDGFPRTIPQADALKDSGVKIDYVLEFDVPDEVIVERMSGRRVHQASGRSYHIVYNPPKVEGKDDVTGEDLIIRADDKPETVLDRLAIYHKQTSPLIDYYQA

SEQ ID NO: 23370 - protein, 151 aa, Haemophilus aphrophilus
MLRSAIKAGTELGKQAKTLMDAGQLVPDDLIISLVKERVAQPDCAKGFLLDGFPRTIPQADALKSAGIAIDYVLEFDVPDEVIVERMSGRRVHQPSGRSYHVIYNPPKVEGKDDVTGEDLIIRADDKPETVLDRLKVYHSTTKPLVDYYQA

SEQ ID NO: 23371 - protein, 151 aa, Haemophilus aphrophilus
MLRSAIKAGTELGKQAKTLMDAGQLVPDDLIISLVKERVAQPDCAKGFLLDGFPRTIPQADALKSAGIAIDYVLEFDVPDEVIVERISGRRVHQPSGRSYHVIYNPPKVEGKDDVTGEDLIIRADDKPETVLDRLKVYHSTTKPLVDYYQA

SEQ ID NO: 23372 - protein, 131 aa, Haemophilus haemolyticus
DFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNN

SEQ ID NO: 23373 - protein, 131 aa, Haemophilus haemolyticus
DFCQRIISGEWKGYTGKAITDVVNIGIGGSDLGPYMVTEALRPYKNHLNMHFVSNVDGTHIAETLKKINPETTLFLVASKTFTTQETMTNAQSARDWLLKAAKDESAVAKHFAALSTNAKDVEKFGIDTNN

SEQ ID NO: 23374 - protein, 131 aa, Haemophilus parainfluenzae
AFCYRVISGEWKGYTGKAITDVVNIGIGGSDLGPYMVTEALRPYKNHLNMHFVSNVDGTHIAETLKKVNPETTLFLVASKTFTTQETMTNANSARDWLLAAAKDNSAVAKHFAALSTNGKAVAEFGIDTNN

SEQ ID NO: 23375 - protein, 131 aa, Haemophilus parainfluenzae
AFCDRVISGEWKGYTGKAITDVVNIGIGGSDLGPYMVTEALRPYKNHLNMHFVSNVDGTHIAETLKKVNPETTLFLVASKTFTTQETMTNANSARDWLLAAAKDSSAVAKHFAALSTNGKAVAEFGIDTNN

SEQ ID NO: 23376 - protein, 131 aa, Haemophilus parainfluenzae
AFCERVISGEWKGYTGKAITDVVNIGIGGSDLGPYMVTEALRPYKNHLNMHFVSNVDGTHIAETLKKVNPENTLFLVASKTFTTQETMTNANSARDWLLAAAKDNSAVAKHFAALSTNGKAVAEFGIDTNN

SEQ ID NO: 23377 - protein, 131 aa, Haemophilus parainfluenzae
AFCDRVISGEWKGYTGKAITDVVNIGIGGSDLGPYMVTEALRPYKNHLNMHFVSNVDGTHIAETLKKVNPETTLFLVASKTFTTQETMTNANSARDWLLAAAKDNSAVAKHFAALSTNGKAVAEFGIDTNN

SEQ ID NO: 23378 - protein, 131 aa, Haemophilus pittmanii
AFCERVISGEWKGYTGKAIRDVINIGIGGSDLGPYMVTEALRPYKNHLNMHFVSNVDGTHIAETLKKVDPETTLVLVASKTFTTQETMTNALTARDWLLAAAKDQAAVAKHFAALSTNAKAVAEFGIDTDN

SEQ ID NO: 23379 - protein, 131 aa, Haemophilus parahaemolyticus
DFCERVISGEWKGYTGKVITDVINIGIGGSDLGPYMVTEALRPYKNHLTMHFVSNVDGTHIAETLKKVNPETTLVLVASKTFTTQETMTNAHSARDWLLAAAKDESAVAKHFAALSTNAKEVEKFGIDTNN

SEQ ID NO: 23380 - protein, 131 aa, Haemophilus parahaemolyticus
DFCERVISGKWKGYTGKAITDVINIGIGGSDLGPYMVTEALRPYKNHLTMHFVSNVDGTHIAETLKKVNPETTLVLVASKTFTTQETMTNAHTARDWLLAAAKDESAVAKHFAALSTNAKEVEKFGIDTNN

SEQ ID NO: 23381 - protein, 131 aa, Haemophilus paraphrohaemolyticus
DFCERVISGEWKGYTGKAITDVINIGIGGSDLGPYMVTEALRPYKNHLTMHFVSNVDGTHIAETLKKVNPETTLVLVASKTFTTQETMTNAHTARDWLLAAAIDESAVAKHFAALSTNAKEVEKFGIDTNN

SEQ ID NO: 23382 - protein, 131 aa, Haemophilus paraphrohaemolyticus
DFCERVISGEWKGYTGKAITDVINIGIGGSDLGPYMVTEALRPYKNHLTMHFVSNVDGTHIAETLKKVNPEATLVLVASKTFTTQETMTNAHTARDWLLNAAKDESAVAKHFAALSTNAKEVEKFGIDTNN

SEQ ID NO: 23383 - protein, 131 aa, Actinobacillus lignieresii
DFCERVISGSWKGYTGKAITDVINIGIGGSDLGPYMVTEALRPYKNHLNMHFVSNVDGTHIAEVLKKVNPETTLVLVASKTFTTQETMTNALTAREWLLAAAKDESAVAKHFAALSTNATEVAKFGIDTAN

SEQ ID NO: 23384 - protein, 131 aa, Actinobacillus pleuropneumoniae
DFCERVISGGWKGYTGKAITDVINIGIGGSDLGPYMVTEALRPYKNHLNMHFVSNVDGTHIAEVLKKVNPETTLVLVASKTFTTQETMTNALTAREWLLAAAKDESAVAKHFAALSTNATEVAKFGIDTAN

SEQ ID NO: 23385 - protein, 131 aa, Haemophilus aphrophilus
TFCARVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVAEFGIDTDN

SEQ ID NO: 23386 - protein, 131 aa, Haemophilus aphrophilus
TFCARVISGEWKGYTGKAITDVINIGIGGSDLGPYMVTEALRPYKNHLTMHFVSNVDGTHIAETLKKVNPETTLILVASKTFTTQETITNALSARNWFLAAAKDPAHVAKHFAALSTNAKAVAEFGIDTDN

SEQ ID NO: 23387 - protein, 131 aa, Haemophilus paraphrophilus
TFCARVISGEWKGYTGKAITDVINIGIGGSDLGPYMVTEALRPYKNHLTMHFVSNVDGTHIAETLKKVNPETTLVLVASKTFTTQETMTNALSARDWFLAAAKDPAHVAKHFAALSTNAKAVAEFGIDTDN

SEQ ID NO: 23388 - protein, 131 aa, Haemophilus segnis
SFCERVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVAEFGIDTNN

SEQ ID NO: 23389 - protein, 131 aa, Actinobacillus actinomycetemcomitans
SFCERVISGEWKGYTGKAITDVINIGIGGSDLGPYMVTEALRPYKNHLTMHFVSNVDGTHIAETLKKVNPETTLVLVASKTFTTQETMTNANSARDWFLATAKDEKHVAKHFAALSTNAKEVEKFGIDTDN

SEQ ID NO: 23390 - protein, 131 aa, Pasteurella multocida
DFCHRVISGEWKGYTGKAITDVVNIGIGGSDLGPYMVTEALRPYKNHLNLHFVSNVDGTHIAETLKKVNPETTLFLVASKTFTTQETMTNAHSARNWFLTTAKDESHVAKHFAALSTNSKAVAEFGIDTNN

SEQ ID NO: 23391 - protein, 504 aa, Physcomitrella patens
MGASRSVRLAFFLVVLVVLAALAEASPRRIALKKKPVTLQSVRNAASRTIQRAKTFTRSEDELRDGEDIVALNNYLDAQYFGEIGIGSPPQPFAVIFDTGSSNLWVPSAKCYLSLACYFHHRYKSGKSSTYKEDGTSFAIQYGTGSMEGFLSQDDVTLGDLTVKGQVFAEATKEPGLTFVVAKFDGILGLGFKEISVNRVTPPWYNMLDQGLVKEPVFSFWLNRNPDESSGGELVLGGVDPKHFKGEHVYTPVTRKGYWQFDLGDVTINGRTTGFCANGCTAIADSGTSLLAGPSGIVAEINQAIGATGVVSQQCKMVVQQYGDQIVEMLLAQMNPGKVCTTLGLCNFGAGEPGIASVVEKDQSHSLREDPLCTVCGMAVVWAQNQLSQNRTKEQIDAYLNQLCERLPSPNGESAVDCNSLSSMPNVAFTISNKTFELKPEEYILKIGEGAEAQCISGFLGLDVPPPAGPLWILGDVFMGVYHTVFDFGNTRLGFAEAAKGEFV

SEQ ID NO: 23392 - protein, 390 aa, Brassica napus
DPSRDLAGVEDVERRCEVGPSGKLSLFTDLLGDPISRIRHSPSFLMLVAETGTEEKEIVGMIRGCIKTVTCGKKLDLNHKSQNDTVKPLYTKLAYVLGLRVSPSHRRQGIGFKLVKMMEAWFMQNGAEYSYIATENENQASVNLFTGKCGYSEFRKPSILVNPVYAHKVNVSRRVTVIKLDPVDAESLYRLRFSTTEFFPRDIDSVLNNNLSLGTFVAVPRGSCYGSGSGSWPGSSKFLEYPPESWAVLSVWNCKDSFRLEVRGASLWRRVVAKTTRVVDKTLPFLKLPSIPSVFKPFGLHFMYGIGGEGPRAAKMVKSLCGHAHNLAKRGGCGVLATEVAGEEPLQRGIPHWKVLSCQEDLWCIKRLGDDYIDGALGDWTKSPPGASIF

SEQ ID NO: 23393 - protein, 259 aa, Helianthus annuus
ANYRGDKQYGRETRHTGDYENPIHSTGGQYEQEVLQTDEYGNPVRRTGQTDEYGNPVRRTDEYGNPAHSTTGGTMGDYGSTGLGQGTGTGGIGTGGYGTTGHHGLGTGVGHTTGGTGTDYTSGGRSTGQTGYQGLGTESEFGGKTGTFQNQPSATPVGGVGLSSGTGAGVGGTGTGTGILHRSGSSSSSSSEDGGQGGRRKKKGVMQKIKEKLPGGHRQEEQYQSQTTTTTTGGGAGYGETHEKKGMMEKIKEKLPGHH

SEQ ID NO: 23394 - protein, 259 aa, Helianthus annuus
ANYRGDKQYGRETRHTGDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESEFGGRTGTFQNQPSATPVGGVGLSSGTGAGVGGTGTGTGILHRSGSSSSSSSEDDGQGGRRKKKGVMQKIKEKLPGGHRQEEQYQSQTTTTTTGGGAGYGETHEKKGMMEKIKEKLPGHH

SEQ ID NO: 23395 - protein, 394 aa, Fusobacterium nucleatum subsp. polymorphum
MAKRDYYEVLGVDKNASENDIKKAYRKAAMKYHPDKFANATDAEKKDAEEKFKEINEAYQVLSDNEKKQQYDQFGHAAFEQGGAGFGGGFNAGGFDFGDIFGDNIFGGGGGFGGFEGFSGFGGSSRRSYVEPGNDLRYNLEITLEEAAKGVEKTIKYKRTGKCEHCHGTGAEDDKMKTCPTCNGQGTIKTQQRTILGVMQSQSVCPDCHGTGKVPEKKCKHCRGTGTAKETVEKKINVPAGIDDGQKLKYAGLGEASQSGGPNGDLYIVIRIKPHDIFIRQGDNLYCEVPISYSTAVLGGEVEVPTLNGKKTVKVPEGTESGKLLKVSGEGIKSLKGYGKGDIIVKFTIETPKKLTDKQKELLQKFEESLNDKNYEQKTSFMKRLKKIFKDIID

SEQ ID NO: 23396 - protein, 455 aa, Caldicellulosiruptor saccharolyticus
MDMSFPKGFLWGAATASYQIEGAWNEDGKGESIWDRFTHQKRNILYGHNGDVACDHYHRFEEDVSLMKELGLKAYRFSIAWTRIFPDGFGTVNQKGLEFYDRLINKLVENGIEPVVTLYHWDLPQKLQDIGGWANPEIVNYYFDYAMLVINRYKDKVKKWITFNEPYCIAFLGYFHGIHAPGIKDFKVAMDVVHSLMLSHFKVVKAVKENNIDVEVGITLNLTPVYLQTERLGYKVSEIEREMVSLSSQLDNQLFLDPVLKGSYPQKLLDYLVQKDLLDSQKALSMQQEVKENFIFPDFLGINYYTRAVRLYDENSSWIFPIRWEHPAGEYTEMGWEVFPQGLFDLLIWIKESYPQIPIYITENGAAYNDIVTEDGKVHDSKRIEYLKQHFEAARKAIENGVDLRGYFVWSLMDNFEWAMGYTKRFGIIYVDYETQKRIKKDSFYFYQQYIKENS

SEQ ID NO: 23397 - protein, 151 aa, Triticum aestivum
MAGRDRDPLVVGRVVGDVLDPFIRTTNLRVTFGNRTVSNGCELKPSMVAQQPRVEVGGNEMRTFYTLVMVDPDAPSPSDPNLREYLHWLVTDIPGTTGASFGQEVMCYESPRPTMGIHRFVLVLFLQLGRQTVYAPGWRQNFNTRDFAELY

SEQ ID NO: 23398 - protein, 498 aa, Asparagus officinalis
MPLILVILLLLPILLLVIRREKSTSSKLPPCPPKLPLIGNLHQLGSLPHQSLHALSVKYGPLMLLKLGEIPTLIVSSSDMAREIMRTHDHIFASRPSLLTSDILLNGATDVVFAPYGEHWRQMRKLCVNHLLSAKMVQSFRLMREEEVSSMLTRISGLVNMSEVLNLFTSKILFNAISGKFFVEEEGRINVFCKLIRENIAILAQLSVSDFFPSLGWLDLVFGVGARARATAKKWDDVLDEVIEDHVKRSNETGDADDQEERADFVSVLMALQEDDNTGFTLNRNIIKAILQDMIAAGTETSFLVLDWGMTELVRNPGTMKKLKDEVRSVAGSETVVREEDISKMFYLKAVIKEILRLHPPVPLLIPRESMDHCNVQQYEVPSKTRVLINAWSMGRDPKVWEDPEEFRPERFLDSDIDFRGQCFEFVPFGAGRRICPGMHFAAANLELALANLMYRFDWELPDGMKSEDLDMGDSPGLTTRRRQNLHLVARPFQRVKR

SEQ ID NO: 23399 - protein, 368 aa, Pisum sativum
MNLNTDAALTTSDPIPLLTPYKMGNFNLSHRVVLAPLTRMRSYNNVPQPIAINYYAQRASQGGFLIAEATGVSDTAQGYPNTPGVWTKDQVEAWKPIVDAVHAKGSVFFCQIWHAGRVSNSIYQPNGQAPISSTDKSLTSNEEQQFTAPRRLRTDEIPDIVNDFKIAARNAIEAGFDGVEIHGAHGYLVDQFMKDKVNDRTDEYGGSLENRCRFALQVVEAVANEIGADKLGIRLSPFAEYAESGDSNPNALGLYMVNALNKYNILYCHMVEPRLIHTFDPVETPHSLEPMRKAFNGTFMVAGGYNRQDGINAIAENRADLVVYGRLFLANPDLPKRFALDAPLNKYHRETFYSSDPVLGYTDYPFLE

SEQ ID NO: 23400 - protein, 368 aa, Pisum sativum
MGIKKVEMSAADPIPLVTPYKMGNFNLSHRVVLAPLTRTRSYNNVPQPHAILYYSQRASQGGLLITEATGVSDTAQGYPNTPGIWTKEQVEAWKPIVDAVHAKGGVIICQIWHVGRVSNSCYQPNGQTPISSSDKSLTSSHAQQFTPPRRLSTDEIPDIVNDFRLAARNAIEAGFDGIEIHGAHGYLIEQFMKDEVNDRTDEYGGSIENRCRFALEVVEAAVNEIGADKVGIRLSPFAEHSECGDSSPKELGLYMVNALNKYNLLYCHMVEPRIKSAFEVVDNSPHSLVPMRKAFNGTFIVAGGYDRQDGINAVAENKTDLVVYGRLFLANPDLPKRFALDAPLNKYNRETFYTSDPVLGYTDYPFLD

SEQ ID NO: 23401 - protein, 362 aa, Pisum sativum
MGATTTDSVPLLTPYNMGKFKLSHRVVMAPLTRTRSYNNVPQPHAILYYSQRASQGGLLIAEATGVSDTAQGLPDTPGIWTKQQVEAWKPIVDAVHAKGAIFFCQIWHVGRVSNSSYQPNGQAPISSTDKAITSNDQQQFTAPRRLRTDEIPNIVNDFKLAARNAIEAGFDGVEIHGAHGYLLDQFMKDKVNDRTDEYGGSLENRCRFPLEVVEAVVNEIGAERVGIRLSPFAEFAESGDSNPNALGLYMANALNKYNILYCHMVEPRIIDTFDPVETPHSLEPMRKAFNGTFMVAGGYNRQDGIKAIAENRADLVVYGRWFISNPDLPKRFALNAPLNKYNRETFYSSEPVIGYTDYPFLE

SEQ ID NO: 23402 - protein, 362 aa, Pisum sativum
MGATTTDSVPLVTPYNMGKFKLSHRVVMAPLTRTRSYNNVPQPHAILYYSQRASQGGLLIAEATGVSDTAQGYPDTPGIWTKQQVEAWKPIVDAVHAKGSIFFCQIWHVGRVSNSIYQPNGQAPISSTDKSITSNDQQQFTAPRRLRTDEIPDIVNHFKLAARNAIEAGFDGVEIHGAHGYLLDQFMKDKVNDRTDEYGGSLENRCRFTLEVVEAVVNEIGAERVGIRLSPFAEFAESGDSNPNALGLYMVNALNKYNILYCHMVEPRLIQTFDPVETPHSLEPMRKAFNGTFMVAGGYNRQDGINAIDENRADLVVYGRLFISNPDLPKRFALNAPLNKYNRETFYSSDPVLGYTDYPFLE

SEQ ID NO: 23403 - protein, 375 aa, Lithospermum erythrorhizon
MGNTEKHEETPKMPLLSPYKMAKFQLSHRIVLAPLTRQRSFGNVPQKHAILYYSQRTTRGGLLIAEATGVSDTAQGYPNTPGIWTKEQVEAWKPIVEAVHAKGGIFFCQIWHVGRVSHQNSQPNGQAPFSSTDKPLTSQIRSNGIDVAEFTPPRRLRTDEIPEIINDFRLAARNAIEAGFDGVEIHGAHGYLVDQFLKDQINDRTDQYGGSLENRCRFALELVEAVATEIGADRVGIRLSPYANYMESGDSNPTALGLYMAGALNKYGILYCHMVEPRMKTVGEKTESPYSLMPMRKAFKGTFLVAGGYGKDDGNQAITEGRADLVVYGRIFLANPDLPKRFELDAPLNKYNRETFYIPDPVVGYTDYPFLEDTA

SEQ ID NO: 23404 - protein, 399 aa, Candida tropicalis
MMNIDQHHQQLQQQSQAQAQAQAQAQAQAQAQAQAQAQAQAAAAAVAASSQRQVSFNVSDHYQILEIVGEGAYGIVCSAIHKPSNQKVAIKKIEPFERSMLCLRTLRELKLLKHFNHENIISILAIQRPLNFESFNEIYLIQELMETDLHRVIRTQNLTDDHIQYFIYQTLRALKAMHSANVLHRDLKPSNLLLNSNCDLKVCDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFQELFSNKPGINPLALDLLEKLLIFNPAKRITVEDALKHPYLQLYHDPNDEPISDKIPEDFFDFDKKKDSLTIEDLKKMLYEEIMKPL

SEQ ID NO: 23405 - protein, 108 aa, Mycoplasma genitalium
KPTKPFVVVLGGAKVSDKLKVVENLLKLADNILIGGGMVNTFLKAKGKATANSLVEKELIDVAKQILDKDTHNKIVLAIDQVMGSEFKDQTGITLDVSDKIQEQYQSY

SEQ ID NO: 23406 - protein, 101 aa, Mycoplasma genitalium
LDVGSKTIALFESYLKTAKTIFWNGPLGVFEFTNFAKGTSKIGEIIAKNKTAFSVIGGGDSAAAVKQMQLSDQFSFISTGGGASLALIGGEELVGISDIQK

SEQ ID NO: 23407 - protein, 376 aa, Actinoplanes teichomyceticus
MSTGIAVAAVAATAGSASASPALAAAPPATVAAGYAHTCAIRTGGTLWCWGSNANGQLGDGTKTSRTTAVRVGDATTWAGVDAGTSHNCAVRTDGTLWCWGSNSRGQLGDGSTTDRTAPVRVGTATNWTTVSAGDRHTCAVRTDGTLWCWGFNRLGQLGDGAQVYVATTPLQVGTASTWASVTTGFAHTCGTRTDGTLWCWGDSSAGQLGLGILSYRTTPGQVGTATNWATVTAGYTFTCATRTDGTLWCFGENGYGQLGVTGTYQASPVQVGSVATWTGVAAGFDTACASRADGSLWCWGNNAAGQIGDGTTTHRYAPTRVGTATTWTAALAAGYHNCGFRTDDSLWCWGSNANGELGDGTTTARPAPQQVSLPA

SEQ ID NO: 23408 - protein, 372 aa, Ipomoea nil
MPTKVSDTCRPHHPIVSQILDLYSIKELPESHAWSSDDHTGSNSINFESIPVIDLDNYNHDNNFNILDTIGHACKKWGAFQLINHNISEKLLEDIEIAGRRLFSLPMQQKLKAARSPDGVSGYGLARISSFFDKLMWSEGFTIVGSPLEHSRLLWPQDFNSFCEVVEEYEKEMKKLAGRMMKLILESLGVAEEDAKWGVESKGRCSALQLNSYPACPDPGRAMGLAEHTDSTVLTILHQNNTSGLQVFREGAAGGWVTVPPIPGALVINAGDLLHILSNGLYHSVLHRAVVNRSSHRLSVAYLYGPPPGIKISPLPKLVAEGQPPLFRAITWSEYLRTKAKHFDKALSSVRLICAPRNPFSDTNDHNRVRVG

SEQ ID NO: 23409 - protein, 367 aa, Ipomoea nil
MNQEIDNIIPMDFNKADQLPDSHTWLDDHSPVNSSSTHESVPLIDLYDPQAVDKIKMACETWGIFQVTNHGVPWSLLAQIEHQARRFFELAPEQKLRAVRSPGSLAGYGTVRISKFFDSQMWSEGFTVAGSPLEHARQVWPQDYSDFCSVIDDYQEKMRGLAEKIAALMFKSLGLSPGEDVEWFEPNGLSNSTQAYLQMNWYPKCPDPTRAMGLAQHTDTSLVTLLYQTSNIRGLQVYGPNLNWVDVKPISDAIVVNLGDLMQIISNGRFKSVLHRAIVSEAHNRISVGYFFGSSKNVEISPSLKLIKGSEFPMYKPISWNEYLDIKNKYFNKSLEMIGFNSDVEKSNALASGDEAPLGSEVEAIKV

SEQ ID NO: 23410 - protein, 434 aa, Cattleya bicolor
MSKVFGIEAPLSKIALSKAHGEDSPYFAGWKAYEENPYDAMNNPNGVIQMGLAENQLSFDLLEEYLEQHPDAFGWGSDLSGFRENALFQDYHGLQTFRKAMASFMEKIRGGRSKFDPNRIILTAGATAANELLTFILANPGDAILVPTPYYPGFLRDLQWRTGVTIFPVHCDSSNGFQLTLSSLEKAYADAKASNFKVKGLLITNPCNPLGTTASFSLLQDIILFISDKNIHLISDEIYSGSVFSSTNLFSISDLITDAVSEQIHIVYSLSKDLGLPGFRVGALYSYNDRVVKTARRMSSFSLVSSQTQKLLAFMLSDEEFTVRYIEKNRERLTERYELVVEGLKEARIECLKGEAGLFCWVNMEELMEEKTMEEELKLWKVIVEELKLNITPGSSCCCSEPGWFRVCFANMSRETLEVALRRLKDFAQKKDCR

SEQ ID NO: 23411 - protein, 249 aa, Rubus idaeus
YILSSWKSDADCCTDWYCVECDPTTHRINSLTIFTDNNLTGQIPAQVGDLPYLETLELRKLPHLTGPIQPSIAKLKHLKMLRLSWNGLSGSVPDFISQLKNLTFLELNFNKFTGSIPSSLSQLPNLGALHLDRNQLTGQIPSSFGKFVGTVPALFLSHNQLTGKIPTSFANMNFDQIDLSRNKLEGDASVIFGLNKTTQIVDLSRNMLEFDLSKVVFSTSLRAVDLNHNSITGSIPAQLTQLDDLVLFN

SEQ ID NO: 23412 - protein, 355 aa, Corchorus capsularis
MGSLETERKIVGWAATDSTGHLAPYTYSLRDTGPEDVDIKVISCGVCHTDIHQIKKDLGMSHYPMVPGHEVVGEVVEVGSDVTKFNVGDVVGVGVIVGCKNCHPCKSEIEQYCNKKIWSYSDVYTDGKPTQGGFAASMVVDQKFVVKIPDGMAAEQVAPLLCAGVTVYSPLKHFGLMESGLRGGILGLGGVGHMGVKIAKAMGHVTVISSSDKKREEAMEHLGADEYLVSSDVESMQKAADQLDYIIDTVPVVHPLEPYLSLLKLDGKLILMGVINAPLQFVSPMVMLGRKSITGSFIGSMKETEEMLEFCKEKGLASMIEVIKMDYINTAFERLEKNDVRYRFVVDVAGSKLIP

SEQ ID NO: 23413 - protein, 392 aa, Aspergillus nidulans FGSC A4
MSAVLFHGDTGRFLLMLALGTSLVNFFSTPFMRLLAPAPAAPYISVSRPRSVESRPLRRPKSTELQSHFGDSGEAGMHTSTTIFSQSAIHSRNHSTASHSQPNGNGPDFDELSSLVSKTPSRTSQESFYERNAEVDDDGFSDVTPDSRQPDIRGLAMLRKIEFWQLFLTMALLSGIGLMTINNIGNSAKSLWEHYDDSASPKFIQERQVMHVSILSFGNFAGRLSSGSHSLGIGSDILVKKFNMSRFWCLFMSSAVFTLTQLAGASIWNPNQLAIVSAFTGIAYGFLFGVFPSLTAHTFGINGLSQNFGVMTMAPVLSGNIFNLFYGMVYDHHSIVDRNGDRDCPDGLSCYQSAYYMTFFSGVGGIIVCLWSIWRDGRRTRTHAKLEHDRLA

SEQ ID NO: 23414 - protein, 447 aa, Aspergillus nidulans FGSC A4
MPHSVLYTKIDTRPPEVIHSRGNYLHTSDGRTIFDASGGAAVACLGHNEPQVKQAIMAQLDKVAYIYSPFFTVPAAEEIATFLTESTGGAMSKVFIVSSGTEAIEAALKMTRQYFTELSKPQLQRTKFIARRQSYHGNTLGSLAAGGHKARRAIFEPILAASTSHVSPCYPYREMKKGESNEEYVSRLAEELENEFQRVGPDTVCAFIAETMSGTTLGCIPAVPGYLKAMKQVCDRHGALFVLDEVMSGMGRTGTLHAWQQEGVVPDLQTVAKGLGAGYAPVGALLVGNRVADVLSKGTGSFTHSQTYQGHPIACAAACAVQKIIQKENLLDNVRRQGEYLGRLLNERLGGHRNVGDVRGRGLFWALEFVRDKETKEPFPAEAGIAQKVHLTGLQKEHSISVIPGAGVADGRNGDIIQIAPAYNVSKEDIELIVERVEGVVHAAFGA

SEQ ID NO: 23415 - protein, 357 aa, Aspergillus nidulans FGSC A4
MPAQHRPLWWYGWNALRGGNPTFLTPDQVPVPDLSGKWIIITGSNSGIGLEAAKAFASAGANLILGCREPAAWETHPAAAAEECQTLARVNGHTESVIEWWKIDMADLSAVDAFAQRWLDTGRALDILCNNAGMGPTGSRKPILTKDGLEILHQVNFTSHVLLTLRVLDSLAKAPQPRIVCTTSCFHFRGYFDLDHFNGELGMAGDPYPNNKLYFQVWLTELHSRLLASPNYRHVTVNGINPGYVNSGIWNNPLSETKNTWIDTAYKFWKFVASILAISPQQGSLAIVYAATSAEFGPDPVTQGVGEIGGKGGGHYINRIWEGEAMPHCSDEECRKEVWEKVGKELGLEERGLGHWV

SEQ ID NO: 23416 - protein, 334 aa, Aspergillus nidulans FGSC A4
MPKVLLTGGSGFIAAHILDQLLERGFDVVTTVRSKEKGEKILAAHPNTPKEKLSYVIVKDVAQDGAFDEAVKSDPPFDYVLHTASPFHYNVQDPVRDFLDPAIKGTTGILKAIKAYAPNVKRVTITSSFAAIVNVKNHAKVYSEEVWNPITWEEGLDSSQTYRASKTLAEKAAWDFVEKEKPSFDLATINPPLVLGPVVHYLSSLDSINTSNARISSFVRGFSKDALPPTGTYVWVDVRDVALAHVRTIEVPEAGGQRFFITAGHYSNKDIVDIIRDAYPELEDRLPPKDAPSDMPKDVYGYDNSKSMQVLGLKYRGLKESVVDTVKSLLENGA

SEQ ID NO: 23417 - protein, 369 aa, Aspergillus nidulans FGSC A4
MANVHHISVPSKVLFQKARKLVPPMLEKFHKGQQGRVAVIGGSLDYTGAPYFSAMASARLGCDLSHVICESSAATVIKSYSPNLMVHPILPSSASVKDPSSIDAPSLASPIIAMLGRLHALVIGPGLGRDGVTLKVVTEVMKEARSRSIPFVLDADGLLLVTENPDLVKGYKDCILTPNVNEFSRLAKALNIEVPSLAQISSKESGDKTSKEAEACEKLSQALGGVTIIQKGPHDVISNGVTSIVSDLPGGLKRSGGQGDTLTGSLGTLLAWRAAYHDALWDSGEQEHSKEAENKEEVQGELESNKRMSPSTTLLLAAWAGAAITRECSRRAFKAKGRSMQASDLTDEVHESFLTLIGEPEGSKVPERL

SEQ ID NO: 23418 - protein, 284 aa, Aspergillus nidulans FGSC A4
MATSTKQTYPVLPKNLLLISLKMYFEPSRTLEYCRALLDPKNDIVRPENRSKLLLALIPDFLTIYPCAEIIKEYVSTLPKDDSPSLPAPFLLGAQDCFWEPLGAYTGEVSPLSLSSLGVSIVELAHAERRSIFGETDEQAARKAAAACAQGMVPLVCIGEISAPGPVASAAVGLAVRECEPLVRAILNAIPADAPIIFAYEPVWAIGKPKPASVDHISAVVDGLRALIGRRSGDVRILYGGSAGPGLWGPGGLGKAVDGMFLGRFAHDIEGVRKVVREVEESLT

SEQ ID NO: 23419 - protein, 351 aa, Aspergillus nidulans FGSC A4
MATPQLQTAAVLPSTGATLTSRLEIRHDRPIPSPAAGELLVKLEFSGVCHSDVHSVRGETPMLTDVAGHEGVGKVVKVGDGVDEGAWMGRRVGIRWLYSSCLECEICERNNTACPNQKNAGANVPGTFQQYIVSPAMHVTKIPPQLSPDEAAPLLCAGIAMYSSIMKTKTRPGDWIVFPGAGGGLGHMGVQIAVKKGLRVIAIDSGEKKQKLCLSLGATAFLDYKTDDVESAVKQLTSGLGAHAVICTANGEAAYEQSMRLLRRLGVLVCVGIPNLPFRLPATPFDMIVKGLTIVGNSAGTAEEMEELMEMAVAGDLKAHIECFEFDQIDDVIQRLGRSEIEGRAVMRIPE

SEQ ID NO: 23420 - protein, 454 aa, Aspergillus nidulans FGSC A4
MLRVGFDASTNEIPDPVARDRRRRKRDQTVAQLIDNEETLYFCNLTVGTPGQSLRLILDTGSSDLWCNAANSTLCSSPKDPCRISGSFDPSSSSSYSYISSDFNITYADGTGAAGDYATDTVSIGGATIKDFQFGIGYTSSSAEGVLGIGYPSNEVQVARYGDDAYPNLPRFLMQNGFVQSSAYSLWLNDLEANTGSILFGGVDTEKYRGDLQTLPIQTVNGEYSELIIALTGVSLDTEARKHTVSSNALPAAVLLDSGSSLSYLPDSIAEKIYDDLRISYEPSTGAGYAPCSLARQNINVTFTFSSPEIAVGIDELIIDAGDLRFSNGERACIFGLVPAGDNTAVLGDTFLRSAYVVYDLTNNEISIAKTNFNSTKSNILEIGTGSDAVPGATKVSHPVTSVVADGSGSRIGAPTNTEDIVPSASTGAAVVLGRSTISPVLVGAAALGYMFAF

SEQ ID NO: 23421 - protein, 352 aa, Aspergillus nidulans FGSC A4
MDIALELFDTFVGDRLYSALLPASLSSTVSVPGFPTAANSTLSLFGASKPFVYEPATKLLYLEPSKYAYLSAWPRNNIYRQFLSFFLIVWIFGFIVYFISATLSYMFIWDKSTVKHPKFLKNQIPLEIAQTMRSMPIMSLLTAPFLVAEVRGYAKLYDTFDEEPFPYYSILQFPLFIAFTDFFIYWIHRGLHHPLVYKTLHKPHHKWIMPSPFASHAFHPVDGWSQSVPYHVFPFIFPLQKAAYVLLFGFINIWTVMIHDGEYVANSPVINGAACHTMHHLYFNYNYGQFTTLWDRMGGSYRKPNEELFRRETKMGEEEWKRQTKEMETILKDVEGDDDRKYLAEEDSKKNL

SEQ ID NO: 23422 - protein, 1789 aa, Aspergillus nidulans FGSC A4
MPTSDKSRQTSAGKSFFGRKLHKERPVEDRWDAHGSWESLAPPSSAAGSRSSRYSKRSSIQSVDFGADIDPSLLSTSAGPITSIPFESLSTDTQSPIPVDYLSKAETSPRKEPSPGHLAKGVGDFHQYPAWDPSAMRNHQQFSHPTGPRPPPHAAGVAMSSSATGDKGARYQQWGRPGSSAGNAGLSHHSSSTVDSSTNSRMSIDQASIHSSLSSNTRGSSYISTDGSSRTTLPSHSNDRSNYYAAMNSGRGSSAQGAIPPAQPRVQNTEQYLTRPRDDRVVDQLFLELMQKRGWQNLPEQARRQMMAYPASKKWTLVHQDRLTELQGEQKRKQKARETHGYDGPSGILERADEEGSPEWYVKKVMDDTITSKQLASLSVSLRTQPISWVKAFVEAQGQIALTNVLVKINRKKVTGPVPAPPSGDKDLDREYDIVKCLKALMNNKYGADDALAHQQIIVALISSLLSPRLNTRKLVSEVLTFLCHWAEGQGHERVLQAMDHVKNHQGETGRFDAWMRIVEVTIDGRGKMGSLVGASEEYRSGGIGMENLLMEYAVSTMILINMLVDAPENDLQLRCHIRAQFISCGIKRLLSKMEGFQYEVIDKQIEHFRENEAIDYEDLLQRESSSTKDSIEGEVKDMTDPLQITDAIASRLNGTRAHDYFLSALQHLLLIRENSGEDGLRMYQLVDAMLSYVAMDRRLPDLDLRQGLTFTQSLLDRLHTDAEARRAYDESLEARQIAEAALAERDEMKAQVELGADGLVRKLQKQIEEQTGIIELQSRQNEMLKAELADVQRLRAQELQRNELETRELYLMLRDAQDIAASNAKKSNMGEAETDPAHMRGILDREKLLTRLEKQLERTKTQFKLEGKVWGQHDPSDRLRELREQMDGDAGPREAFEEQARLNLSLNPVGSVYRKKTYIQGMEDTATEELGQTDDEVVYAKARLVDLHRPRMDPEQATGLLGEIAAKVPKIDADDAKDEGKPTESEQPAEGAATKGDEQGVDDTVAVDKATAAPPPPPPPPPAHPGLSGAAPPPPPPPPPPPPGAGAAPPPPPPPPPPPPGGLGGPPPPPPPPPPGGFGGPPPPPPPPGGFGGPPPPPPPPPGGAFGVPPPPPPPGTVIGGWRANYLASQGAPSHAIPVMSSIRPKKKLKALHWDKVDTPQVTVWATHGTTPQEKEEKYVELAKRGVLDEVERLFMAKETRIFGGGVAAKQRKDKKQIISNDLSKNFQIALSKFSQFPAEEVVRRIIHCDAEILDNMVVMEFLQRDEMCTVPENVSKLMAPYSKDWTGPDAANTEREQDPSELTREDQIYLYTAFELNHYWKARMRALALTRSFEPDYEHISAKLREVVRVSESLRDSVSLMNVLGLILDIGNFMNDANKQAQGFKLSSLARLGMVKDDKNETTFADLVERIVRNQYPEWEDFTEQISGVIGLQKLNVDQLRTDAKKYIDNIKNVQASLDAGNLSDPKKFHPQDRVSQITQRSMKDARRKAEQMQLYLEEMVKTYDDIMVFYGEDNTDDGARRDFFAKLAAFLQEWKKSKEKNIALEEARRRTEASLARKRINVGLANGAGAAGDAPVSPATSGAMDSLLEKLRAAAPQAKDQRDRRRRARLKERHQVRVASGQKIPDLEGAEAPGSGGQNSGATDTNATDSSLLSPTIQEPEGGSSPIASQSEDVADRAASMLQDMLRNSPDPERTRRRRESAEEERRKRRLRRRNGATSGSKDSNDTTPLSPVTEPTSTQGESAEPENLSLSSPPNGEDPTLNPPTIVLSSDASDTPDDEHRPSTS

SEQ ID NO: 23423 - protein, 369 aa, Aspergillus nidulans FGSC A4
MAEMLGGFQNIPTPALINVYDQWAKGGWGAVLTGNVQVDVNHLGSPFDPALSGEYIDAETNKDLFEQYRKYAEVSQAHGTPAIVQLSHPGRQSPRGAGRKGLLGSTMAPSAIPLDMGAGFVQRWLSWLVFPPPREMTQGDIETVTRQFVDAARLMADAGFSGIELHGAHGYLIDAYGGSAANRARFVLDIIAQTRAVVPSTFCIGIKFNSADHNSSSFEDTMTQIGLLVDAGIDFIEISGGSYEDPKQAEKSARTVAREAFFLEFAAAVRERYPTLILMLTGGFRSRAGADYALSQNACDLVGIGRPAAIDPHFPKLLLDESVQESEAQLHLNRIPVPFWAKWIPLAAIGAGAESIQRIAKGMKTIVPL

SEQ ID NO: 23424 - protein, 405 aa, Aspergillus nidulans FGSC A4
MWKPSERLMDTIRHYASFPATGVSLRQMVQFGDRPSTGTLFRASQFLSEELPIRLAHRVQDLGELPDGLSEMPSIKKVQDWYAQSFEILAETTQNPSVREGQYRSAMTNGNGNGKAAAAARRYFVPSDDQGNWPPELNDYNERFAKTLQQIKRRHDSVVTTVAQGILEWKRKRQRLQIDSTIQSFLDRFYMSRIGIRMLIGQHIALTEQTHVRHPNYVGIICTKTNVREVALEAIENARFVCEDYYGLFEAPKVQLVCKEDLNFMYVPGHLSHMLFETLKNSLRAVVERHGADKEAFPVTKVIIAEGKEDITIKVSDEGGGIPRSAIPLVWTYMYTTVEQTPNLDPDFDKSDFKAPMAGFGYGLPISRLYARYFGGDLKLISMEGYGTDVYLHLNRLSSSSEPLQ

SEQ ID NO: 23425 - protein, 141 aa, Aspergillus nidulans FGSC A4
MSSITIANLPRISRDALSALILSASTPSKLAIIDVRDSDHVGGHIVSSTWVPSSTLDVRIPELVRTLKDKEKVVFHCALSQQRGPSAALKYARERERMLGSEESHKQEVFVLEGGFVQWQEMYGKDVRLTEAYVEDIWREY

SEQ ID NO: 23426 - protein, 1517 aa, Aspergillus nidulans FGSC A4
MADNAHLTQLPTVTGEEPSDSTMVSGTSSDTDASSEGQWGEQGTEPVSRRGAMEDYEEMRRELTRLSLQRTKSTTKDAHRLRSRASQHQDPEKALQEEDLEKEGESEYGGFDLTDFLMGGHLERRTTAGDPAKKVGVVFKNLTVKGVQTGASFVRTLPDAVIGTFGPDLYNIICRFVPQLRFGKKPPVRDLIHDFTGTVREGEMMLVLGRPGAGCSTFLKAIANDRGAFAAVEGDVSYGGLSAAEQDRHYRGEVNYNQEDDQHFPNLTVWQTLKFSLINKTKKNDKESIPIIIDALLKMFGITHTKNTLVGNEYVRGVSGGERKRVSIAETLATKSSVVCWDNSTRGLDASTALDYAKSLRIMTDVSKRTTLVTLYQAGESIYELMDKVLVIDSGRMLFQGPAHYARQYFVNLGFYCPEQSTTADFLTSLCDPNARQFQEGREASTPKTPEELEAAFRQSEYYKLIQNEVQAYEDQLHDTNCADTQRFQKTVQSSKSKTVSKKSPYTVSIARQVAACVRREFWLLWGDKTSLYTKYFIIISNAFIVSSLFYGEAMNTNGAFPRGGALFFSILFLGWLQLTELMPAVSGRAIVARHKDYAFYRPSAVAIARVVVDFPAILCMCIPFTIVVYFLAGLDATASKFWIYFLFVYTTTFCITSMYRMFAALSPTIDDAVRFSGIALNVLVLFVGYVIPKQGLIDGSIWFGWLFYVNPLSYSYESVLSNEFSDRVMACDPSMLVPQGPGVSPEYQGCALTGSKLGSTDVAGSDYLSTTFQFTRHHLWRNFGVVIAFTVLYLLVTVIATETLSFVGGGDGALVFKRSSNAKQIKAATEKPNDEENGQGDAVTQSGGNNEAAFNRISSSERVFTWDNVEFTVPYGNGTRKLLNGVSGYAKPGLMIALMGASGAGKTTLLNTLAQRQTTGVISGDMFVDGRPLSTDFQRGTGFCEQMDLHDATATIREALEFSALLRQDRNIPREEKIAYVKQIIDLLELEEIQDAIIGSLNVEQKKRVTIGVELAAKPSLLLFLDEPTSGLDSQAAFSIVRFLKKLSQAGQAIVCTIHQPSSMLIQQFDMILALNPGGNTFYFGPVGKDGKDVIKYFADRGAVCPPAKNVAEFILETAAKPIKRDGKTVDWNEEWRTSEQSRQVKEEIERIYKERRDATANEDQSAQYEFAAPTWLQCYLLTRRVFTQYWRDPSYYYGKLFTSVIIGIFNGFTFWMLDNSIASMQNRMFSLFLIILLPPIFLNSTLPKFYMNRALWEAREYPSRIYGWVAFCTANVVAEIPAAIISATVYFLLWYFAVGFPVTASASGYVFLMTMLFFLFMASWGQWICAFAPSFTVISNVLPFFFVMTGLFNGVVRPYDDYPVFWKYWMYYVNPVTWWIRGAISAIFPSVEITCAATEATHFNPPPGSTCSDYASNFVNNIAGAGYLANPDATSDCQYCPYENGTQYMSTLNVRPDDKWHSFGIFLAFVIINWVLVYFFIYTVRVRKWSFGMGSLFGGIGAVLSGIKNVFAKKN

SEQ ID NO: 23427 - protein, 355 aa, Aspergillus nidulans FGSC A4
MYRQSFAPPPAHSPPLHHPVPQHVSTVPMMRSPPPPTSQQPQSSAYGNPYQPDIAQGGSGTYAPGFGGFINDPTAQMGFHMGKTAMAAGQEYMEQNFNRYVSIPALKHYFNVSNSYVINKLGLVLFPWRHKPWSRQQARLTTASTGPDGQISHQQYSSMFLPPRDDINSPDMYIPVMALVTYILLSAMLAGFRGNFHPELLGATTTTAIAVIVFEIICLKLAMYILSINNDSQLVDLVAYSGYKFVGIIVTLVASEILTPGRGTGSWVGWVAFIYTFLANAFFLLRSLKYVLLPDSTSDSSMRTGSMHTVARSQRNRRTQFLFIYSYVIQFIFMWVLSREGPSATASALGNGISS

SEQ ID NO: 23428 - protein, 478 aa, Aspergillus nidulans FGSC A4
MSATEVTSENVAQILQNDTRVKLAGVDADGMLRGKLVSKKKFLSVVDEGFGFCSVIFGWDMHDRTYFRELGISNKENGYRDLLAKPDLSSFRRIPWENNVPFFLVSFYDPDTKEPLFACPRSLLRMALRKPEAQGYRAMAGAEYEFYQFATPNRNASSTASFLKENPVEALPSITDGMFGYSLTRPIHNQDYYYGIFDACEQFNCEIEGWHTESGPGVYEAALQFGEAKGMADKAGLFKYVVKSIGTKHGITPTFMAKPREGLPGNSGHMHISLVNSDDTNAFHRSTPDPSPPYPDVAYLSDLGRCFLAGILTGLPDIMPMFAPTVNSYKRLVENFWAPVTVSWGLEHRAASIRLITPPTASPKATRLEVRVPGADANPHFVLAAIVALGWWGVEKKLEIPVPPLSKGEDMGGESDKGVRLAKNLGAAIATFTRKDSVAREVFGDAFVDHFGGTREHELRLWEEAVTDWEVRRYIETV

SEQ ID NO: 23429 - protein, 439 aa, Aspergillus nidulans FGSC A4
MPPPFPTSHRGMTANPQRPARYRPGKPIAEEPSSEEEEEEEVNEEIQGEQERKRLEQQRQKQAAPKATSFPGTRTVTKDIKDVKVQQEDDDDEEGFVTEEEDEGVAIARDIVAAQVAKPAEKEQEEEEEEEEESEEEESSDEESSSEDEAPRRVLLRPTFIKKDKRTNGATDHQGAAAADSIAEAEARKAQRQEKADALVREQIEKDAIARSSANKAWDDDEAMANEEAAIDDTDGKDPEAEYAAWKLRELKRIKREREAIEAAEKEREEVERRRNLTAEEREREDQEFLAKQKEEREASRGQTGYMQRYFHKGAFFRPDLEKEGLDKRNVMGARFADDVARETLPQYMQIRDMTKLGKKGRTRYKDLRTEDTGRFGEGFGNRRRQEAPVGVTDERFLPDRGFDKKGPTGANASVWTTLVRLKSIGSLACSLLILIYAG

SEQ ID NO: 23430 - protein, 1083 aa, Aspergillus nidulans FGSC A4
MAEIPEPKGLPLIGNIGTIDQEFPLGSMVALAEEHGEIYRLRFPGRTVVVVSTHALVNETCDEKRFRKSVNSALAHVREGVHDGLFTAKMGEVNWEIAHRVLMPAFGPLSIRGMFDEMHDIASQLALKWARYGPDCPIMVTDDFTRLTLDTLALCSMGYRFNSYYSPVLHPFIEAMGDFLTEAGEKPRRPPLPAVFFRNRDQKFQDDIAVLRDTAQGVLQARKEGKSDRNDLLSAMLRGVDSQTGQKMTDESIMDNLITFLIAGHETTSGLLSFVFYQLLKHPETYRTAQQEVDNVVGQGVIEVSHLSKLPYINSVLRETLRLNATIPLFTVEAFEDTLLAGKYPVKAGETIVNLLAKSHLDPEVYGEDALEFKPERMSDELFNARLKQFPSAWKPFGNGMRACIGRPFAWQEALLVMAMLLQNFDFSLADPNYDLKFKQTLTIKPKDMFMKARLRHGLTPTTLERRLAGLAVESATQDKIVTNPADNSVTGTRLTILYGSNSGTCETLARRIAADAPSKGFHVMRFDGLDSGRSALPTDHPVVIVTSSYEGQPPENAKQFVSWLEELEQQNESLQLKGVDFAVFGCFKEWAQTFHRIPKLVDSLLEKLGGSRLTDLGLADVSTDELFSTFETWADDVLWPRLVAQYGADGKTQAHGSSAGHEAASNAAVEVTVSNSRTQALRQDVGQAMVVETRLLTAESEKERRKKHLEIRLPDGVSYTAGDYLAVLPINPPETVRRAMRQFKLSWDAQITIAPSGPTTALPTDGPIAANDIFSTYVELSQPATRKDLRIMADATTDPDVQKILRTYANETYTAEILTKSISVLDILEQHPAIDLPLGTFLLMLPSMRMRQYSISSSPLLTPTTATITISVLDAPSRSRSNGSRHLGVATSYLDSLSVGDHLQVTVRKNPSSGFRLPSEPETTPMICIAAGSGIAPFRAFLQERAVMMEQDKDRKLAPALLFFGCRAPGIDDLYREQLEEWQARGVVDARWAFSRQSDDTKGCRHVDDRILADREDVVKLWRDGARVYVCGSGALAQSVRSAMVTVLRDEMETTGDGSDNGKAEKWFDEQRNVRYVMDVFD

SEQ ID NO: 23431 - protein, 412 aa, Aspergillus nidulans FGSC A4
MLVPVSLLALSLSSVAAAHSSHQTPLTGPLQKLWYNTLPGDGGTQADSVFSGISTFGRLPYFPCLASEEERFDIAFIGAPFDTGTSYRPGARFGPSGIRQGSRRLNLYGGYNVPLQANPFSNDLKVLDCGDIPVTSYASLSPMSIPEDVCADCRRYDNAWAIQQIEEGHNSLLMRKPYTSANEYGLSRAGKTLPRIITLGGDHTITLPLLRSINKAYGPVTVIHFDSHLDTWKPKVFGGSPSEVASINHGTYFYHAAMEGLLRNDTNIHAGIRTTLSGPSDYENDGYVGFEIVEAREIDTIGTEGIIKKIRDRVGNDPSTPIYLSIDIDTIDPAFAPATGTPETGGWSTRELRTLIRGLDGLNLIGADIVEVAPAYDTNAELTTMAAADVLYEVLTIMVKKGPLTVDERSDL

SEQ ID NO: 23432 - protein, 507 aa, Aspergillus nidulans FGSC A4
MYSSIHTTAPGPEYDSPTPTEYTSLLPKPTDDLFPDSLSSRDAEVTDHDSRKAILAEFLLLLKSSVPVILAYALQNSLQTVSVLIVGRISPEHLATSAFSLMFAMITAWMIALGGTTALDTLASSSFTGSDKRNLGILLQRGFFVLGLFYLPVAVLWIFSEKVFLLLGQDADLSKDSAQFLTALIPGGLGYVYFELMKKYLQAQGIMRPGTYVLLLTSPLNAALTYTFCYKLGLDLLGAPLALGISYWLSFALLVLYAILVRGSECWGGWSREALTNLGTFSRLAILGVVHVGTEWWAFEIVALAAGRLGTIPLAAQSVIMTADQVLNTIPFGVGVATSARVGNLLGAKDAKGARRAANVAAWLSMILGLVVLVAFMGTKDHFAKIFNSDPRVVSLTSAVLPFVALFQIADGLNGSCGGSLRGMGRQHVGAAVNIVSYYCGALPLGVYLAFHGWGLKGLWVGQCVALYLVGALEWVIVAASDFDKEVRKAFKRMDEAAYAEEEEGRL

SEQ ID NO: 23433 - protein, 168 aa, Aspergillus nidulans FGSC A4
MASQSRKRVSEVVDHSLVDKPPLSKKSRTNAPDVAGFDNSRPELVARKEDSNGDIYWEISKMRRVTISSFRGKTMVNIREYYEKDGEELPGKKGISLPIDQFSSLVTLLPEIEIVLQEKGLSIPRPKYVGQGTSTGGNDKKDSTDGLPMARPSRENIEATSDEDEDEE

SEQ ID NO: 23434 - protein, 512 aa, Aspergillus nidulans FGSC A4
MTVGPTLGTGLFVGTGQALAAGGPASLIITYVFISAMTYCVTTAVAEISTHSITRNGAMLAHNYHYTSNHVGFAIAYLRWIGLSLLVPFEVTAGMVHLGLWEPSASLALRMGGMMSVIFFFNMLPEKFFRRSQTFFTGIKFLATIGLATISFYLAIRASQPGAVVGGFEYWANPGPFAEFLLLGDLGRFLGFLFCILCSTISFVFLPELTVQVAEDHDSEPGNSIFRRTRNSNLIMFILYMLSTLTTTLMAPYDDLRLNNSFIGAGLSPYMVGLVDSKIRLVPAVGGGLIFLSSVASGRSFLNLASRMLSTMAETGHAPALFMIRNRWNVPYMSVAISAGFTWLCFLCMVISSSEVYNYLMFFITTIGYVSWVCSLVAYLRFRRVVKKSEIMPLHRSFIQPFGTYFALGGTVLLIMLNLSQIMVAPRHGLNPLNGIPAHIALNMFGLLYGGHRLVVAVRKKATRLEPHVVEYRGDEDEDQPQDQVIEMEETQGRRPEDELSTTPTHAVNSRG

SEQ ID NO: 23435 - protein, 1365 aa, Aspergillus nidulans FGSC A4
MGVYLFSSSLWATLLLAILIYRLVRITYNLYFHPLSGIPGPSAWAASRLPFVYALIRGTIIQDFQKLHEQYGPIIRIAPNEVTFAHPEAYTDIFQPRPEKSQGQFLKDPLWWARQPGHPDSLLSVINPERHAQMRRVLSPGFTARALRKQEPFVQKYVNLLVAQLQDLVSKSPSAHINMTPWFNYTTFDIFGDLGFGESFDCLQHSRYHPWIALLFDSVKAAGFVIATRYYPLIEAVLLKCVPPSMRKIQRDHYQQIVDKVQRRLGWELQRPDFMSYVIDERGGLRLDAGELYATFMILTTAGSETTATALTGTLNYLVNHSPESLQRLENEIRGAFSGLDAITLDAVRNLPFLNAVIQEGLRLCPPIPWVLPRLVPQGGSMICGTWLPGGTPVSIQAYTLNRDPTLFNRATSFLPERWLASSTSDSSSCFFNDQRQVVQPFSTGPRACLGQHLAWAEMRLILAKLVWVFDFGAIDGQGVNWEDLRTYLLVERKPINAVADVAHLWPGALEGVQACTVYWYPSSITESHPQKVHRECIDYLPALVLKPCVSFCLPYPIICSTSFTFTPSRKGEQRRGSHTSLGTRGTLSHHLQYQYHYRLYFPPLAKFPGSRIAAATGCHDPDFYNELYVTESKRRTNHYDVFCKGIEFEFDGSHLLTVDHTLHLKRRKPLEPFFSRKSIQKPQPTLAEVTLKFEQPLRASSGTGMVVQLDHACAAFSGDIIAKICLDDVAEGDRFLDHPEFAPYCGTMLADHDRIFSQTHNNSKPVTSLFPHVAQSDMPESDRSPERLAKEAQVLLGGGTASTARTIAFASFYIADSPDIRSSLRDELWETMAGWPERVPSGLSSRDLPICRPLLKSLSGIYCLYESPSTMMAIDPERAGTTEKAWTRFLQLAAHPRSRPLRTLEAYLPSRVIDAGELIWFGTLTFAMAISIRNEELELCLKLARPGYAAVSLTNDNYTWNKNCEEAQRLGIDYVYNAVWVIMQEQSVGEEEAKRVCAEQIRYYIKQYFQVVEQEKRCWWLSDDLKTYLEAVKATPATAREMGAQFSQFFPPHPTFTSENLSEQQGKVFLITGGTSGIGLELAKILYCHGGKVYITARSEEKAEKAIQEIQASAPNHHGELDFIILELDDLRSIKASVEAFKAQESKLDILWNNAGVSQPPLGSVSKQGHELQLAVNCFGPFLFTQMLLPLLDAAVASSVSPGSVRVIWTSSQVAELSSPDEGIIMSELTSPPKDNVRNYVNSKTGNWFLSAEFARRYGSRGIVSVALNPGAANTNLLKDARLMKILSYPLLHRAGLAAHTELYAGFSPAISLQNNGCYVIPFGRIHDQVADALLSAMKVAEDGGSGRAKEFWEFCEARTKDYL

SEQ ID NO: 23436 - protein, 422 aa, Aspergillus nidulans FGSC A4
MALPDVENTPAAGIPYFTPAQNPPAGTAANPQTSGNAVPKLYTPLTVRGVTFHNRLGLAPLCQYSAEDGHMTDYHIAHLGGIAQRGPGLMMIEATSVSPEGRITPQDVGLWKDSQIAPMKRVIDFVHSQSQKIGVQIAHAGRKASNIAPWLMNKGIVATEKVGGWPDRVIGPSTVPFHETFPTPKAMTKDDIEQFKRDWFDACKRAIAAGADFIEIHNAHGYLLSSFLSPSSNTRTDEYGGSFENRIRLSLEIAQVTRDAVGPNVPVFLRVSATDWIEETLPEESWKLSDSVRFAEALAAQGAIDLIDVSSGGVHAAQKIKSGPAFQAPFAVAIKKAVGDKLLVATVGTITNGKQANKLLEEEGLDVALVGRGFQKDPGLAWTFAQHLDVEIAMASQIRWGFTRRGGTPYIDPKAYKESIFE

SEQ ID NO: 23437 - protein, 1789 aa, Aspergillus nidulans FGSC A4
MAAPTPQLPTRFPCWCRAIYSWGGEAKSDLGFIEGDLIECLNAGDGQWWMGRLRRDRRMVGLFPSNFVQLLGEDFVPVTRATSPMLPAAASPITNPTSAPKKQKTVFRKPFQAHKEALAPSGSGGSPSSTSLVGSTIPQTPPRDGSLSRRTKTGRTPTRANRQQSSLSRPLSIARPPSRGVSPHPPPEPTPQQHDISSRSRSRPPSRAVSPRPQLPEVTHSSPLVSPAGPTYAQTSHYPSHASSSRPQLPDFGRHSPLVSPSFPMYSHVQDTHSWSRSASPRPQLPEITHHSPLSPSVPMHNHSQLSHQSSREISPLQLTEREDSPPPPPPPPHRVAVQRQPSPGPAVPRQLDMNDRYVVFTRTPSPAGHSDANGQTPSPLRDAMEDVMTSLEDMGMPRDSRSPSPQPEFDNPWSPAAFDSLRESRHPQRNNRPLTSLGFEGEKEFYHSDAVHRNSVYTHDPFIEGPPQINNYVQRMESRLRQMQEQGRRGSEDIQPPVENSEEDDDMPPPPPPRHGSYHGRHNSIPAHLPSLRSRRSGHDLRNDMLNRSFTKSSNTTNSSSGVHSNATNQTSSTDRTSQSLMSGPSAGGFSATSAGSYARRGIAAGERPSTAVDAVRSRGFSDLTRMPRPESPMSGISYHSSHNTSRQGASSAIPWSTSATTPEEPNSVFGGLATPKAKKQGFFKKILESAKTGAANARSSIAVGQSGGSFSPTKGRAISPIRSSHSHRDTAAREMGTGNNPMDWVQVRRDVNRASSPSRNERIERAERCQMMDHPVIYAVEELYETAEGEESIDGLPISEPTDFGNVNLTLVDKSARFVNSLPPMTNPLSLAQGYVCRPYKSDVQRLRAIFTWVSEKIAWDEPIEDADIDLKRVLQTKRGCAQEVAYLVREMCAAVGIHADAIEGFLKPPGEVFDLDSLSRPNHWWNAVLVDGDWRFMDCSLANPTNPIRNQFVTTNTTVAESWYFLARPLELCYTHVPLEPEGQHICPPISPDVLLALPTVCPTYFKMGLQFPDYDTSVFRIEGLEVLQVRILVPADVECAAEVEAPGFARDADGDFFESGEIVRKRALVQPDWVNGQKRITIKAVLPGDEGQGMVKVYAGRKGLMHSSRDIPHPLAFALPIIHTGENPPYEFVLRHPTPHAQRHDLYIIQPQCAKLAVNNTFVFAVRQHPSSPTPQTSSNENSFSGRISPSVFSRPASALSMVSSSAGGSTVSTVSNEFSASTSAISSTRSNSGREKPAKLAIQSPSGKILRLTRKADHMISSPKTSDSPSECTADGSVWETVIKIGEGASPLQQQAFEFTPLLIPRDDIWHLALPRLASFEWTCTYLIYIEASKREMSPRLNLPDPFATIPRVSLLYPFSSPIHPLQSLSGLASAPAPASASASASTTHSAPGSTRSQGARTEGIHVSLYAKREDHSSPLACAGNKYRKLEYIVPDILSSSPRYGAGIAADVPTPIHGKGKVTTLVTEGAIQSNHTVQVASVASRIGLESVVLLHKGTGGGLASAKDKAAFLRTGNVQIVKLLGAEVRMFEKPVAPKTQDDIVEEVLNNLRAEGKVPYWIPSGASLHPLGGLGYARCAFEIAAQEKDILGSPNDRGSGGYGIKQPRFDYIFVACGSGSTVGGLIAGFKLLEKMENSQPHEQTRGERKRRVIGILTSPTMRKRYHEERILRFARGAGKLIGLNPQTDITMDDVVLDDRFAGERYGVLDAKTNDMLSLMAEKEEVILDPVYTAKVARGMMHWVAEGEIEKDLLASPATYRGQDGEQVNVLFIHTGGQSALGAYAST

SEQ ID NO: 23438 - protein, 200 aa, Aspergillus nidulans FGSC A4
MVRYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 23439 - protein, 432 aa, Aspergillus nidulans FGSC A4
MDTSQVRILPKLDISAGHNFTKPSKRINESQDVAEFLSSKAYVDLMTFLLQLNRSLFPTKLPDGRVLTWELNSEAVEYSAPVRQLQQLLSKLEAILDEAPPDTGPRRFGNISFRRWYEMVESRAASLLEECLSKEILQMPSSDPGAPTAEVELLAYFLGSWGSPQRLDYGTGHELSFLAFLAGIWKLHGFPENSPGVEERAIVLGVIQPYLELVRTIIKRYTLEPAGSHGVWGLDDHSFIPYIFGSAQLAPAISESDRIPEEGSLSDAPAPGGVTKANVVERERKHNLYFSAIGFIYDVKRGPFWEHSPMLYDISGIQAGWAKINKGMIKMYNAEVLSKFPVVQHFPFGSLFSWERDPNAPSPAADAHIAATTRRTDEASTSSYLYSPKYIKATSWSYGSYKGALGNISTRWTGSPWRFYVCRPYANESSVG

SEQ ID NO: 23440 - protein, 488 aa, Aspergillus nidulans FGSC A4
MALSKHIHRIAVIGAGPAGLTSVKYLLAEKCFDTVDVFERRSHMGGVWNYSPGTLKEAVSTPVPQLSPDEDIQEPVWLPRDASRPNQEPTFISPIYDTLDTNLPKELMAFGEKQFPSDVQDFPRHFTVKEYVREYGEDIKKHIQFETQVLDVQKDSSTETWSVTTQSLRSGTTTTSSYDAVVAASGHFDVPYLPEIRGIVSWNNAYPGVITHSKFYDVPDPFRNKKVVVVGSSASGLDIGNQISKVCKGKVLASQRTDLYVSPSTAMDKAYYPEIVEFLPPATHERAVRFADGRVEDNIDAIIFCTGFLYSFPYLSSLTPPIITHGRRVENTYQHLFYIHDPTLVFPVLPQRIIPFPLSENQAAVFSRVWSGRLKLPSTAEMKSWENSAVAQKGDGPGFHLMPYPLDANYLNMLHDWVSTAESRPGLVNDGNGKPCNRWGRKERWMREMVPEMRKAFFSKGEERRLVKTLEELGYDFNRWRTEQDHFP

SEQ ID NO: 23441 - protein, 1019 aa, Aspergillus nidulans FGSC A4
MYTVLRTVYSSLHTGLGAHDDPVTSSTMFEELTSILPRASALRRRRYSVRSFYWSLAIFTVLAAFSWGLGRWSSPLVAHGFANPSLMKRENELECRLVRNAKDQCAFVRLNCLDEEDGFFSYLQLYYCALAHAKPLAFIIIVLWLSLLFSTIGIAASDFLCIDLSTLASLLGLSESLTGVTFLAFGNGSPDVFSTFAAMRSNSGSLAIGELIGAAGFITSVVAGSMALVRPFKVARRSFVRDVGYFVIAISFSMVLLADGRLHAWESATMVALYFFYVVLVVTWHWYIVRRRRVQERNMAARSHFHIPDNQELDIEEMEDDDPGIATESTSLLRGATTEDFDALESAEAPAWTDPDEDDETRNRHFAEIRSNMRVSRPSAPRRNTLNPIRPSLVGALEFQSVLSSLKRSRSHNRSHSIGLERYSDNSESVQGDRSQFDNISIASHPQSSRTQGNSFLSLDQGTNRTRAVSANDAMGLKLDTNFFTSDNAPQPKLTVSRPSIEDGSNTEISHILESQNGTEFTRSPTSSAFSSRSPSLGPRPGSSVHNPTLLAPPDVFQSLNYSEAASDSRSTPQVSPKGTRYVTDGQDNNSSGAPSPFPPFQDVPGSPLSTAPSIRLPASFSPAEPLQYQEDTFDSGSRLTSPVNWWPRSRSLLRLVVSTLFPTLDGWKAKTIWEKILGIVAAPSVFLLTITLPVVDPVSPEVTSATVPVIVTSAEDDPSAATPIVRLPEDSPQLQAHISESVAERTVAGQDNKFQLDRSRQRYDSELPAVQDPAPTTREWYPWLVYIQLFTGPQFVALISWSAIDSDLTARTFLLLSLCAVVFTLVCLGALLVSERRSPSSLGHPPTSWRPVLAFLGFIVAIFWIATIATEVVSLLKTLGVILNISDSLLGLTVFAVGNSLGDLVANITVARLGYPVMALSACFGGPMLNILLGIGLGGLYMTLHTTKGHTSDAADITYDIAVSKVLVISGATLLTTLVGLLIIIPWNKWRMDRKIGCGLIILWCVSTLSNVIAEIVS

SEQ ID NO: 23442 - protein, 337 aa, Aspergillus nidulans FGSC A4
MSISSTSPPYPLHPSVKDLLDPEYVAFYNAHVIDKQQVHLQPVETSRTSGILIPGGGPLVDVGKTVDITIKRRATEGPEILLRAFTPIGEAPEGGWPVMLYFHGGGWVLGNIDTENVVCTNLCSRGGCVVVTVDYRLAPENPWPAAVHDCWESFLWLLSDGPANLNINISKIATGGSSAGGNLAAIITHKALTLSPPVRFLAQLLSVPVMDNTATVSNNESYRRYEFVPALPAAKMLWYRNHYLPNEKDWSHPEASPLFYTGDWSALPRALIMVGELDVLRSEGEQYAEKLKQAEVEVDLQVMKGMPHPFLAMDGVLKEGKRSITLMCDLLKEVFSS

SEQ ID NO: 23443 - protein, 260 aa, Aspergillus nidulans FGSC A4
MIFGICINAGAGKQGYMGFDTWVHPGPFVAYDNISPDSTAKFVGFWAVLIQAAFSYQGTELVGIAAGETENPRKTVPSAIRKTFFRILFFFVLTIFFIGILVRILLTVVLSAANSNVYSASRILIGLAQEGFAPRFFKKTSKAGVPYYSVAFASAFGLLGFMNVSNSGATVFNWFLNISSVAGLISWASILGCHLAFMRALKARNISRDLLPYKALWQPWFSWYGLFFNVLIIITQGFTAWIPEFSLFVNYDSKIPNFAY

SEQ ID NO: 23444 - protein, 1127 aa, Aspergillus nidulans FGSC A4
MSPTAIETVPTGKNNWWKEATIYQVYPASFKDSNGDGWGDIPGVIEKVPYLHSLGVDVVWLSPMYDSPMLDMGYDVSDYENVLPAYGTVVDVEKLVEECHKYGMRLILDLVINHTSDQHKWFLESRSSKDNPKRDWAIGCLRATIGGILQGVHVRSLFPTAGHALIRTGTWDEHTQEYYLHLYAKEQPDLNWDNLETRKAIYDSAVRFWLDRGVDGFRVDTVNKYSKYTDFPDAPITDPKSYIQPAIGMWCNGPRIHEFIREMYDEALEPYGDVVTVGELANTPDPAHVLRYVGASAKQLSMVFHLDIGHIGMGSLEDKYVLQPWKLTEMKSIVAKWQTFIEGTDGWTTAFCENHDNGRSVSRFASDAPEHRERSAKMLALMMVAMTGTLFLYQGQEIGMINAPRDWPIDEYKDIEGLGYYREAQAQVASGVDPMREERIMDGLRVLARDHSRLPMQWDDSPEAGFTTGVPWMRTHDLYREINVKKQEGDPDSVLSFWKKVLLLRKRYRHLFIHGAFEVLDFDNLDTFCFIKSRGEERALVVLNFSAGEQPFTQAEMAADMELLVGNYAEAELFPHPCAGISYYSDRWILVTRFIAEGLAFALLHCNRFSLTSIFPCDACRRRKVKCDGQQPCGRCRDAEISCRTTSVRRKKGRQGATATVLHELRKAPAPVAQVQSVPSPQPTVISDPFIRQPGLLHPSVVQSCAEYFFPRMLGTVPILVPTTFQDHVARIEESLHSYCLVTAFCAFVFAQTGYVSWLNAGNQSASLGRLLLDEAMAARRHLDLFSASTRQGITISFLLYGCQIGMGNQRQAYYFLREATTLYTAGMLDPADADDEDAGNLFWLLLISERAHAIRRHRPITLQVTRDSPILCDTRSDAFSLGFRCLAELYRPFDQTFLSRWNGTDSSATTEQLIQLEDHLLQAVPADVELPDIVLADLRVSQQWLRTMIWQLATSAGFLSSTPSRPCLGFAYPLQIARDLSLATWKLSKESLETHGIGLAEKIFEITCTLTDVMACMTSAGLRSSSFDLGPQDYLKHLCTLIHSLPGGETKFLPLLLAKISQTLPSMLTPVTRHLSLPSCMAEQVSVSPNVGIGSPVSHRDDWSKALNWAEMSRIGDRTPEARRGA

SEQ ID NO: 23445 - protein, 218 aa, Aspergillus nidulans FGSC A4
MASRAAAGARPGARFAQFKLVLLGESAVGKSSLVLRFVKDQFDDYRESTIGAAFLTQTISLDESTTVKFEIWDTAGQERYKSLAPMYYRNANCAVVVYDITQASSLDKAKSWVKELQRQANENIVIALAGNKLDLVTENPDKRAIPTADAEAYAREAGLLFFETSAKTSSNVRELFTAIAKKLPLDQAGPRNMRTAPRPGVDLRPEAPGTQSGGACNC

SEQ ID NO: 23446 - protein, 1119 aa, Aspergillus nidulans FGSC A4
MYKTGNHSSDPARKNHRSAPPIPERLNTGNSRLMRQTRTAAKDSSFVLISRSGHFLANQCLASSCCSSVNLLEPDAAGSEDYMAGSHRSPVLKDQWRGSSGEVGDQRGREKHSRPRGSHRDRGRERFRDQDRHHHHPPNDDRLHRSSRSPPPRSFPGPDNKPQHRDFSTNIASTRASPAPSRSEIRPSQNINRPDSPERIGYRVTNSHMRSAERNHRREDSPSAPPFKRQRTHSPPPDGFQGRPPTHSRGAPPRHGRDFDREPSHSKGRGGRPPGRGRPSRRPSPRRERERRKHDSGLRDPSRNRQPWSHDWEDKPPIHPSRRYRSPPLDGIERDSYLRSPSRVSAGTLDSRTSALSRRGSKGDIAMHPPPSPSRLSLDRVPDTGYGAGLPERSRASRSPVNSYHESTRPSSPYSTARSGRSGQHSSHPSQHSFRASNFSEHDSPSRLSHGQPTSSHHVAPSHSYRDGQQRYQETHQDRRISGIVPTAPLSHARNRFSSPQRDASASRSRAGPPSPPQGPAADDPPPPPPPPTEPRSHREGYQNLTNHRPASRETRAPDEGSGHDSGSGFRAGQTGQPDTRPPEPPSGPSKGGKISFAFKAKTGPPSAPKPVPDLAQRMLAREPPQRVAEPPRSKMSSGPPPRFKPEPRFDRRDRDRDRHRDRDRNRGRNDRRDYREPRGSREARDYRDSRRDDRRVDPRDKRRNDKASGVRPERRHDPSPEPVKRSKIMLRLKPRPTISEEFANSDSVYFRKPGNESVIGAGTYGKVFKAIHVYTQRKVALKKIRMEGEKDGFPVTAVREIKLLQHLRNHNVVSLLEVMVEKNECFMVFEYLSHDLTGLINHPTFTLTAAHKKDLAKQMFEGLSYLHHRGVLHRDIKAANILISNQGRLKYADFGLARFFSKSRQLDYTNRVITIWYRPPELLLGETQYGPAVDVWSAACVYVEMFTKKAVFPGEGGEISQLDKLYNTLGTPTRAEWPNIVEMPWFELMRPTERRKRIFEDIYRDILSPAALDMVSQVFRYDPAKRPSAEDVLAHPYFHSEEPSPQQPIELENIQGDWHEFESKALRKERDREARRAEYQRDKEKRKILAAQDERETKRIKPDTSDGLTSSVPQPGQQ

SEQ ID NO: 23447 - protein, 1478 aa, Aspergillus nidulans FGSC A4
MEKDPSTGGPLTNSPAEQYLRSPAESRSTSDTASIPSSNPDSEKFAPIQTNQSTRSRNQTLTRRGTAGSRPLTDDEITRALSHRTSSTYQGGSEDNEEVARLVSRMFGRERKANSDEEQTRHQGVVWKNLTVKGVGLGAAIQPTNADIFLGLPRLIKGLLTRGRKGTSAGSAPLRTILDDFTVCSYSMMSRAELIVKGLRAASVEGEIHYGGTDADIMADKYRSEVLYNPEDDLHYATLSVRETLMFALKTRTPDKDSRLPGESRKEYQETFLSTIAKLFWIEHCLGTKVGGEIVRGVSGGEKKRVSIGEALVTKASVQCWDNSTKGLDASTASEYVQSLRSLTNMAHASTLVALYQASENLYKQFDKVLLIEDGRCAYFGPAGRAKAYFEDLGFKCPPRWTTPDFLTSVSDPNARRVKKGWEDRIPRSAEDFQRAYRSSEDYRENLLDIEDFEREVKEHEDEQEEARRRAPKKNYTVPFHHQVMILTERQFKIMYGDKGTLIGKWAILTFQALIIGSLFYNLPNTRGGVMFFVLLFNALLALAELTDVFTHRPVMLKHKSFSFYRPSAYAVAQVVVDVPIIFIQVTLFELIVYFSMANLQRTASQFFINFLFIFILTMTMYSFFRTIGAFSASLDVATRLTGVAIQALVVYTGYLIPPWKMHPWLKWLIWINPVQYAFEGIMTNEFYNMDIKCIPPNIVPDGPDAQPGHQACAVQGSEPDQLVVQGSNYVSAAFTYSRSHLWRNFGIIIGFFVFFVATAMIGMELQKPNKGGSSVTIFKRGEAPKEIEKAVEQKEKPNDIESGSRNDTTDTVGSDDGQAVEGIARSESVFTFQNVNYTIPVSGGKRQLLKDVQGYVRPGRLTALVGASGAGKTTLLNALAQRLDFGVVTGDFLVDGKPLPRSFQRATGFAEQQDIHEPTATVRESLRFSALLRQPQEVPIEEKYDYCEKIIDLLEMRQIAGATVGAGGTGLNQEQRKRLTIAVELASKPSLLLFLDEPTSGLDSLAAFNIVRFLRRLADAGQAILCTIHQPSAVLFEMFDDLILLQSGGRTVYNGELGQDSSRLIEYFEQNGGKKCPPDANPAEYMLEVIGAGDPNYKGQDWGDVWANSENCKKLSDEINKVVEMRRNNEKERNKDDDREYAMPIWVQILAVTKRSFTAYWRTPQYNIGKFALHIFTGLFNTFTFWHLGNSYIDMQSRLFSIFMTLTICPPLIQQLQPRYLHFRALYESREANSKIYNWTAFVTSAILPELPYSIIAGSIYFNCWYWGIWFPRDSFSSGFTWMLLMLFELFYVSFGQFIAAISPNELLASLLVPCFFTFIVAFCGVVVPYMAMPHFWQSWMYWLTPFHYLLEGFLGVLVHDVPMECVEREETLFSLPPGQDSCQRYAGSFLSQATGYVRDVGNGMCAYCMFSDGDQFAANNFNVYYNHKWRDYGIFWAFVMFNFAAVFVLSWLYLHGVNDMKKWLSRRKAKKSGLQS

SEQ ID NO: 23448 - protein, 489 aa, Aspergillus nidulans FGSC A4
MTEDADFGLIGLAVMGQNLILNAADHGFTVCAYNRTTSKVDRFLENEAKGKSIVGAHSVEEFCSKLKRPRRIMLLVMAGNPVDQFIESLLPHLEEGDIIIDGGNSHFPDSNRRTKYLKEKGIRFVGSGVSGGEEGARYGPSLMPGGNEEAWPYIKDIFQSIAAKSDGEACCDWVGDEGAGHYVKMVHNGIEYGDMQLICEAYDILKRGVGLSSKEIADVFAKWNNGVLDSFLIEITRDILYFNDDDGTPMVEKILDKAGQKGTGKWTAVNALDLGMPVTLIGESVFARCLSALKDERIRASSLLNGPTPEFTGDKEEFIADLEQALYASKIISYAQGFMLIQNAAKEYGWKLNKPAIALMWRGGCIIRSVFLKDITEAYRKDPDLENLLFNDFFNKAIHNAQKGWRNVVSKGALWGIPTPAFSTALSFYDGYRTKALPANLLQAQRDYFGAHTFRIKPEHASEKYPADKDIHVNWTGRGGQVSASTYTA

SEQ ID NO: 23449 - protein, 442 aa, Aspergillus nidulans FGSC A4
MAKHTKSHAHPKPPSGAAKGKGSAASVSKTPKSMVIRIGGSRVGSSVSQLVKDVRLMMEPDTAVRLKERKSNRLRDYAVMAGPLGVTHFLLFSKSSTGNTNMRLALTPRGPTLNFKVESYSLCRDVEKALKRPRGGGQDHKTPPLLVMNNFNSPNADENSKVPKRLESLTTTVFQSLFPPINPQATPLKSIRRVMLLNREPASESDKEGSYILNLRHYAITTRKTGIPKRIRRLDPKEVRNREKHKSAVPNLGKLEDAADYLLDPSAAGYTSASETELDTDAEVEVAGTTTRKVLTKREMQRMKTGEKVEKKTTTAEVEKRAVKLVELGPRMRLRLIKVEEGLCEGRVMWHDYIHKSQQEVDALDKTWDQKIKEKEARKKLQRENVERKKQEKAKARAEGKEVEDDEDDEDVDMDDEWISDDEEEQNQEVDEEDEGDESIDE

SEQ ID NO: 23450 - protein, 492 aa, Aspergillus nidulans FGSC A4
MTRPQIRRVAVIGAGISGVVSAAHLIQAGLDVTVYERSHAAGGVWLYDERVAPEPSYTSLKPLESERYFDKNEHNIALTHAPPGPCYDGLKNNVPTPLMRVKLNAWPEGTPDFVSHSVMKEYIQDTSRKTGVDDITIYGARVKNLIKQGDSWQVTWSRLEQYDDELKEQERKTTFDAVVVASGHYHTPRIPETPGLAEAKARWPDRIYHSKRYRKPEGYEKKNVLLIGGAVSAIDIAREIGPQADTIYQSTRNGEFDISASILPENGVRVSEVTRYEILDESQVVDGKLPLKVHLKSGQGLCGLDQVIICTGYQFTLPFLADYHNDRLSPAEADETILVTDGTQAHNLHKDIFYIPDPTLAFVGVPFYTATFTLFEFQAITAANVFSGIADLPSKQEMRAEYNEKLKRKGHGKRFHSLKDVEDDYVNNLLEWINTPRVRIGLTPIEGHTERWHEAKEAQRERLKAFFETPTATNDRRDSGIEGLPVLPACSA

SEQ ID NO: 23451 - protein, 504 aa, Aspergillus nidulans FGSC A4
MAQPVQLTAPNGVSYSQPTGLFINNEFVPAASGKTLTTVNPYDESIIATVSSAGPKDVDRAVAAARQAFASEWRGLTPSERGLLLLRLADLCDRDKEILATIDAWDNGKPYEQALGEDIAEVIAVFRYYGGWADKIHGSTIDTGDAKFAYTRHEPLGVCGQIIPWNYPVMMAAWKLGPALACGNTVVLKAAEQTPLSVLYLATLIKEAGFPAGVVNLLNGEGASAGAAIAGHPGVDKIAFTGSTNTGRVIMKAAAGNLKAITLETGGKSPLLVFDDANIDQAVKWSHVGIMSNMGQICTATSRIYVQETIYDTFVEKFKQYTIENSKVGSQFDPSVTHGPQISKAQRDRILSYVQSAKSEGAQLVLGDEPVSEKGYFVPPTIFKNTTREMSAVREEIFGPFVVIQSFSTQQDAINKANDTEYGLGAAVFTENITRAHRVAAAIQAGMVWINSSQDSHFAIPFGGYKQSGIGRELGEYALAAYTQVKAVHGKFSLPLEFNLGTWL

SEQ ID NO: 23452 - protein, 488 aa, Aspergillus nidulans FGSC A4
MAQVEVPSTNGSGKSVETRLFINGEFQPSSDGKTFSLIDPFTQNSVAEVSQATEEDTNNAVAAAKAAFPAWRDRSPADRGACLHKLAALIRENNEEFARLEALSTGRPVSRYFDATVSADTFSYFAEAGWTVQGTSSLNTPGHLNMTVKQPYGVVACIIPWNVPMAFFAFKVAPALAAGNTVVLKSSEKAPLTSALAATLIAEAGFPPGVINILSGFGTPAGSTLASHMDVRCLSFTGSSFTGQRIQAAAAASNMKIVHMELGGKSPALIFEDADLENAAQATQFSIQCLSGQTCMANSRIYVQESVADEFLALFKEKFGSAVLGNPLESGTTHGPQVDGLQYERVKSYITIGEQDGKLSMGGDAGNGYFVKPTVFEGVPEDSRIVKEEVFGPVVVINTFKTEEEAIKKANASEFGLYASVFTKDLDRAVRTSKLLEAGTVGVNTTSPNVAKDMPFGGYKMSGVGREGFMHSLDNFLETKTILIKMSS

SEQ ID NO: 23453 - protein, 338 aa, Aspergillus nidulans FGSC A4
MTTPSIPIIDLEPARSGGPEELANLAHEIYQAFKHVGFAYIKNHGVPQDLIDEAFSWSAKFFALPESEKNKAPHPPEGSYHRGYSGIGREKVVQMVFDSDSIAERRKTPDVKESFEIGNENDTKMRNIWIPEESLPGFRGFFAKFFNICSDLETLMLRLIALGMGLDENFFLKYHSERTNQCRLLHYPAVEEELLRAGKAERIAAHTDFGTMTILFQDEVGGLEVEDIHEKNKFNPAPYIPGTAVVNIGDLLMRWSNHELKSTMHRVRAPPLVDVEDGSTVEKKRRMTRPRYSIPYFISPDRDKMIECLPNCHGEGRPKLYEPITSSEYIAMRMNATY

SEQ ID NO: 23454 - protein, 370 aa, Aspergillus nidulans FGSC A4
MFRQSVRRFATAALRSAAESPYNVRVSQAQGFVNGLTEAIGNTPLIRLKRLSEETGSNILAKAEFQNPGGSVKDRAALYVVKDAEERGLLKPGGTVVEGTAGNTGIGLAHVCRSKGYKLVIYMPNTQSQGKIDLLRLLGAEVYPVPAVAFDNPENYNHKARRHAESLDNAVWTNQFDNTANRRAHIETTGPEIWAQTGGKLDAFTCSTGTGGTLAGITYYLKQASGGRVKSFLADPPGSVLHSYIQSGGKLVERSGSSITEGIGQGRITDNLQPDVGTLDGSLNISDEKTIEMIYRCLDEEGLYLGASSALNVVAAKEVAEKLGKGSTVVTILADGAYRYADRLFSKSWLESKGLRNAIPKHLEKYIVLP

SEQ ID NO: 23455 - protein, 430 aa, Aspergillus nidulans FGSC A4
METSFFSCFFAWPFTKKFGRRWSIALASLIFCIGGIIQVAPTHSIGAFYAARVISGVGVGMATVMVPMYSAEMSPKEIRGQLGSLFQFFFTLGVMTSYWIDYAVEKYVASSDRQWQIPIGLQLVPAGILGLGMLFLKESVRWLASVGRHDEALQSLIWVRGGEDTEEVRTEMAEILDGISAEVAATEGVTWKELNLPANRFRIFIAISIQIAAQCTGNTSLAYYAPQIFGAVGTSENDTLLITGFFGVVKVVACGTFVLFLVERIGRKWSLALGAFMMGALMLIVAILAKVFTPDSTATEISSPTAASIAMIYLEAASYNMSWGPVPWLYMSEIFPTRIREIGIAVGTATQWLFNFVFSQATPHAVNNMGWRTFLMFCIFNWAIVVYVFLFIRETTGKSLEEMEDVFKSNIARFRKDEERAEDGAPTYTQ

SEQ ID NO: 23456 - protein, 1124 aa, Aspergillus nidulans FGSC A4
MATNPGSIPVETHQPSLLCVAKDPKPEKHDEAKAIDIVAVHGLRPAANIDAWKIADGSLWLKKLLPRDVKGVRVFTFSYNALAVFSGADHKLTDAAMDMLLKITAARAQVPLDRPLVFICHGFGSFVVECALNRALSCPSLYPNLEGCVRGVIFLSSPQSAPLEVPFSALLIDSATDSIMTENGISTTMIRWLESNADILQAIPRDFKRIASRMKIKVYSCYEEFPVVPHNQPTLNEYSAAVGLKLENLRMMSGCNHHSLATFSDRECDNYKFIVSAIKKVRNAARKARELDPKVIPELGYEQPTLGSRDDHYQQGPSSPEYQRISLPRILPLQMDNPSCAVNASQKDVFQQPKKPNLPSFQAPATFSASSVALVPPSQPAGPDQLKIPMRPVGSNPGRSPPGNTPAPSVRSLSMTSSNFDGFMPASSQVAIDRIEAILPTGNATTPVTSAQQSARSPSTASSHSMGFISKQPQPLPDKSNAYTAHYSAPGMVGQRLPEQGMSHQSQVIQPKMPGEIPGGVSKAQLQPQNIDVGEGLPDAKRCLPPQSLTDNASTTLRTTPTSWGPKYSATTQPSPSGLIPHPPQVMHSNQVSYAPFNTPIKQPPRPQRPGHSQTSSAVLSIPMNNSKVPAPLPTGVSSSSNPKPPPLPKNKKTKTPQPTISKKVKRVQEDAAAGQPPKPPRATRPPHKPKPLEPPTQPPQPRPSANKGLRGQSTSQKPQELSKPSKPQKPPKLLASAPMHIISPGKRTSGPSPLHPPSLDRQVGPVPREKPGLFRKLFSSSQSDRSSGASAGAMHNTSPGVSGQYKPYRPGPSQTSVSVPQRPLAGSTGYRPTGRTFLPQQPHRPQQPHMLFGGGGLGNGHANTQHPVHGQSQGLFHAPFHGHGHGPTHHHGPGAPVPHVQQHGSQGDPTRLSGVGTLGKVGAGALGGAALGGLGVIGAMHAHHGSEHEGSSDPEGSDPEGSDPESSAPEEGSDPEENSNPESSDPEDGEESDCDEDEDGENGDEDDDDDEDDDDEDDDDDDDDEDDDDNEDDDNEDDDNEDDDNEDDDDEDDDDEDDDDEDDDDNEDDDSEDDDEDDDEDDDEDDDEDDDEDDDEDDDEDDDDEDDDDADAYSNDEDDYYYS

SEQ ID NO: 23457 - protein, 448 aa, Aspergillus nidulans FGSC A4
MTFSVFDNYQNTINGVQTSTAEKRHGINPATGEPNPDVPVATAEDVDKAVAAAEEAFKTWSEVPFVERQKALLAFADAIEKHAEDFSKLLVQEQGKPDSAEKKIVVRHTPIGVAAGIIPWNFPLALAVIKLAPALLTGNVIIIKPSPFTPYCGLKLAELAQQFFPPGVVQALSGDDRLGPWLTAHPGIGKISFTGSSATGKKVMESASKTLKRVTLELCRGGKDAAIVCKNVDVKSVAPQVVSKGFLNSGQICLAVKRIYVHESIYEEFRDAAVAYAKTVQVGPGTQEGVFMGPLQNSMQYEKVKGFFADLTKEQLSLTHTDGKAFDDKPGYFIKPTIIDRPAEDSRIATEEQFGPIVPLLTWNDESEVIARANNTRMGLGASVWSSDLDEAARIAAKLQAGSVWVNTHFESDPRAPFGGHKESGIGTENGLHGLRQWCNLQTLYLKK

SEQ ID NO: 23458 - protein, 310 aa, Aspergillus nidulans FGSC A4
MDVFLDVLDTFFFDRLYALILPATNPVEDTVRESQKLYNQNIGRYVPLAPSPYVDASIWKRDDIVRQATSLFLIAWIFGLAMYLIGSMIVYHTMFDKRLMRHPHFLPNQIRLEIRQGVTAIPVIAILTAPFFLAEVRGWSKLYDFASEAPFPAYTWLQYPLFVCFTDFGIYWIHRWLHVPMVYRWLHKPHHKWIVPSPFASYAFHPVDGWSQSLPYHIFPLLFPLQKSAYLGLFVFVTLWTVLIHDAEYLTNSVVVNGPACHTMHHLYFNYNYGQFMTLWDRLCGTYRKPKEDGFLQKENLQAQSIKKHE

SEQ ID NO: 23459 - protein, 397 aa, Aspergillus nidulans FGSC A4
MESRNRALFCQGCEDLVYDHGLERCRSATPESTLKGPLARKRRFSESSADELYVKSNANRRPCAKQGVRGLFNLGQTCYLNVILQTLLHDPILSTYFLGNGHQPHDCTVADCIGCAVAEAFADFHSIDKPEGFAALNLLLASWRASPTLAGYQQQDAHEYYQFLVDKLHTSAEGNRENHEKGCSCFFHRTFYGKLRSSVTCDRCGNVTKTEDPIVDLSLDVQVQAKKRAMGGGTGPSATPTLSGCLESFTSPEKLMADVYNCSGCGNTPQKATKQLRIKKLPAILCMQLKKQRFEHTFSVSEKVEGRIDFPLSINMLPYTTNPDSAVDKSRYTYDLSSAVVHKGKLEAGHYYVYCRQGDEWMLFNDDQVTPVTEAEVLGVDAYLLFYNLRCLANAAS

SEQ ID NO: 23460 - protein, 361 aa, Aspergillus nidulans FGSC A4
MVQQMPPQGGSRKISFNVSDQYEIQDVIGEGAYGVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKALFPKSNDLALDLLEKLLAFNPTKRITVEEALRHPYLEPYHDPDDEPTAPPIPEGFFDFDKNKDALSKEQLKSKYLAPIDSISYATIN

SEQ ID NO: 23461 - protein, 367 aa, Aspergillus nidulans FGSC A4
MAAPEIPKKQKAVIYDNPGTVSTKVVELDVPEPGDNEVLINLTHSGVCHSDFGIMTNTWKILPFPTQPGQVGGHEGVGKVVKLGAGAEASGLKIGDRVGVKWISSACGQCPPCQDGADGLCFNQKVSGYYTPGTFQQYVLGPAQYVTPIPDGLPSAEAAPLLCAGVTVYASLKRSKAQPGQWIVISGAGGGLGHLAVQIAAKGMGLRVIGVDHGSKEELVKASGAEHFVDITKFPTGDKFEAISSHVKSLTTKGLGAHAVIVCTASNIAYAQSLLFLRYNGTMVCVGIPENEPQAIASAYPGLFIQKHVHVTGSAVGNRNEAIETMEFAARGVIKAHFREEKMEALTEIFKEMEEGKLQGRVVLDLS

SEQ ID NO: 23462 - protein, 507 aa, Aspergillus nidulans FGSC A4
MANEGAGSLQQDASPGSSARPEPYPRPRCLLGILHFSSTPSFESPQRHHRRNPIARRPVKETLNARSEYTLSQDDGTAEHRINQYVIKQEIGRGSFGAVHVAVDQYGNEYAVKEFSKARLRKRAKSQLLRQSRGPKRPADGLNSPFHRQGPGLGDEEMKNALYFIKEEIAIMKKLHHNNLVSLIEVLDDPTQDSLYMVMEMCKKGVVMKVTLEERADPYDDERCRCWFRDLILGIEYLHAQGIVHRDIKPDNCLITNDDVLKVVDFGVSEMFEKNSDMFTAKSAGSPSFLPPELCVVKHGDVSGKAADIWSMGVTLYCLRYGKLPFEEHSIIELYDAIKNRPIVCDGETDEVFKDLMLRILEKDPAKRIQMDELREHPWVTKNGMDPLLPKSENTAEIVDLPTEEEMNSAITKNFGHVLAVMKAAKKFKSLLGPTRASTPIQSILGQEYETHFVEPPTQMDPEESVSLPSPLPYKKTQSLNTYNRRAWERDDVTNKERFRLNTKCQN

SEQ ID NO: 23463 - protein, 449 aa, Aspergillus nidulans FGSC A4
MSRHTPPTDTLGKESDRTRATTPQDASGCLTSWFAEGKNNKTCPDCRAPVKSQPAPAYLVRAVVQLFTSRAELLDKGETTEQHRAHQNEEAERLEADKKNRDPKEGGLFRGIFNQTRQRPAQPIYDLEDGVVRCPYCAHELEADDCLNCGYRNDDSLSDVRSDSENSEMTDDPYAEIDDDGFGEAPGSDSAEWYDDDLTTENYPGIQRLPTGFRLQSFPGFGNVPGGMARAIYEHFHGHSDFDSHGSTHEDDDDEMDDEEDEDMDSFIDDEEQPEDYDSDSDRDTVVGRSEYGGTQLRTILDSSPGSRYSSAQSNIYDFDTMLDSDEDGTSDEGEDEDGNENEDEELEDDDGEEEEEEEEEEEDDDDDDDDDDEPIRPSVARSRRTTYQILSSSSPLRVNSAPATSTCSRPQPPAAGLSAASAISLDDDSDEGPVGPATRRARARPAAA

SEQ ID NO: 23464 - protein, 1413 aa, Aspergillus nidulans FGSC A4
MADLKPPFTEEAARAKVKIAQNLWNAQDPVRVSQAYTPGCIWRNRTSFFSGTEAIVDFLTAKWKRERNYRLRKELFSFTDNRIAVQFWYEFQDANDSMRWKRCYGLEDWTFDRESGKMCKRMMSGNDILLGPDGNGEGRCDYRLLTQRWDHPTYHPYNRNRRLQQLDLNHFCRARISLAMEETSPFPDSKTMRSPLTDASNRINNCHTPTTERRLMREEHALTSPVPMSIVDSPLSPRNNAENNGPPPVGDSRACSKRNSAVSAASIVSAKGKRKTHVGPWQLGRTLGSGATGRVRLAKHAVTGQTAAVKIVSKKCAAISQSDSIAAMDRNAGTFIGAGGRQMPSGIEREVVIMKLIEHPNVISLYDVWENRGELYLVLEYVEGGELFDYVSNHGPLPEEEAVRLFRQIIAGLGYCHRFNICHRDLKPENILLDGEHNIKLADFGMAALQPAGHWLNTSCGSPHYAAPEIIYGRKYRGDKADLWSCGIILFALLTGFLPFDGEDLHATLQLVRKGDYMIPPHVSAEAADLIQRILQKKPDDRISMKDIWKHPLLKKYEKFHQAICNHYLGPPPPLSPQDCGPPVVRQDIDVDLLRNLQTLWHDVKPERLIEKLISLEPTQERLFYHALVKFRNEQLENYEGQPLRYSTSDYHHISRGQARLSKHLRSRSQNGSQRRSRAPSVKETGKRRPSTRELKPSASVETYDPYRSPFNRVPDKSPQYAHVTIHREAPETSPKPAEVEVDSSNPFLDDEQEIECQQSPPFTLVRKRKQNFNSVKSFQSKTSLISSRRALNSASTPRSVSYKRNVTFHHNRNRSQSSASAKAKRAHCNRQPSEASLISGFDDDPFSDSRSSSLLPAQPAVVRGAGIAVKNSVQRRVQHSDFVWRDEARKVSHELSQICEEAFNGSSLSTGCTDTTCVSPETPATSVSLASPGVSNHQMDSSSSTVCLAATPPADSPKTSHVRRELEETRRRLIEHSMKDGSKEIPQCLAPVIDHLDRLIEQEKTRRPGKVSTKEDYSSMSDLFCGSPVEPTQLSVLSEELNTGRRSDDTPSSKKDRQVSGSTAASSQISRGKRSIRMVPHSSYQSISNTEPRAVHRPAAALIDRPENDRGNALASRVGSNHRHNRTPCELDPIDEHPASPRRSAVRSTDHKKWSWFRKSQNIEEDFVKAPTVVKPLHPSSATVIVHEVHPARNTAENQPKLGKPPSDSQKVSFWSFIKRKKGKNADPESTATNPVLESRRDDERQRAHPGPKLSENKTATKPRRSIRSSGISNNWFARVFQFKPATRVVALNASKIKGRKEIYKMLRDWKQYGMEDIYLDKPNSIIYGRVGESNFLHLRPVDFSADFYTVIEDGRQANLSVVRFRQERGAASSFNRVVDTLCMVMKQRGLLVEDPARAKRMAQVLDAFPNA

SEQ ID NO: 23465 - protein, 351 aa, Aspergillus nidulans FGSC A4
MSLQTRSLGSGPDAPQVPCMGLGFGSLSGFYGPAGSPESRLSLLDNAYAAGLRFWDLADIYGDAEDLVSEWVKRSDPAKRDDVFIATKFGLQRQADGMHRFRSDPDYVKEACERSLKRLGVNTIDLYYCHRVDGVTPVERTVEAMVDLKKQGKIRHLGLSDISASTLRRAHAVHPIAALQVEYSLFTLDIESSESDVLQTARELGVTVIAFSPIGRGILSGQFTSYTSIPEGDLRRIYPKYAESNFPAILKLVKGLESVASAHSQRAERSVKPAQIALAWLLAQGNDVIPIPGTKSAARIAEDVAAAAIDLTEGELERIRALAEEAAMGISGTRYPAAVMATMCADTPPLE

SEQ ID NO: 23466 - protein, 361 aa, Aspergillus nidulans FGSC A4
MHFLQNSLIAAAMGAALVAAAPAADLDARSSCTFTSASAAKSGASKCSTVTLKSIQVPAGETLDLTGLKSGATVRETTFGYKEWKGPLISMSGDKITVKQASGAKINCDGARWWDTKGSNGGKTKPKFFSAHKLNNSKIQGLKIYNTPVQGFSIQSDHLTISDVTIDNSAGTSKGHNTDAFDIGSSTYITIDGATVYNQDDCIAINSGEHITFTNGYCSGGHGLSIGSVGGRSDNTVKSVTISNSKVVDSQNGVRIKTVYKATGSVTDVTFQDIELSGITKYGLIVEQDYENGSPTGTPTNGVEVEDITFKKITGSVDSSATRVNILCGSGSCKDWTWSGVDITGGKKSSKCKNVPSGASC

SEQ ID NO: 23467 - protein, 1322 aa, Aspergillus nidulans FGSC A4
MVSRSNEGPEAPHPASRTPGAPAKGRLTRLGSSPSKRDDKAKDDRMGKTSAKDVAELKDYIKLADLPKSELRVIMLEIDLLKNLDHPNIVKYQGFVKSAETLNIILEYCENGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPSALQLPHLRPHDNFGGMLSSEKLKAFASLDGTVLKSDESFEESDDPFKGSLLAGEHDPLKTIRPPPSQQANSGTSQSQNGPYGAHMRRGPPLNTAITPVYGGQMLQNSSSPIRQQRPPLFYKENSVEDYSDLISANEDVLDRKISAFQESDEHKDLADTGRSREVIRYQSSYEQEDTPRIGRQISVKRYRGTVEIQQFAENEHDEDFSDILGVDGVTLDKAESDDGSNKSTLMLNTKLSNNSWLGDLDDEDDPFALLEEGLDETDLEANIARDKHARLRSQVEGLVGSLKTSQDEEVLGDISEQLLAVFCDFPETKNIIISAHGMLPILEILDLCRRRDITLCLLKIVNAIIYDDYEIQENLCFVGGIPIINEFAAKKYPREIRLEAAAFVQQMYQTSTLTLQMFVSAGGLNVLVEFLEDDYEDERDLVLVGVNGIWSVFELQGSTPKNDFCRILSRSSVLDPLSLVLSRVLDEEGELAEVVEGRIANIFFIFSQAENHVKEMVSERTVLHSTDDGLGVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNKGLAFYISLLSDPYWQVTALDAIFIWLQEETAKVEEHLLENRYDQPSFTDAIVRCLTLSKANAFENILEPLQKLLRLSPPIASTLARPDLFSRLGQKLHHSKAAVRLNLLRIISSICDSSEQQGGLLASYGLLDSIRELEHDPAILVRDMAGKLIQSSERNDSYGLCKLKPNVRRGSTSATSPGLLANQSAPVTPQLSRQNQSKGYYDSRETQRRPRSAISGSALALRPGSRDGPTPGIVGGANGSAGASRNRIARGVSNRLSHIELLPNDDDRIPSSITRRSSVLPRRRRLTQFEAERGS

SEQ ID NO: 23468 - protein, 506 aa, Aspergillus nidulans FGSC A4
MATLAQAFSPDGSNAAVIVPGKPALTVTYAQLHSHISAFQEKLAKLGVGHGAAVNLALINSYEFIVGFLAASWQRAIAAPLNPAYKQDEFEFYIDDLSSTLVLIPRESYAQNGPAVLAGRKYQAAIAECYWNGTEVVLDVKELGKLKGKGDIGVQTAQPDDIALVLHTSGTTGRPKAVPLTHKNLTTTMRNIQATYKLTPQDRTYLVMPLFHVHGLLAAFLAPLASGGSVIVPTKFSAHQFWSDFIEYKANWYSAVPTIHQILLKSPLPNPIPQIRFIRSCSSPLSPKTFQDLEKTLNAPVLEAYAMTEAAHQMTSNPLPPAKRQPGSVGIGQGVEIKILDQSGNEVPQGHEAEICVRGENVTKGYLNNPAANKSSFTKDGFFRTGDQGKKDPDGYVIITGRIKELINKGGEKISPIELDNTLLQNPNVGEAVCFAIPDPGHYGEDIGAAVVLKSGQNATEDELKSWVQEKLAKFKTPKQQIPKTATGKIQRRKVAEAMLKPKAKL

SEQ ID NO: 23469 - protein, 499 aa, Aspergillus nidulans FGSC A4
MAQQYKLPFELDNPDLLHFDSYVGNAWVTAKSGARFEVVDPGTDLPWASCPTNSAEDVDSAVQIAHDAFEKFKKVNPRQRAQWLLKWDSLIREARSDLAKILTHETGKPIAESYGEIDYATGFTWWFAGEAERIQGSIAVPAAPNRRVFTVKQPIGVAAALVPWNFPIAMVLRKAGAALAAGCTMIVKPSPETPLTALVLAHLAEKAGFPAGVFNVLTTDLENTPPLSEALCKHPLVKKVTFTGSTRVGKLIASHCAHGLKKVTLELGGNCPFLVFDDADLDQALDQLMALKWRHAGQACITANRIYVQAGIYDKFAQLLKERTAKLVIGHGAKEGTTLGPLTTPRSIDKAISQVEDARRLGADVILGGSRVQGTQGYFFEPTILKNMTKDMLVSREESFAPIAALYRFETEEEAVKLANDTSMGLASYAFSKNIDRMWRLLENLEAGMIGMNTGNSSAAESPFGGIKESGYGKESGKEVAVNEYLITKTGTLTIDGQY

SEQ ID NO: 23470 - protein, 499 aa, Aspergillus nidulans FGSC A4
MNPKLYQFFVALFASFGSFLYGYDLGVIASVVASDSFIDKFVRGSSTVSGTVVALFTAGAFFGAFGAGFTDPLGRRMTLVLGSVLFIIGGIIQTASVNLGMLYFSRIFSGFGIGILVEMVPMFQAEIAHARIRGILGSLQQTMLGIGSLAASWIGYGCEHHWSNTGNSVQWRLPLALQVVPAIGLASCIFFFPESPRWLIDHDRHEEGLRNLATLHANGNENDAYVLAEFELIKQQVEEEHRHGAKSYKELFSNRSNTRRIILACACQASTQMTGVSAIQYFSPAIFAQIGISTSQTLLYQGINSIIGELAQFIFFFLIDRVGRRPLQIGGNIACGLAFTIGAALMAVYPPSSTNTSAHWAFIVTSTWFFNFCFCASGTMSWIIPAEVFNTATRAKGISLATMVSFAFNTMIAEVTPVALENIGWRYYILFIVCDFGNALFFYLFLPETKGITLEVMDDLFTNSPLLVPGSRWQPRPELDVDKVMERKDIMLRSVVAAP

SEQ ID NO: 23471 - protein, 1639 aa, Aspergillus nidulans FGSC A4
MDINSLLSPQDANSQSGRSAPASGSSSGNTPPAPSPAPKPLRKGRAAATNRPVMASSPLATHVYAPPSRAPEPSPPSSLGSAVNMGGKSGSGTPPTVDLQNSRQPSTPGMDTLADLASMQHHQPPRPRAANLRTPSYESQLSPSTIHPNVNQISHNTPTPRSSFDIAMSDGPRESARRDYAGSSLLPDARRMATELFARIQVNPQSYEAHVNFIRLLHDGFVNHVYPPNNPDIHGDPREYDLLKDMRTAREEMDKLFAMGEDLWAEWIQDESMLATSVNERIAVMELCQRSIEEEYGSTKLWIIYGEWVLYLYNSAHGDSSQSRWSEEDRLVGREVFTWQSVLDTWQRGAEATRWRIHDSHLVWDRLLELQVRDLSRNPSQDKIARVRELFDIRLQTPHATWDLTFQAFSNFISTYYNANYENIMAETAGKYATPVKDQYAAREDLEIRLRNAAESGDRAQEWAIFGEYIEWELNRNRRRRNTNFELINAIYQRAVLRFQTDANIWEDYIMFLIDESMHGNAHPTTISALDRATRHCPGSGTLWSQYLLSSEREGQPFTKIADIKHKATSTGLLDVGGMEEVLKVHTAWCSYLRRRAFLSEATDEDLDVAEVGIRSAIESVQELGEKKYGRSYEGDPLFRLERIYIRYLSESGSWDSARETFKGLMGRRGNSYEFWLTYYHWELVSWSKFVQGEATVDAARRTPNPSFATAVLKQAIKRTDLDWPEKIMQVYVAHCEDYEDSEELQLAILETRKAMRAINARRQREAQEAAAQQAAAAATETQEASQSEKRKREDESTANGLPTKRARADRASVEAEPVALRRDRENSTVVVKNLPQGTTEHKVRQFFRDCGAINGVKMMPGEDGKSEVAMIEFNTRDDAAAAQTRDQKTFDGNTIQVHFGSETTLFVTNFPPTADENYIRDLFSKYGEIIDIRFPSLKYNTHRRFCYLQFKTSVAAHSALALDGSAVGNGLHLVVKISDPSRKQDRNGPIYEGREIHVSNVNWSASEDDLKELFSRFGTVELVRLPRKVDGGSKGFGYVVFSSKEEATAALAMHEQEFRGRPLHVKVSAPQGAKRIAATVVTRVGKSQSPAPEANGAPPATDLEEPTGERRDRTLGLMNVPDTVNDARIRALAEPYGKLVKVVLRPDHQGAIVEYADVNHAGKAALELEGQEITPGRKLHIGTVGEMLKQSAEKKAPVQAPKPKDKPKSSFLTPTAPIKRPPQPGGRSGKRGHLGVKRGTAQPTSTTTTMTTTTTNASGEGSKNQKSNDDFRLDESIRSDRIFAVSTVVPRDDTTYLQRLIGQESEQSRIRDISLRRRDQMRTEGEKSQVGLKIERSSGPGPPPPRPQTLGYFKRLSVSQSQRLPASSPTNPRPSTYVHTGLSTPPAPPLRPSPRRWTSISFPAAQTATIRAFGLSIAAIAIPRWVSYHSSSYDYSYGLHRRCSSLTDTCEAFPNREDCIGEDRYFCSMWRTVGFGMSFAVVLEGLSVVAFLIVLSGGKRLREEGWRVLSLLILAGAAVQAGCMGLVAYLVENEPRFFVGWRLDESWIYCTVSWCVSVFSAGAIILAAYSLPSEGVSTSTYSASRAEVSASFEWSPKIVIGVASRNGAVPCSVARPRAASNGADLALPRTEQPESADS

SEQ ID NO: 23472 - protein, 1211 aa, Aspergillus nidulans FGSC A4
MDSGRAQVDASLSQASPDEQLDGPAGDSAKRKAEQPANGTQTRSKRNRHPVTVAATSSWNVRRYAPNCCNNNFKDSEEFRSMKEQIASLQDQVTSLFSSISELRAQRSTFDTPAFDNFSRDGSQVFTSMRPPTGKPRFKHARFHGPTSSAFNFDVARSSLQHMGIAPVEETMPDDITTGHATPAASPPHIPALTQPMHPSKDPIWAIKKDEALRLCRVYEEEIGIMYPLVDIDHVVQQVNLLYTFMEAAIRTGLMHRGLAGTDGLEDDSTNIIKLIFATILVVEGGGQSQLGQRLYLSVKPAIESKIWDTLDVKTIQLLGLMATYHFHTDEDALAYRIIGVASRMCLEMGLHRRDALAKNFPDEAQWPDIVRIFWSIYSLDRRWSLGTGLPFSMHDEDIDQMEPDPSLQYLRCMITYNRIISKVWYSGLGSDGATDIRRDEIGYLDYQVLQWYKQIPDSLKFYPAESPRQGEAASRGLRRLRILLYLRMNQLRILIYRPVLHSAASIAEDKGHAQTVVDVAKDTVRILTRLNQTSDIYRTQQITFNYFLVAALAVLFLAVCHAPNEFNRQVRDEFYLALDLVNGFSTKSYVSKRLWKTIKGLRQIGERLGVLERPYGPDANDPHSTAAVAMAGLAGHPMEDLSVYGALNGVGELGNSPLNGLQMSHELTTLFEAVGGFGNFMGTTAADSINGFIGHEGELQNTGEGLSALRCIKVDAAHRPTRLIWRSILASVDRSPQQPAAKNSPSNAGASSASPPHNQHINDPSAYQEEYHLLTIPRLVRAQHLRSFIRHLRSPAFDSSLLEVSTVSREVGSALADGLDRLDLSQLSESTPSSTVPSDSFDMSSSDGAPESWISSFCQLMGHEFFAEVSEDFIEDDFNLTGLQSQVPMYKEALEMILDVEPEEDEEEEEEEEEEEDEDEILGDEKPPGYRRERRHTRVASDLSMIETSAELLYGLIHQRYITSRPGIQQMLEKYELQHFGVCPRVHCNGCKVLPVGRSDTPGQETVKLFCPSCQDLYTPPNSRFHSVDGAFFGTTFGCLFFMTFPDLEIGPRFDAPLSNISPPRSASLPSTATTTTTTTTTSAGASNQVTSDTPRPVYPVELNGVRTVNFCPGLGEGRVYESRIYGFRVSERSRAGPRMKWLRMKPADITELDEMSRFKALQNYDDDGDADMGEDNAQNANSAIAQRKKAPMRRRRYNPDQMNINGVDG

SEQ ID NO: 23473 - protein, 434 aa, Aspergillus nidulans FGSC A4
MKLSHLLTSAVSVLSLGLTVEGHFSRSRNDAVGPKRPFKPLPYSHPRKKVCHVRSHGDGRDDSAFILSALKSCNNGGKVVFAEEKEYTIGTALDLTFLKHVDLEILGRIQFTNDTDYWQANSFKHTFQNATTFFQLGGEDVNVYGGGTLDGNGQIWYDLYAEDPLILRPILFGVIGLHGGTIGPLKLRYSPQWYQLVANSSDVLFDGIDISGYSKSENEAKNTDGWDTYRSKNIVIQNSVINNGDDCVSFKPNSTEILVQNLYCNGSHGISVGSLGQYIGEVDIVKNVLVYNISMYNASDMARIKVWPGVASAMSEDLQGGGGLGSVSNITYEDMYIENVDWAIEITQCYGQKNMTLCNEYPSNLTISDVYISNMYGTTSSARDPNIGTIVCSSPDVCSNIYVENIDVVSPSGTNDFICTNVNESLLQVNCTSG

SEQ ID NO: 23474 - protein, 161 aa, Aspergillus nidulans FGSC A4
MTALMGASGAGKTTLLDVLAARKNIGVISGDILVDGAKPGTSFQRGTSYAEQMDVHEPMQTVREALRFSADLRQSYDVPQSEKYAYVEEIISLLELENLADAVIGTPETGLSVEERKRVTIGVELAAKPEMLLFLDEPTSGLDSQSAFNSKLTMAMLLTYS

SEQ ID NO: 23475 - protein, 441 aa, Aspergillus nidulans FGSC A4
MSSNDWGMLSHVFLVLSALGEVASFSREPITLHTQAKRFCGPSLGFTLGWIYWLKYMMVIINQITAGVLVLSFWTNLGIGQKAAYITVFLAVILSMNYWSGRFLGRYEVLLSSFKILVVLGLMMLSLVIALGGGPNHKKGFHYWRMPGAFANEEDRSALGVFRAIFRTFPPTTLSYLGTELIGMAVLHTQDSKKAAARAIQQTFYRILAFNLVVVTLLGMAIPYDEDILELSIYTSKRRAMAFVVAVQVAHVTVLPDILNACILIFVVSSASRALCMATRIIRELSLEENAPHFLRRVNKRGVPVYALGGKGAMEESNHSGMVDMRRRHWHSDGDRARNPAGLTSSICPSIEYRLRMERGNARSNNSCNIDGHTVMWAWDPGKQHTDTKHSMKASILTDCIACIYIYVEESERSFVGKALATNAQCGLIERAHSHCFMFPL

SEQ ID NO: 23476 - protein, 341 aa, Aspergillus nidulans FGSC A4
MNSSLYVIPVGATILVTGANGYIASHVCNILLSMGYRVRGTLRSPKPWLTAFFDAKYGTGRFESFILPDLTQRGAWQVAVEGVQGIAHVASDMSMKPNPEQVVPQMVQGVQNALKAAMQQPQVKRVVYTSSSTAAYISVPNKEGVRITRETWHDACIDAAWDKDTPENERGYLVYSASKTSAEKEAWNWVQQNQPHFGFNSIVPNTNYGRILCPEIPATSMTETANLLHGNDSVIRRFPPQWFVDVEDTARLHVVALLSPSAVGKRIFAFAQAFNWTDILTILHELRPDNIHLPPCPKNEGRDLSEIEDAPEAEALMNEFFGTKGWVSLKESLAAGLEGYW

SEQ ID NO: 23477 - protein, 333 aa, Aspergillus nidulans FGSC A4
MGGLFGQLFTKLTLPPASAVDGKTILITGGNTGLGREAARHALALGAATVILGVRTLSKGEEAKADIESSTGNSGRNKVLVWPIDLESFASVQAFAERARNYVAGENGRLDLAIMNAGIASVMWAVTPDGWERHLQINVLSTALLSLKLLPLLRHTAEQHPQDWQRPHLVIVTSDSHESVKFPERTADRIFPVLNDQGQWAKSQRLGGPIERYGVSKLMAILMTEDIARLVPRSTQGDPLVVVNSVAPGFCKSELLTRESVPWFLKVIEALVARSAQEGSKTLLDSATRGIASHGKWLENQAITTPGKLVTDPNEAAYKKKEARHSQSTSEHS

SEQ ID NO: 23478 - protein, 410 aa, Aspergillus nidulans FGSC A4
MFITSAAAFVWANLNPTNYIGSVSFCPERDIPDLAGKVVLVTGETIRQIIKHNPEQVFLAARSEEKAQNAIRELESTAPNIKITWLPLDLASTKSIHDAAETFRAHASRLDILILNAGVMSLPPGETDLGHEIQLGTNHTGHFLLTKLLLPVLLETAQKPDSDVRVISLSSIGHNLAPDFETILHQDELKKCNTNARYGASKAANIIFAAELARRYPSLTAVSVHPGIIVTELYAATSASNPIAALAVKLLGLIATKVEQGAWNQLWAAVGAKKGELVNGAYYTPVGIVKQRNRYVVDQKMGRRLWEWTETELKRDHKEGFIERMLQPHPHHQRRRSSVGEGEIEKPDLAIGLERQSSTERNEQGQNQAESGGQNVLRPQRRNSRLQRLKEFMHSEEELDDAGKTYAKLM

SEQ ID NO: 23479 - protein, 329 aa, Aspergillus nidulans FGSC A4
MSFKVFKGSEKGVIESTTKKPALEGDRVLVKVSHSGVCGTDLHYKAADMVLGHEGVGYVEEVGPDVKDLKKGDRVGWGYEHDCCGRCKHCLSGFETFCPERAMYGFADLDQGSFASHAVWREAFLFKLPDGLDNESAAPLMCGGSTVYNALVGAEVTPTDTVGIVGIGGLGHLAIQFAAKMGCYVIVFSGTDSKKEEAMKLGAKEFVATKDAKELKTSRKLNNLIVTTSFLPEWELFLNVLDNRATISPLTVSDKPFTIPNQEMLVKGLRVQGGIVAARQVHREMLQFAAFHGVKPIVMRYPMNEKGINECMKTLEEGKMRYRGVLAAE

SEQ ID NO: 23480 - protein, 347 aa, Aspergillus nidulans FGSC A4
MAEFIRSDILGTTFETTSRYANLQPVGLGTAGVVCSAYDLISEQVVAIKKMMKPFHSTSVAKRTYREVKLLRHLRHDNLINMSDIFISPLEDVYLVTELLGTDLHRLLNGKPLESKFAQYFTYQILRGLKYIHSAGVIHRDLKPGNLLINENCDLKICDFGLARVQEPQMTGYVSTRYYRAPEIMLTWQRYGSKVDLWSVGCILAEMLLGRPLFPGTDHINQFWLITDLLGNPPDEVIDRITTNNVRNPAPDLQPSNHLEPANGNRRIDSSGALNLLDNLLVFDPDRRISAEQGLMHPWMAPYHDPTDEPVATEQFDWSFNDADLPLDTWKIMMYVHHCSDVVSFTL

SEQ ID NO: 23481 - protein, 199 aa, Aspergillus nidulans FGSC A4
MATGPATQSLKCVVTGDGAVGKTCLLISYTTNAFPGEYIPTVFDNYTASVMVDGRPISLGLWDTAGQEDYDRLRPLSYPQTDVFLICFSIVSPPSFDNVKSKWFPEIEHHAPNVPIILVGTKLDLRDDPAQLESLRMRKQEPVTYEQALAVAKEIRAHKYLECSALTQRNLKSVFDEAIRAVLNPRPATKQRNKKCTIL

SEQ ID NO: 23482 - protein, 187 aa, Aspergillus nidulans FGSC A4
MGVSGAGKTTLLDVLATRVTMGVVSGSMLVDGRLRDQSFQRKTGYVQQQDLHLATSTVREALRFSAILRQPAHLSRQEKLDYVEEVIKLLGMEAYADAIVGVPGQGLNVEQRKRLTIGVELAAKPQLLLFLDEPTSGLDSQTSWSILDLIDTLTQHGQAILCTIHQPSAIPGENPQNTPKSGSTWQN

SEQ ID NO: 23483 - protein, 363 aa, Aspergillus nidulans FGSC A4
MDLRVGNKYRIGRKIGSGSFGDIYLGAFEIAIKLESVKAKHPQLEYEARVYKSLAGGVGIPFVRWFGTECDYNAMVIDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGTLPWQGLKAATKKQKYDRIMEKKMTTPTEVLCRGFPNEFSIYLNYTRSLRFDDKPDYSYLRKIFRDLFVRESFQYDYVFDWTKDKEAEEQARRQGATMPLTTSGAAKPGAISSQRRKIMERGALDNTPDTNRAVGGSDRIHRGFPQLVGSVDFQVYVRR

SEQ ID NO: 23484 - protein, 1533 aa, Aspergillus nidulans FGSC A4
MDGQRQQPYVPAPPPSASQPSQAHIMPLPPPPPRYPPAQPQNVMPPPPPGPPPGSAYGTSKLTNPQLQSQSTLGWSNWGGRGIPQYLPPPPPPPMTHANQSSFARPSAVQNNNATSATYVPQPGTFGPGVGIPPFDVPSHSYDAPNTMVASERPRPPPNAPYGHGTSNASAYQLDGTIPSTPLTHTAPFSHETSHDVPSSAVPTGSPFKSVPQSASQANDLTKSSSHRHNNSNTTVGGMSASEAAVQWPLDRVLLWLAKNGFSHEWQETFKTLEIEGADFLELGHGQNGRPNLGKMHTVVYPQLAKECEANGTAFDLTRERDEGKRMRKLIRLIHDDAGPDNGGTFNKQHDFDDGHGSVPDEGPEFSPNINNVAQAPGSPSLNATNVSNSPNLKAPKYSHKPRSFTTPGSISHDSTTAELAMTEGSSTMLPRSDFSRNVLGTIGIDHQRKSPSMSSDNGVFAIPPHRPHEGSPKSGSPAAQHATLYAAPVSSATDLNAKYDARFGHNRVNSGERRYYETLKHDGSRPSPQTTQTAGDNASSYPKDHRMGFLNFFKKKSARNSDPNNPSPDDNTPDSPIYSKYHFNSSDVSVNERPLSASLSDYERMMMVRTKPAHRGKRFIFATMDGWNYRLIDTTDIDSVEKLRASICQNLGIYDWPDAQIFLTEPGQLEHDEPLNDTFLTLCQRSKSDSIGSLKLFVKTPHNVAGLGVSMPDRSAVSPTSAIPRKPLDGEAASRLSPLKPSSPQQLKPPASRLPLRDIQNSAAGTSPVDGEPDGSLQDQERKPQKSYRPTPAPLPRPDAYSETGYRRKEVINFDKPRISPYEDKKSEVLVPFRKPPSAPQESNTLSKVNSLRKKDGDRPRPHRSNQPPGIKEMMADMGMMSSLIGKPSSPNSGNTTATEDAHSSIDSAVDKSSQSTPPLTNTSYSPTTTATTTTTTTTASSSLSRSASQKRKSVGPEFDFEETQVSFQRSPALEEDSDDDSDDGLFAIPLANTKNSVKPGSPDTQARPRKPSLTVDTEAKPRTGLSVSFKSPSATRETFASSGGDASNSTAPYFIASNSPEEEKTPIRRNSLRNSFATGDVWASRPPVEGVIDQLDDFFPDIDLDAPYLDEQGTSPPSSPASKVAIDNELNRKDKQENSHHGMQPPPAPEDNTLGSSEPTMTSHGQGIVARRNVSRSGGGLTRMKSIREVAKGANQATRQRSVAASSGNKRSGDVHRRKSTKMFGAKIMQISPRRGSQLSQLDPIPQNSISSSSKPQRQPTFRIIRGQLIGKGTYGRVYLGMNADNGEVLAVKQVEINPRLAGQDTDKIKEMVAALDQEIDTMQHLEHPNIVQYLGCERGELSISIYLEYISGGSIGSCLRKHGKFEESVVKSLTRQTLEGLSYLHNQGILHRDLKADNILLDLDGTCKISDFGISKKSNDIYGNDSSNSMQGSVFWMAPEVIQSQGQGYSAKVDIWSLGCVVLEMFAGRRPWSKEEAIGAIFKLGSLSQAPPIPDDVSMNVTPAALAFMWDCFTVSNPSYSSFLRARSEV

SEQ ID NO: 23485 - protein, 232 aa, Aspergillus nidulans FGSC A4
MSSSEYDQELDSLLVGPIPVGVNKFIFEADPPDLRRIPTSEILGVTVILLTCSYDGREFVRVGYYVNNEYDSEELTADPPAKPIIERIRRNILAEKPRVTRFAIKWDTEESAPAEYPPDQPEADGLDDDGAAYGQEEAELEAALLKELQEAEKNESTKGEDHDMEGADNGEEDISDAESEDIEDESDDDEDEVDEEEGNDADEDVEMGDDSEPKDDNANPAAHHSQQEVMVH

SEQ ID NO: 23486 - protein, 258 aa, Aspergillus nidulans FGSC A4
MSESTPANAPKPSSSVKLVLLGEAAVGKSSLVLRFVNNDFQENKEPTIGAAFLTQKCSLPSRTIKFEIWDTAGQERFASLAPMYYRNAQAALVVYDVTKPSSLTKAKHWVAELQRQASPGIVIALVGNKLDLTNDGGETPAETEREAGTEGDDADDNQEEQEDNTPGDARKVPTREASTYADEEGLLFFETSAKTGLNVTDVFTAIANAIPESSLKSGRGAGAGTGQTTLGGGGRSTDDSRVNLGDRGAATAKEGCAC

SEQ ID NO: 23487 - protein, 332 aa, Aspergillus nidulans FGSC A4
MQSTKPFVLFFNPVKFARPFYEQLQKVAHTEVVTSRNRTEFFQDLQDKYRNIFAIYRTSSSGAVAGKFDTEFINRLPPSCKYICHNGADACAKRGIVVTNAPDPVTDATADLAVFLLLGALRQLNPAMNSLRAGRFKTGVAVGNDPQGKVLGILGMGRIGRAIKKRCDPFGLKTVYHNRTVLAPEQAAGAEYVSFDKLLAESDIISVNVPLTGQTKQLIGAAELAKMKRGVIIVNTARGAILDEAALADALESGHVGAAGLDVYEREPEVNEKLLKQERALMVPHVGTHTAETLAKMETWAMENARRAITGEALLSPVPEHQGLALQARSRV

SEQ ID NO: 23488 - protein, 495 aa, Aspergillus nidulans FGSC A4
MGRLYTFNLALFAATGSFLFGYDSGVMTDVIASKNFLRYFNTTKTSAIIGAINSTFSGGAAIGALQGGLTMDRFGRKFTIQMGASICLVGAILQAAATNLAMILVGRILAGWAVGLMSMSVPVYQSECAHPRNRGMIIGLAQQMIGVGFIVSTWIGFGSLHAPESSEFQWRFPLAFQVVPAVILLIGLFFLPESPRHLIGKEKYEEAMKVLRKLHYDGTNEDWIQREYGEIKSTIDAERAVTEPGWLVMFKVPQLLTTADRYRHGVLVQVFTQMTGINVINYYQTIMYENLGITGSTNILVTGIYNCLGPLANLLFILFVLDKVGRRRPMLFGAIGITIALFCEAALNSQNEDGHRRGYSIGGVFFIFCVTIIFSWSFGPCSWVYMAEVMPMQIRGRGNAFATGVGNWTVSTLWSQVSPIALGKIGWKFYFIFAGWNICVTLPVVYFFFIETKQKSLEEIDILFGGRALGTLPEDIADKDNEVVATTEHHDKREV

SEQ ID NO: 23489 - protein, 474 aa, Aspergillus nidulans FGSC A4
MWSPFLEVAKALREGHVVEFITQKYNEYGWTFEQNVLGRSGISTIEPENLKALLATQFNDFCLGTREREFGPLLGQGIFTLDGAGWSHSRALLRPQFTRDQVADLDLMESHISRLIELVPKDGSAFDIQRLFFLMTLDSSTHFLFGESVHCMDEGNVLARSTVNNAQGFANAFNTALDYLNWRSVAGNFYWMITSKEFRDANKRVHEVVDYYVHQAIEAKRHPEKKEPGRYIFAEALAADNDNPKVLRDNMLNILLAGRDTTASLLSSAFFYLSRHPAVWEKLRRVIIEEFGDVQNPKGEITHAKLKDLPYLRYVLNEVLRLQPPVPLNLRVAVKDTSLPVGGGPDGKSPVFVEKDQPVLYSVYAMHRRKDLWGPDADSFRPERWEENAKHGWEYLPFNGGPRICLGQQYALTEASYTMVRLMQRFSKVENGEPGLDEPLIRATLTMSHENGVKVRFKLQHVRRKPSPLQTCTR

SEQ ID NO: 23490 - protein, 1387 aa, Aspergillus nidulans FGSC A4
MFQINRELAALGIEWNPRRIYYLETWRYPEVESPTRWNIRDGLLEDFQVEEWLNQRGEFSPPVPPAEVGNGSHGGIRLLACNYHLFPKISVGMSPETFGLAPQKYEIGNYMLSLTYDMSSHWTTALLAGESIVDTASTIFNRSSLPLAPLSPCDVVREYLMSSPTLWDHPLMLPCIVLSHHLRRLQHHCNRDLTPIVMGIEAQLGVTRVGRRNFDARPRSINAIKDGPVARVQSEHLTVTINTQLTRVGFTARNPKWNYEASALLEKIVTELAAYTPALRPEANEEILGVLDHNITLAKSLEDNVLGLQKRLELQLNVLYSFVAQTDNRLSARLAATAGRDSTSMKILAFITTIFLPGSYVASLFSMNMFNWEDGASGSEGPGSGGSTISPQFWIYWTVAAPLTALTLAGWALWWSFEKHRYDEHLEGNRQDTRVKIPPWWRRILETRHTLNPGLADDYLRFAQQRYETSRPRSKAQHQRATSHLPGGNTRSVLHATPFPLCMQAGKGNRLVDVDGYEYIDCMGDMTACLYGHSHPVIMETVDSTMKSIGMNLGSSTSAEAHFAEALCDRFASIDHIRFCTSGTEANLYALSVARQSTNRTKVIVFEGAYHGGVLSFSHGIAPNNVDKDDWILGQYNDIDGAVQLITENKDIAAAVVVEGVQGAGGCIPGSAGFLHAIQDAARENGIIFILDEVMTSRLAPGGLQSILLHPDHGTPLKPDLTTFGKWIGGGLSIGAFGGRRDLMSVYDPRTSIIHHSGTFNNSTLAMNVGCKGLTSVYTPEACTSLNNLGDELRSGLQELAKGTKMVVTGLGAVMNIHFVRASGSRVVARTSDLEVNSGSVEEALRDLLWFYLIERGFWIARRGMISLILGTGVEEVEQLKGVVGDFLEDFRELVSAYLLPVAALATAVSTHPQTPSDLIVATSSGIVHGIYNDTAHKVRAFLGIPYAEPATGDLRFAPPQPRAPSQHPINASSFGAPCPQVYNYDNESIWNVLPYRIRNVEDMSEECLFVNIWTPAEHQTKKSGAGRKGKAVMLFIHGGGFGEGAGSVGFYDGVDLASSEDVVVVTFNYRLNVFGYPNAPGLDPAEQNLGLLDQRLAVQWVHQNIANFGGDPDRILLFGQSAGGASVDAYAYAYPEDPLVSGFVLQSGTVSLFNNADTAHANWNRLSTAVGCSAGDGSLACMRSVSFSRILEVLGNGSYTFTPVADNRTVFSDYIARAKAGGLARLVRIRTPLTRCQPTLAGINAREFSAGFPLSQSSINETAVTEDLFGSFSCPAYQAVKTRLRQHIPTWRYVYHGNFTNLSPKPWLGAYHSGAWVAFAQNRHTGLEDYGWPLFTFNETTLVNLAVDNRPGAVLGSAEDWDRHCRGDVYIGYTIPDSLQLHVYNM

SEQ ID NO: 23491 - protein, 1664 aa, Aspergillus nidulans FGSC A4
MYWDLGVLLVHCRCGLAGHAATGPLCLRASIGSELRFEAIGSDVVSLDVSFRLLDKLQSEGARLAIAEQALHSASGFRSVCPAIPDFSSTLSTSGRKTFSLFQRVCGTSPWGIAERVWPPSPCAPREKGSDLYIPSETRSKAHASPLVTLAAGSQYRHIICDNSTMTSSINSRPAAGAVAHSSLARRTVGRPDDDPAALVLEAWSQGLMTGSLVIMAAVTFANMRPGVLLHKLILLELILAMAHGTFIFAPEPVYGCLISMTVTASANHGWTSDPWWIYTTCNIFWVVKTHYNFGILELVRECPRFGLMLASMCLSIVFIVLDVISVTGALDAAMPLGINPFWKCLCDTIILDDFKTALDKLSARWLARNGMNGVHASGNRPFVRNRIITPFSVFSAWWTAYADPHSLRPSSGTGASRSWEDHKHDAIGPATQEQGSRVPLDFWGMTVDSVPSGMGWFYYTYCFGLEPRAHSLLVTLSAFFGLVLTACKQPWSIRLQSPEQTMDPHSLPAHDTRRRRNALACNTCRRRRTKCDGKRPKCSFCVERGKDCFYQEPQDLPPSPLKAELSRIWEQLDHIAAIVQGRNPRSSPSPNEQQSHAPLTAPGAPQGFPFMTVQSEAFLILLGLDKYLPMHLEHVERGRQIISAKPSLESIVMVDLADASVLLHAFTEQIYIWYPILHADFTNEFLEAVTSCFPFSLSSCLTLLVLAIGCVVKCESIVDALQARPEAAYIQAASAMLPCVLADSSPRSAQCLLLFSIYHLCYAQPCQAHDFVVMASRKMQNYMLKCVERVPGRVSRTGDDVLTSASRSEPDIGNDTTIIGNCFWIALLIERYPDLRAKKSNLDKLTICSELRVQLDFVDSGIWNMALFAPAPTASSIWTWRELTPSLDSPGSFTSNESVDLSRSDDLSYFVAEIAMRKMLQRCTWATSTLAQGRHVYAPIVAVELERQLDEWLQLLPEPLSFRGRGSTCIGSRPLRNSDSAQVEFLRAQYYAFKASIYWPAVYEALLSSETDGNLIRHCAKFFSSYAEFVPSAAAAVAVCKPNLWTLCASVFTFSMATLLALTEPCLAEVVPQGVYLGLEVAVNVFDGLAEFAVEIDVNMNCRHTAKQQDKQHLRPRHLLPFCDRHKTMGILFKKPEGTEGKAWPAILISGFVAFGGILFGGILAMPYWAQTFSTGYRDSTGQLNVTSSQSSAIVSILSAGTFFGALGAAPVGDIIGRRWGLIASNGVFVLGVVLQTIATSIPPFLAGRFFAGLGVGLISALVPLYQSETAPKWIRGFIVGSYQFSITIGLLLASVLNNATHHRNDSGSYRIPIAVQFAWSIILVGGMLILPETPRYLIKRDDTKAAALSLSKLRRLPQDHESIRQELSEIQANHQFEVSLGKSGYAECFRGSLLKRLLTGCGLQALQQLTGINFIFYYGTQFFKNSGFKNEFVITLITNCVNVGSTIPGLYAIDKWGRRPVLLTGAIGMAVSQLLVAVLGTTTTGQDAQGNIIVHNAAAQKAAIAFICLYIFFFAASWGPIAWVVTGEIFPLKTRAKSLSMTTATNWLLNWALSFATPYLVNYGDGNANLQSKIFFIWFGCCFLCIGFVYFMIYETKGLTLEEVDELYLEVKSARESVSWSPKGTFARVAEKGNGSAGILERTEKGDVGGHREIGAPDGVSV

SEQ ID NO: 23492 - protein, 492 aa, Aspergillus nidulans FGSC A4
MSLASLKRKDLFQQHGLIGDKWVSSSGGGTFTVTNPATLETLATLPEMNGADTESAITAAHTAFQSFRKTTARQRATWLRKWHALCVENIDDLALILTVENGKTLAEAKGEVLYAASFLEWFAGEAERVHGEVVPASNANQRILTVKQPLGVAACLAPWNFPIAMITRKVGAALAAGCTTVWKPAGETPLSALAQAVLAREAGFPSGTINVITTLNSVAEVGAALCNSKLVRKLSFTGSTRIGKLLASQCSQNLTKLSLELGGNSPFIVFDDAKVETAVEACILAKFRNSGQTCVTANRIFVQEGIYDRFSAALVEKVKALKVGNGVEEGVIIGPLTHERAVEKAVAHIKDAQEKGASLLLGGSPCQPNNLPGYFLEPTVLGKMSTEALTTREEVFAPVVALYPFKTEEEVLAKANDCDVGLGSYVITESMPRMWRVAESLEVGMVGINMGTLSAAESPFGGVKESGYGREGGRQGIEEYMTVKSILMNVAA

SEQ ID NO: 23493 - protein, 330 aa, Aspergillus nidulans FGSC A4
MRAVAIKGGKGPADALYIDNIPVPEYGPSQALVKVKAFGLNRMDLLQREGQYPVPPQAPATLGVEFSGTIAELGDGATEDFKVGDEVFGLAYGGAYAEYIAVATGMLIHKPKELSWEEAAGIPETWITATQALHLVGAFKPGNSVLWHAGASSVSIAGIQLAKAAGASAIYVTAGSDEKISFCVNQLGATAGFNYRTQNWAEELSKATNGRGVDVIVDYIGAGYFQDNLKSAALDGRIVNLAFLGGIKVENVDISYFLRKRIRYEGSTLRSRDEEYQRKLRNMLVDNALEKLRNKEFKVFVEKVFKFDDVVEAHKLMESNQTKGKIICTI

SEQ ID NO: 23494 - protein, 268 aa, Aspergillus nidulans FGSC A4
MDPAQPPVAEAPVPEAEPQHQDQYQENQPEHQHHQTELDQPDQMSQGLSHMSETETPTIVPTAASEEPTLPSTSYHNGYSSDSRAHYEYHTPTQDPQPQPPTSSRPSSGLSGTQKQPAQTTKNSVVIKVGMVGDAQIGKTSLMVKYVEGSWDEDYIQTLGVNFMEKTISIRNTEITFSIWDLGGQREFVNMLPLVCNDAVAILFMFDLTRKSTLNSIKEWYRQGRGFNKTAIPFLPPPLALLGSDSLGQTLRKGDESQFDFQQYQPQH

SEQ ID NO: 23495 - protein, 510 aa, Aspergillus nidulans FGSC A4
MHLWKHDFRGRVLVVAIALASCQAFLLLGFDQGVMSGLVGADNRFGRDFDNPDANMQGNITALYDIGCVLGSIVSYFVGERLGRRTMLIAGGGIMVIGTVILASSDTVAQLIVGRIVTGVGNGMNSSTAPVYQSECAPAAYRGALLTLQGTVTILGVVIAYWMDYGPSFTESSLQWRFPLAFQAVFAIFLVLQVIGLPETPRWLVQHDRHEDAREVVAAITDRDVNDPQVVRTVLDIQVGLEEEQKGGPFKFKELFAWGEEQNLRRLLVIISVELGQQFTGSNMINYYGPVMFQTTMNMGRNLSMILGGAIQCTYLVGSAIPVLLMDRFGRRTLLIVCSVGLCFCFVMVSILLSLGSTNAAYGATAFIFIFQIFYGIGWLPVPWFYPSEISTTRTRTRMQAIASAWNWMAVFAVVKITPLAFQNIGWRTFVIFAVLNAAFIPMVYFFYPETKGLELEDIPLLFSKGGFTGGVFSSKGGRTVTPGQHAMQTNVDRKVERMGIELEQVETVA

SEQ ID NO: 23496 - protein, 500 aa, Aspergillus nidulans FGSC A4
MYRINNIYVLAAFGTIGGALFGFDVSSMSAFLATDQYLEFFNHPNSDLQGGITASMSAGSFAGAIAAGFIADHVGRRKSLMVASLVWIIGAVIQCSAQNVAHLVAGRVISGLSVGVTSSQVCVYLAELAPARIRGRIVGIQQWAIEWGILIMYLISWGCGKGIAGPSAFRVAWGVQAVPGLVLFLALFFFPESPRWLASRERWEEALDVLAALHGKGNRNDPVVQVEFEEVKEAARLAAEAKDVSFFALFGPRIWKRTLCGVSCQVWQQLLGGNVAMYYVVWIFQMAGMYVIFVATTGVILPYIDRIGRRLLLVSGAIICMIIHYAIAAVMATRGNPVDEINGNASLKWEITGASGKAVIAMSYIFVGVYGLTWAPAAWIYASEVFPLKYRAKGVGLSAAGNWIFNFALAYFVAPAFTNIQWKTYIIFGVFCTVMTFHVFFMYPETAQRSLEEIDLMFDTHVKPWQTAKLQDRFEEEVERQRKQSVAEAHVGDASHKEEV

SEQ ID NO: 23497 - protein, 469 aa, Aspergillus nidulans FGSC A4
MAEVARPSPLGESSSQDTSDKQVHPTLQETDHGAETDLRRTLSTRHLTMIALGSSIGMGLWLGSGTSLRNGGPAALFIGYILAGTMIWSVAHAIGEMAVLYPLPSAFVQWSSIFISKELGFAVGWAYWFSAFITIANELQVGNPPYLTFFAHCQLNPTPVVSAGGAPNHEAVGFRYWNAEPFTNGFKGFLSVMPTCIFAMSGSENSALVAAETQNPRRSVPRAVGSIWLRLSLFYLLGAVVVTITVSPEDPNLFGASGTNASPFVIAYTNAGIPHFHRKDQPNTEEQIFGRADRKGRPVAGLVVTLLLGGGFSYLNVSQSGADVFSWLSNLTSLFTLFGWGSICASHLRMRYAWKNQGRSEADLPWKTWTYPYASWWGLSWCILLIIAEFYLSVWPLHTNPNVTDFFANYVSIIVVLVVYLGARLWYQGPWWVDAASIDLDAPRRFYAPDDAEGKKVNVLEKSVGWIFK

SEQ ID NO: 23498 - protein, 388 aa, Aspergillus nidulans FGSC A4
MGSLSPLEPLFTPLRIGAFALQHRVVQAPCTRMRSTKESDGIWVPNDLNVEYYAQRASKGGLMLSEATPISRDAAGYPGVPGIFTPSQIEGWRKVTNAVHTKGGLILCQLWHVGRATTPGFLGGKTPLAPSDIPISGKALDGNVYADAPPRPMTVDEIKEVVLEYAAASKRAIEAGFDGVEIHGGNGYLLDQFLHDNVNNRTDAYGGSIENRSRIVLEIISAVTEAIGAERVGIRLSPYNYFQDTRDSNPQKHWGYLCTQIASLPESSRPAYVHMIEPRFDEILDESEKISALETMQEVVKPSLDGLRSSLKKGGVSFIAAGNFKPENAGEKLITDSADAIAFGRLFISNPDLPRRLKEGIELTKYDRSTFYGATPPEKGYTDYPFAQ

SEQ ID NO: 23499 - protein, 503 aa, Aspergillus nidulans FGSC A4
MGLELRSMVLVSLARIYQTGFKVRRPLLAVATTNFQNIINGEKTSTTERRHGINPATGEPNPDVPVAIKEDVDRAVVAAQEAFKTWIDVPFDERRKALLAYADAIEEYVADFAKLLVQEQGKPLQFAANEVAQSAQVIRSAADVAEGLTDEIIEDSAEKKIVVRHIPIGVGAGIIPWNFPHLLTVVKLAPALITGNVIIIKPSPFTPYCGLKLVELAQRFFPPGVVQALSGDDRLGPWLTAHPGIGKISFTGSSATGKKVMESASRTLKRVTLELGGKDAAIVCGDVDVQSVAPRVISKGFFNSGQICLAVKRIYVHESIYNEFRDAAVAYAKTIEVGPGTQEGVFMGPLQNSMQYEKVKGFFADLTKEQLSLTHPDGKAFDNKAGYFIKPTIIDRPAEDSHIATEEQFGPIMPLFSWSDESDVIARANNTQMGLGASVWSRDLEQAARIAAKLQAGSVWVNTHFEADLRAPFGGHKESGIGTENGLQGLRQWCNLQTLYLKN

SEQ ID NO: 23500 - protein, 380 aa, Aspergillus nidulans FGSC A4
MNFMNSTFSSTTPETYWDHYDDISAHSSHLNVAERLWAAWYAWMQNDVLATGIMSFVMHELVYFGRSLPWILIDTLGFFKNYKIQSSKIPSLREQWDCAKFVLLSHFTVELPQIWLFHPMAQFFGLSTSVPFPSFWTMAYQIAIFFVMEDTWHYFSHRALHWGPLYKAIHKIHHQYSAPFGMAAEYASPIEVMILGFGTVGCPIVWCAATGDLHIFTMPLMHTVGMSSHGVYTTFFLFGLEQIITTFTTRSSLATTPAVSGGGIMFWTQSTVPRRSGGGGITRRSAVRRKPNNAIVLEVSWNGINMSIVTPLARSTSPDMLIWDRGIPRHIDSPTAHRLGEVPGLEEPPRFSFDYIGHSSSFNNPLWDWNPYPVNGADLS

SEQ ID NO: 23501 - protein, 359 aa, Aspergillus nidulans FGSC A4
MAPFSIKRAKKDQPQAGQPKKAAPAKPDQPTYKKRAQLTQMFPPRPTFTEKDITFQKGRVFLVTGGTSGIGFELAKILYARGGTVYITGRTEEKAKEAVQKIQASVGERDGQIDYIVLKLDDLTSIRESADAFMEKESKLDVLWNNAGIAQPPVGVLSKQGSELQLATNCLGPFLFTQMMLPLLDAAVALNGPAYPGSVRVVWLSDQVVELSSPIEGIVMQELNNPPQDNSRNYLNSKTGAWFLGSEFARRYGPEHGIVSVAMNPGAARTNLLRHAGWTKFLSWPLLHSPKLAALTELYAGLSPDINLENNGCYVIPWGRIHTTVAPHLMNALRSKEAGGTGRAQQFWDFCDDKTKDYH

SEQ ID NO: 23502 - protein, 379 aa, Aspergillus nidulans FGSC A4
MASTVGKTITCKAAIAWAAGEPLSIEDVEVAPPKAHEVRIQVLHTGVCHTDAYTLSGKDPEGAFPVILGHEGAGIVESVGEGVTSVKPGDHVIALYTPECRECKFCKSGKTNLCGKIRATQGKGVMPDGTSRFKARGKDLLHFMGTSTFSQYTVVADISVVAVTDKIPTDRSCLLGCGITTGYGAAVVTAKVEEGSNIAVFGAGCVGLSVMQGAVKNKAGKIIAVDVNDAKEEWSRKFGATDFVNPTKLNGQTIQEKLIEMTDGGCDYTFDCTGNVGVMRAALEACHKGWGESIVIGVAAAGQEISTRPFQLVTGRVWRGCAFGGIKGRTQLPGLVDDYLDGKLKVDEFITHREPLANINTAFEQMKAGDCIRCVVDLS

SEQ ID NO: 23503 - protein, 327 aa, Aspergillus nidulans FGSC A4
MQNLKFLIAAVSCLGPALAAPTPTSNFINSNFNKRASVEDSAFGYASLNGGTTGGAGGTTTTVSSYAEFTAAVQGDDPKIVIVSGPIEETAEQVDVGSNTSILGADSSAVLTGFGLRLKEVENVIIRNLGIAKVLADNGDAIGAEYSNNIWIDHVDVSSDRDHDKDYYDGLLDFKRGSDYITVSNSFIHDHWKASLVGHSNSNEDEDSGKLHVTYANNYWYNLNSRAPSIRFGTGHIYNNYYETVSDGINTRIGAQVLVEGNVFVDSKKALYSTDEGYAVERNNDFGDAKNEALEGTLTSVEYEYDLLDTSEVKSAVVGTAGQTLTF

SEQ ID NO: 23504 - protein, 452 aa, Aspergillus nidulans FGSC A4
MGSVDHVEAFFDKADKYLMSTGVPYSPFVVTKAKGTRLYNQDGRSILDFTSGQMSSLLGHSHPDIVEVVKQYIGELDHLLSNMITHPVVDLAERLARFLPAPLEKSFFLNTGSESTEAAIKIAKVYTGNFEVIAFAASYHGLTQGSGSVTYSAGRRRGGPVMPGALAFPAPYAYRSPFKKADGSYDWEAELDFGWSMIDRQSVGSIAAFIMEPILSTGGILDPPKGYFKRMVEECRKRGILVIMDEAQTGVGRTGQMFAFEYDGIVPDILALSKTLGCGLPLASVSTTAEIAKGCKEAGFLWLSTHINDPLTAAVGNKVLEVVERDNIARRAAERGAQLREGLVKLQQKYWCIGDVRGRGLLQGIEIISDPETRAPGPELGQAVSDQAMTKGLSCNVVNLPGMGGVFRLAPPVTVTAEEIEEGLAILDEAFGDVLKTWSASESDSKLGGLFK

SEQ ID NO: 23505 - protein, 512 aa, Aspergillus nidulans FGSC A4
MSFFKNSRVYMLSAVAYMGSFLFGYDTGVMGSVLALDSFKHDFHMATGSTGFASSKEAEISSNVVALLTAGCFFGAIAGAIANDRYGRKNSLLVLSVIFMIGAAVQTGGRGTIAYIYGGRVIAGFGIGGMSAITPIYVSENCPPNVRGRIAGLFQEFLVIGVTVSYWLCYGVEKNIAPSTKQWRIPIGFQLVPSGLMFIGLWFLKESPRWLMKQGRREEATASLAFTRRADPNSDEVQQELAEIRASIEEELRSTEGVTWREVLLPGNRLRFLNAFLIMFWQQFSGTNSIGYYAPQLFQTIGVASTDTSLFTTGIYGVVKVVSTGLFLLIGIDRFGRKWSLVGGGWAMAVFMFILGAVLVSYPPVNTDTISNASIAMIVMIYLYVISYSASWGPIPWVYISEIFPTRLRAYGVGMGSATQWLFNFVVTKFTPSAISNIGWRTFIMFGVFCFAMGLWVCIFIKETKGKRLEDMDDIFGGKTVEQMQKDIEQADVEEQTEVEKTQTRHEEQVVR

SEQ ID NO: 23506 - protein, 402 aa, Aspergillus nidulans FGSC A4
MAHGQEDCASVLEQFVHDVANLPLEINHLMEEIQAKDKIIQECRAIINSRDASIQKFIKLNGSLTPNPKEEQYSKIVLQNLDKSSQLQDEKIQLSEKACILLDRQIKKLDIKIRDLQNDGVLSNDPPIPSLFNNKDQYRDPPKIFFPDSSNDSASYTSPLAASSGNANPTPRLSLSLNRPHSAAALSQTARSSAPATPAATAHFQQRQRESSAGAIDSKRRRLNATLGSLPAASSNLRQSSLGPGTPKAGTPASSRAGSAGPRSAGVTKKALTKKVAPHQQLKKLKSLNGKHTKRSSSTSRVKSHKKSPSGGDDDDDESMLSSAELSESENGDMHIDEEEEDEGNEDTKVYCTCRTVSHGDMVACDNDDCKFEWFHWKCVGLTREPVGKWYCPDCLAAKGGE

SEQ ID NO: 23507 - protein, 1068 aa, Aspergillus nidulans FGSC A4
MSAHDEFEPSSPDFVPVHETVPLNRSTDLDASGAYKLNVNVLNRAIQEIGMGRYQWQLFGVVGFGWACDNLWPIVTSLILLPVTYEFDVSQPPILLLAQNIGLLLGALFWGFGCDIFGRRVAFNMTIGITAVFSLAAAAASSFAAVCILSALWSIGVGGNLPVDSAIFLEFLPGSHQYLLTVLSVNWALAQLLANLVAWPLVGGHTCSSADGCTRADNMGWRYFTAAMGGLALLMSITRYFLFTLLESPKFLMGKGEHYDAVAVVHEVAKRNGKTCNLTTDELHDCSDSGAGYRSGEYHRQGLSARDQLKLFLEPFSMTQIRSLFSTRRRGLATTLMIIIWGLIGIGFPLYNAFLPYLQHERGIEFGDGSTYLTYRNSLIIAVASIPGSLVGGVMVEMPQLGRKGTLTLATIMTGVCLLASTSASTSSALLGWNSAYGFSSSLVYAVLYAYTPEIFESRNRGTGNALVSASNRLGGILAPVVALMTDLQSTLPVYYGQREYNEPEVLITVQFRCCQMPALYLEARPTMAFAYDHDAEFWGALINPDKSPSPLLEQLCLGIAQLMTTFDNLPIADLTPARLAQFYRKVGGNYDVLFLETKPSALSFIYQRLGCFHSIQPSSDPYKPPSIPALQPHGFVRWQTIQLLLDPDEHVSYLQNAVERWDIFSPNGTLFPKTIPREAFPGGPDPEMIQWHETVSQKFEFDYWKKNLMDASPKSDPYNSKCAQKETPTPNKEEEFSQNHHPRASSHRYAVPAEAQTTRRHQRRQSADVPKTSHKSQTNLLHRSAEFVSGYTSPRAPSPPAWPKHASKSRGRERKSYSRPASPEYAHGHSASDASSEDSGTATQEPISPRYGHHRNLSPPHAPHARRHSHEAYSRRPHRELSPDSQRRYAYREAFNFSSNRPYDSDSGRGPRQPRVYIDEVRQSRTPGPSPSYAEPVFRESATVPTSPVYGHAHPLPIHPIHPRFVNVASSGPNPAYMVHQQMPMQVPPELDANVMDDPRRNGYRGSQTPNPSGSGSGVTYRRPRFASVGDFQPPGWSSHAVHGKGRPVPPGVLEAEYGRRSSMYDR

SEQ ID NO: 23508 - protein, 448 aa, Aspergillus nidulans FGSC A4
MFIGGLNWETTDQSLKEYFSQFGEVQECTVMRDSATGRSRGFGFLTFKDPKTVNTVMVKEHYLDGKIIDPKRAIPRDEQEKTSKIFVGGVSQEATEQDFKQFFMQFGRVIDATLMIDKDTGRPRGFGFVTFDSEAAVEAALSRPLEILGKTIEVKKAQPRGNLRDDGDRGRRGRDFRDGSQGGSDGSQQQAGAQGQGVMPGGLTPQMMAQYWQRMQQYFALMQQQMAVAATQGQGMGAMGMAGMNPALMQQMQMKQLQQMQMGNNQQSPSMSPPAQSPTPQSMQNMMNPAMMQQMQQQMPNQGQANNMGGQMGMGGNGSGNMNMGSNYAGGGRGGPGYNAHEQIAFEQQKYEQQQARRAMENRAFSPYQQGGPTSWEGMYDEVPQPNIPTGPQAMNRSSSVGRGQTPQPQGAAPANAPTGPKNAGKPGANYRGGGRGGHRGFHPYARG

SEQ ID NO: 23509 - protein, 502 aa, Aspergillus nidulans FGSC A4
MRSFATVVTAFCGLVLSSSSIVSAKSIESKLLPADFKPPQVFKNVNLVRNTNLEKGYARETINVVIENVDKQPQSEYYLSFPSDIFEQIGGLEVRNKKEADKGRFDVEASEVDPFSDVRYFIVHLPEPLAPSSQLTLGISYSLLNSLHPRPAAIKQSDRQFLTYSFSAYVPSAYQTVTQKTKVKFPSANIPDYTTTELKSGADPERQGTTYIYGPYETANVAPGTSYPITVRYEFTKPVITVSLLERDLEVSHWGGNLATEERYWLRNNGSKLLTQFSRVDYTVANYQQSPSTAIKELKYPLKPGSVDPYFTDDIGNVSTSRYRPGLKNREANLEFKPRYPVFGGWNYSFRLGWNNNLSSFLRRTVSNDDSYVLKVPFLEGPKMGEGIQYEKVVVRVILPEGARNVRYEIVEGPTSNGLPSASQIQSSLSTHKTFMDTLGRTALTLTVESLTDEARDSQLVVTYDYAFWDGMRKPITITIGLLSVFAAAWAVANIDVSIKKR

SEQ ID NO: 23510 - protein, 192 aa, Aspergillus nidulans FGSC A4
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQVDLRDDPAVRDKLARQKMQPIRKEDGDRMAKDLGAVKYVECSALTQYKLKDVFDEAIVAALEPAPKKRSRCVLL

SEQ ID NO: 23511 - protein, 430 aa, Aspergillus nidulans FGSC A4
MKLTWAGLWALAGTALCCSHHDEESVPQEVREELLKKWNQEWSFSGHASFAHLKPVKCLVEPDEKYDIAIIGAPFDTAVSYRPAGARFGPRAIRAASARQMAGTSYNTRAGINPYSSWATIKDCGDIPITPFDNGLAERQMYEAFLELGTRSPVTPASSEYGSKGISAGKSKLVTLGGDHSVALPALRALYQIYQKPITVLHFDAHLDTWNPVRYSAYWQSEQSAFNHGSFFHKASREGLICNSTSAHAGLRTRLTGIDDSDYTAPGTPEQGFMRIHADDIDELGGPMGVVNKIMERIGLDLDQPVYLSVDIDVLDPSTAPGTGTPEPGGWTTREFIRILRGIEKLNIVGADIVEVSPSYDNKGETTALAAAQVAYEIITSMVKNGAGKDLGGWYGRKESVTQESVPVVDAEAEVEAEVPEPESVLKDEL

SEQ ID NO: 23512 - protein, 249 aa, Aspergillus nidulans FGSC A4
MSDPDVPESNKAFVPLENNPEVMSHLVHQLGLSPSLGFTDVFSIDEPDLLALVPRPSQALLLVFPVSKSYESSRIAEDSSLPEYTGSGPNEPVMWFKQTIRNACGLIGLLHAVSNGEARKHILPGSDLENLLKEAEKLDPIRRADLLYESKALESAHADAAKLGDTKAPGAEDDVDLHFVAFVKGEDGRLWELDGRRRGPLERGVLGDEEDALSERALELGVRRFLDVEAKGGNPDLRFSLVSLGAVFD

SEQ ID NO: 23513 - protein, 276 aa, Aspergillus nidulans FGSC A4
MSATNYVSPTSSTSTPTWHHFERKVDEVKPSKTLVMDYLVTNGYPAAAQKFALEANIEPVDVESIRERVEIRTAIYSGNIQAAIEKINELNPQILDENPSLHFSLLRLQLVELIRSCSVNPDGDITPALEFATSQLAPRAPTNPQFLEDLEKTLALLIYPKENLTPSLAPLLHSDLRRDIYAKVNAAILQDQGARTEALLCDFARLYAWAEQKAREAKKDIPDKLDLGLGESNNTSALGGVVACGASESFKYFQHNIEAIPNDARILHDPFASIKA

SEQ ID NO: 23514 - protein, 2020 aa, Aspergillus nidulans FGSC A4
MDTVQETKSSASKADYGATSIPDVELVKGEVGIADQLEMPMKRKFNILSIIAVGYNISNSWVAIAASFAIAIQSGGALSLLYGIIVVTFAMLCTGVTLAELASVYPTAGGQYHFTSILASRRWSRGLSYFSGLAAIFSWICLGASIGLSGTNALMAIIIRWQPAYQPASWHYFLVYQLFNILVVVYNMYLANKTLWIYNIGSRSEVHVDSKEIWAIMTNGSGWSDGISFLTGLSTPQFMLSGIDATLHLAEECLDPERVVPKAVLATVIVGFLTAFPFAIAISYSYRDVAESLSTNTGFPIFFIWEKATHSPAAATVFMACLFVISCVAFNAVHQTASRLTWSFARDDALFFSKKLSPVHHSLGVPVNALVLDGILVFLVGIVYICSSTAFNSFISTTVIVAQVSFAIPALLVILRRRSSHFLPESRPFRVPNVVGYICNVVCIIWAVILTVFFCFPAALPVTGGNMTRAWDPCEHPSRTLVPGPNHASYQRDCDLHNCLHYPKESKTCNWIVIPPAWEALNCTTHRAGCSWVPVPVSPSGDVAPPGAVQQPSETVSRITDDNGAPSTAKEKAESSDITCASSEKDIDRDRKDIDQESELKITALARNLSRLSQKSGAVDGTNTFLDSSSDPELDPNSGQFNARKWTKNFLSVANRDPDRYPRRTAGVSFRNLSAFGYGTAADYQMDVANMWLKGFGWIRRKLGFVDRVRIDILRDFEGFVRSGEMLVVLGRPGSGCSTFLKTIAGETHGLWLDDGTDIQYQGISWDEMHSRFRGEVIYQAETEIHFPNLTAGETLLFAAQARTPANRFPGVTRDQYAHHMRDVTMAMLGLSHTMNTLIGNEFIRGVSGGERKRVSIAETILCGCPLQCWDNSTRGLDSSTALEFVRNLRLSTEYTGSTAIVAIYQASQAIYDVFDKAIVLYEGRQIYFGSASDARRFFVEMGFECPDRQTTGDFLTSLTSPTERLVRKGFENLVPRTPDEFAERWKQSAERKRLLEEIEAFQNEHPLGGSKYEEFTRSRAAEKAKGTRAASPYTLSYPMQIRLCLSRGFLRLKGDMSMTLATTIGNSIMALIISSIFYNMNGTTEKFFSRGALLFFAILLNAFSSALEILTLWQQRPIVEKHYKYALYHPSAEAISSMIVDLPAKVLVSIVFNIILYFMTNLRRTAGHFFVFYLFSFTTTLTMSNIFRWIGAISRSMAQAMVPSSIFMLILVIYTGFTIPVRNMHPWFRWLNYLNPIGYAFESLMVNEFSGRRFDCAMYVPDGPGYADVPLSSKICSGRGAVAGQDYIDGDTYLNTSFQYYRSHLWRNYGVLLAFMFFFLAAYIICSELVRAKPSKGEILVFPRGKIPAFAKEVRRDEEDAKTVEKPQLVGEKSDDHVGAISKQTAIFHWQDVCYDIKIKGENRRILDHIDGWVKPGTLTALMGVTGAGKTSLLDVLADRVTMGVITGEMLVDGRLRDDSFQRKTGYVQQQDLHLETSTVREALIFSAMLRQPASIPRKEKLAYVEEVIKMLGMEEYAEAVVGILGEGLNVEQRKRLTIGVELAAKPDLLLFFDEPTSGLDSQTAWSICSLMRKLADHGQAILCTIHQPSAILMQQFDRLLFLAKGGKTIYFGELGENMGTLIEYFEKKGSTPCPKNANPAEWMLEVIGAAPGSHADRDWSEVWNQSPEREQVRAELARMKAELLQKPEPPRTPEYGEFAMPLWSQFLICLKRMFQQYWRSPSYIYSKATMCVIPPIFIGFTFWREPLSLQGMQNQMFAIFMLLVIFPNLVQQMMPYFVTQRALYEVRERPSKAYSWKAFMMASICVELPWNILMAVPAYFCWYYPIGLYRNAGPGETVERGGTMFLLILIFMMFTSTFSSMVIAGIEHPDTGSNIAQLLFSLCLIFNGFWIFMYRVSPFTYLVSSVLSTGLSGAEVECSDIEILKIPPPDGQNCTSYLGPYAEGIHAKLLSDAPNGDCRLCSISSTNQFLASLSINPDDNWRNVGILFVYIVFNAFAAVFLYWLVRVPKKKSQQVKKQ

SEQ ID NO: 23515 - protein, 252 aa, Aspergillus nidulans FGSC A4
MSPPAIIAPSILSADFATLGSECSTKISEGADWLHVDIMDGHFVPNITFGAPVVTKIRSHVHRPSQPQGKGTFDCHMMIAEPQKWVKDFKDAGCDLYCFHYEAAVSSVAAKEPADKETTRKTSPKELIRFIHEEGMQAGIAIKPDTPVDVLWDILAADDEKERPDMVLVMTVHPGFGGQKFMASELPKVKALREKYPDLNIEVDGGLGLGTIDQAAEAGANVIVAGSAVFGAENPGDVIQKLRDAVNKHRKA

SEQ ID NO: 23516 - protein, 1528 aa, Aspergillus nidulans FGSC A4
MAPVTSAGEAVARIAYQASEVVLSVQPSLQSDSWFTKTLKSLKAAGARSVVPEGVPDVVSVRYNEDPFLSAFHPLQSGKVVSAVTSSSTLLTSIPHLYRLANSPVVIHVALEPYPFPDYSAISSIRQCGFTFLHSETLQEAQDIALTAHALARKSGKGVIHFFDPANSANDDAIEQEDAQTLKSILDLSRSAVSHSEGHGVDTLYAETGRVATVSDETVESSTAAQVEETATPTQPSQTPSSRSVANSSVGSSERDSSVDSRATSSAATTVDGSVRPVSATDIFSWASQIWKALSEITGRNYRAIEYTGPSDAKSAIFVFGSTGVFVDVLSKEDVPAELTNIGLITARLYRPWVGAEIANSIPRSIEKIAVLEQVRKTTRWGPSFMDLLSSLTPAAVGGRSPQIVGYRLGYVEPSTAVQALRGIIQNLSSPSPIQSLEIGSSNVPTLQTPLEQPRIENAYLKILNQLFGERLYLANQLSSNNAGISSTIAASPEYGFGSLIARKEHRQRFIREVEAASKSNSFATDVVSKWLADWALNATDATKANRLAPDVIARLSNDGSALSKQLLQTKKLFYSESQWLIGSDAWAYDLGNSGVHHVLASGADVNMLVIDSQPYSERSAADPTRRKKDIGLYAMNFGNAYVASVAVYSSYTQVLQAMAEAEQFKGPSIVVAYLPYNQENDSALTVLQETKKAVDLGYWPLYRWNPANEDKGEPKFALDSERVKRELEEFLRRDNQLTQLMNRQPKFSSVLSESYGTEVRAIQKRKAKDSYEKLLEGLFGAPLTILFASDGGNAATLAKRLGNRGRARGLKTLVMAMEDYPFEDLPTEENVVFITSTAGQGEFPQNGRALWEYVKNTGDLDLSTINYSVFGLGDSHYWPRKEDKIYYNKPAKDLDARIAFLGGRKLTDIGLGDDQDPDAFQTGYSEWEPRIWQALGVDKVEGLPEEPAPLTNEDIKIQSNYLRGTIAEGLLDESTGAISASDQQLTKFHGTYMQDDRDVRDERKAQGLEPAYSFMIRCRLPGGVATPSQWLQMDAISSAYGNETMKLTTRQTFQFHGVVKRNLRGAMRAINKALMTTIAACGDVNRNVMCSSLPELSYYHREVHAVSKKISDHLLPATTAYHEIWLQDENDKKVQVAGDAVVDQEPLYGPTYLPRKFKITIAIPPHNDTDVYAHDIGLIAIKGADGHLEGFNILAGGGMGTTHNNKKTYPQTGRMFGYVPADQAHIVCEKIMLVQRDYGDRKNRKHARLKYTIDDMGVEAYKEKVEALLPDGLRFAEPRPFKFASNVDTFGWQKDENGLNHFTFFIENGRIEDTADFRMRTGLRELASLDKGEFRLTGNQHLILSNIKDEDLPAIKELMAKYKLDNTSFSGLRLSSSACVAFPTCGLAMAESERYLPVLITKLESTLEEVGLARDSIVMRMTGCPNGCARPWLAEVAFVGKAYGAYNMYLGGGYHGQRLNKLYRSSIKEDEILDIMKPLLKRYALERNTDGEEPERFGDWLIRAGVIKETTDGRNFHEGVAEEEDEE

SEQ ID NO: 23517 - protein, 500 aa, Aspergillus nidulans FGSC A4
MGFSLHANNSNDPPEVRNWRIHLITTIVSMGAIAMGYDTSVIGGTMALDSFRRHFGLIHASDIETDTLEGNIVSTFQAGCFFGSLLTFPLGERFGRRNAIVMAVCVFCIGGSLMTAASGHLGLIYAGRAIAGFGIGSVSLQVPVYIAEMSPASIRGRLVGIFEICSQGGGMLGFWINYAINRTISSSRMAQWQIPLGLQLLPGGLLLAGIFWCPETPRWYAKKDRWGDAEKSLVWARRLPANHPFIQGELQQIREQFLYDVVPEGRKYDPWRWLIEEYSYSPRIFETLGINSTDTKLFATGFYGVAKTLGMVIFSVWLVERVGRRSGLIYGAFIGSLPMWYIGGYVFERDPAGTSARGDTVQDAWGYIAMVCVYLYGLIYCATWQGITWVICSEIFPIDIRMLCVAITTADQWLWSFIISRTTPYMITSLGYGTYFFFASLMIAMGVWAWFFVPETKGKTLEEMDRLFGAPSSVNGMTEKDDSEKIGSGKAGEVVHAESV

SEQ ID NO: 23518 - protein, 1049 aa, Aspergillus nidulans FGSC A4
MGDEIVIDKTAFFNRLSSFYAAWKADKRSTNSVFGGAGSIIILMGKTDEANSYQKNNAIHFWLLGYEFPATLFVFTPEVMYVVTTAKKAKHLEPLKGGKIPVEILVTTKDQEEKTRLFEKCVDIIKSAGNKVGILPRDTTTGPFVEDWKRVYGKISGDVEEVDISPALSAACFSVKDTDELVSIRNASRACSGLMSDYFVDEMSRLLDEEKQMTHKALSMRIDAKIDDAKFFNKLAKLPSEFDPQQIDWAYGPVIQSGGKYDLKLTAVSDDNNLEPGIIIAGFGIRYKTYSSIIGRTYLVDPTKSQEANYSLLLSVHEAVLKEARDGVVAKELYNKAIGIVRARKPELESHFVKNVGAGIGIELRDSNMILNGKNTRVLKSGMTFSITVGLVDVEEPSVKDKKKNVYSMMITDTVRVGEQGPHVFTKDAGIDMDSVSFYFGDEEEPQKPAKEKKETKSSAIASRNVTRTKLRAERPTQVNEGAEARRREHQKELAAKKTKEGLDRFAGTTGDDNGVTQKKFKRFESYKRDNQLPAKVKDLTVYVDHKASTVIVPVMGRPVPFHINTIKNASKSDEGEYAYLRINFLSPGQGVGRKDDQPFEDLSAHFLRNLTLRSKDNDRFAQVAQDITELRKNALRREQEKKEMEDVVEQDKLVEIRKSDRRPVKLPDVYLRPPLDGKRVPGEVEIHQNGLRYVSPFRNEHVDVLFSNVKHLFFQPCAHELIVLIHVHLKTPIMIGKRKTRDIQFYREATEMQFDETGNRRRKHRYGDEEEFEAEQEERRRRAALDREFKAFAEKIADAGKDEGVDVDIPFREIGFTGVPNRSNVLIQPTTDALVQLTEPPFLVISLNEIEIAHLERVQFGLKNFDLVFVFKDFHRAPVHINTIPVENLEGVKDWLDSVDIAYTEGPLNLNWTTIMKTVVSDPYGFFADGGWSFLAAESDSEDGSDEEEESAFELSESELAADESSEEDSDYDDDASADDDFSADEDESGEDWDELEHQAKKKDRESGLDDEDRGKKRKSVNGIFPLQIISDYRNLQKVDMLTYIIWL

SEQ ID NO: 23519 - protein, 259 aa, Aspergillus nidulans FGSC A4
MAPITDDVVAGLKSTIGKLEARIEDLESRLGGEPKPKSIAEHMRIILMGPPGAGKGTQAPKIKEKYCVCHLATGDMLRSQVAKKTDLGREAKKIMDQGGLVSDEIMVNMIKSELENNAECKNGFILDGFPRTVAQAERLDEMLVARNQKLQHAIELKIDDALLVARITGRLVHPASGRSYHKIFNPPKEAMKDDITGEPLVQRSDDNAEALKKRLVTYHAQTAPVCDYYKKTGIWRGIDASQEPGQVWKSLLGVFNNKN

SEQ ID NO: 23520 - protein, 2144 aa, Aspergillus nidulans FGSC A4
MGLNLEEIYGQTIVEEQRPNEYSEYQPKKGYGWANTLPERQGLYDPEYEKDACGVGFAANIKGKASHKIVSDARNLLCNMTHRGAVGSDARDGDGAGVMTSIPHKFFIKNFAREVGVDLPPLGQYAVGNLFFKPDEEALKESIKQFEEIATSLGLRVLGWREVPRDSTILGPAALSREPTILQPFVVLKSAYGEGNKPDITDPEQFDTKTFELQLYVLRKRATHIIGLANWFYLCSLSNRNIVYKGQLAPIQVYQYYHDLVNVDYEGHFALVHSRFSTNTFPSWDRAQPLRWAAHNGEINTLRGNKNWMRAREGLLKSDIFGEELESLLPIVEDGGSDSAAFDNVLELLMINGVLSLPEAVMIMIPEAWQDNPAMDPAKAAFYEWAACQMEPWDGPALFTFSDGRYCGANLDRNGLRPCRFYVTDDDRIICASEVGAVDIDQERVVQKGRLQPGKMLLVDTVAGRIIDDSELKYTVAHRHDFSSWLNKELVKLPAITEKLVEQNMDLRHDLDNTTVQNDPRLKAFGYSFEQVTLLLGPMGADSKEALGSMGNDAPLACIAKQPRLLYEYFRQLFAQVTNPPIDPIREAVVMSLECYVGPQGNLLEMDPSQCRRLLLPSPILSIPEFNALKNINTVHKDWTVRLIDITFEKKKGVPGYIEALDRICDAATEAIQQGDKILILSDRATSADRVPVSALLATGLVHHHLVRNKWRSLAALIVETAEAREVHHMCVLVGYGADGINPYLAMECILKMNREKLIRKELSDEKVIENYKASCDGGILKVMSKMGISTLASYKGAQIFEALGIDDSVIDRCFTGTASRIRGMNFELIAQDAFAIHERGYPSRAIVDIPGLNESGEYHWRDGGEDHINDPVSIANIQDAVRTKNDKSYEAYAKAAHEQIKNCTLRGMLEFDFDQRTPIPIDQVEPWTEIVRRFVTGAMSYGSISMESHSTLAVAMNRLGGKSNTGEGGEDPERSKRMENGDTMRSAIKQIASGRFGVTSHYLADADELQIKMAQGAKPGEGGELPGHKVVGPIAHTRYSTPGVGLISPPPHHDIYSIEDLKQLIYDLKCSNPRARVSVKLVSEVGVGIVASGVAKAKADHILISGHDGGTGASRWTGIKYAGLPWELGLAETHQTLVLNDLRGRVIVQTDGQIRTGRDVAVACLLGAEEFGFATTPLIAMGCIMMSKDPCPVYVSLQPLIWCIGKCHLNTCPVGIATQDPELRKKFEGQPEHVINFFYYIANELRAIMAKLGIRTINEMVGRAELLKVRDDLTNPKQENIDLSLILTPAHSLRPGVATYNVRKQDHRLHTRLDNKLIAESELALEKGLPCRVECDVVNTDRALGATLSYQVSRRYGGEGLPQDTIHSNIKGSAGQSFGAYLAPGITLELEGDANDYVGKGLSGGRLIVYPPRGAAFKAEENVIVGNTCLYGATRGTCFFRGVAAERFAVRNSGATAVVEGVGDHGCEYMTGGRVVVLGSTGRNFAAGMSGGIAYILDMNQDFLSKVNMEMVECSGLEDPAEIAFLRGLIEDHHHYTGSELAARILLDFTRALPHFIKVLPTDYKRTLEEEAAKAAAAKKAETTIPQLPSVPVEKQKPKAEGDAKKAELLDIEDSVTDSKVEKKRTALILDKTRGFMKYNRRSEKYRNPATRTRDWAELSSRLTEDELKYQSARCMDCGVPFCQSDTGCPISNIIPKWNELVFQNQWQDALNRLLMTNNFPEFTGRVCPAPCEGACVLGINEDPVGIKSIECAIIDRGFEMGWMVPRPPPVRTGKTVAIIGSGPAGLAAADQLNRVGHSVTVYERADRIGGLLMYGIPNMKLDKKIVQRRVDLMAAEGVKFVTGVSVGPDSEVSLDSLRKSNDAVIIATGATVARDLKVPGRELEGIHFAMQFLHKNTKSLLDSELADGAYISAKDKHVVVIGGGDTGNDCIGTSVRHGAKSVVNFELLPQPPPERARDNPWPQWPRIYRVDYGHSEVKTHMGKDPREYCIMSKEFVDDGNGRVKGINTVRVEWTKSATGGWDMKTVEGSEQFFPADLVLLSMGFLGPEDRLLGEEIERDARKNVKTPPGHYGTNVPGVYAAGDCRRGQSLIVWGINEGRQCAREVDTFLSGISSQLPVTGGIVRRPAVDAVRQATETVTIAA

SEQ ID NO: 23521 - protein, 379 aa, Aspergillus nidulans FGSC A4
MDSSKLFTPLKVGNIQLAHRITLPPMTRFRVDEGHIPQDQVAEYYAQRAAVPGTLLITEATLISTRPGVYTHVPGLWSKEQIAQWRKVTDAVHAKGSFIYNQLWALGRVADPEATKKEHGGSEGRVIAPSAVPLDPSGEPPKEMSEEDIAGVIQDFATAAKNAIEAGFDGVEIHGANGYLVDQFIQKAANKRSDRWGGSVENRARFPLEVIRAVVDAIGAERTAIRYSPWSTFQGMGVDPDEEQIAQFAYLAKKTAEFKLAFVHLVEGRIAGNTETDENGGRNLHFFFDAYGRAGPIMVAGGYVGETAREAADVQYKDYDVMIAIGRPWTANPDLPFKVKKGIPLRPYEREHFYTVRSPKGYIDYDFSEEFKAATGTRL

SEQ ID NO: 23522 - protein, 399 aa, Aspergillus nidulans FGSC A4
MSDTKHRPAVQTTAAEHYGEVPSPVVSAHPTRESSAPEIAADLVDEQKKGFFAYFRTKEFYVTLLLGQFLAIANTGTNTFNTLLANKNTNIPAFQTFFNYSLLNIIFTSYTIYKYGIKGWFEMLWKRGWKYIILSFCDVEGNYFMVLAYEYTTMMSAQLINFWAIVVVVVVSFLFLRVRYHISQVLGILICIGGMGILIASDHIQGTNGGDISRGNQIKGDLFALLGASFYGLANTGEEFFVSTAPVYEVIGQMGFFGMIINGVQAAIFDRKSIQHAHWDGQVGGYLTGYTLCLSIFYSTAPLLFRLASAAFFNISLLTMNFWGVIIGIRVFHYSVHWMYPIAFVLIIVGQLVYYLGRKVLGEARKPWLGRNQERGVAGIFTAKRRIESSAAAFRTAPA

SEQ ID NO: 23523 - protein, 1593 aa, Aspergillus nidulans FGSC A4
MEFQQTGALNITHRGIAECDRLIPACTACREAGTRCSQRQVPVEPSEESNGLSHAALPGYIESLIQRIRALEALTSQKRRRVSSDDPDGDATPPMPPEGLDSSVQTALGEIGFLSRSAMAEPREGVSGFPRQLAMSEMIQAMLSLSGATPSQSRRSEAEAAPWNLLLVPDPRQLLSKDFVTPFLRCFLDRIHIYYLDFDRAELEQQCEAFFDRTSHETGEPSAAAQSYRDVSVFLAVSIGMLLSPQVGCVDLLAQSLHSAAVKLLPMILQCGNCFSEMHCLVLLVVYSMLSPNGGSTWHLLGLAMKRCIAFGMHKEQDTDSALPVKEFERKKSLLWTLYSLDRFVGEYAPAWTGHLASKTKTSPQQLGAVNADGQDAFEFHLLMYAKLISSIRDSDERCPFFHYKNICFWRDVPRELCLFLDQNETARDHLKQLSCRALIQILSLCIFSTSEIQVSEDPFLEIENDVRSSCEHMVDRMYRSLDGHAPAGFAFTDGYDVFAAGVAILCTADLALIQNLAPDSTGISKCVALLTAVGGRFDEVKVFRRVLLAASELRMGRHTEEEMRCYRPKMIPRIMESHEKTVATQVLTEKRTVYMIDSLHPDAVEHAKMLWNVVLPGDKKLNNWREHATAVLVRGSYVTADDIARAPNLIAIGKHGVGIDKIDQAACAKRGIKILNTPGANSRDVAELVVTLALTVARSIRSITTRQMTAPVPKETCKGLTLRRRTVGIIGMGNIGRTVAEIFHGGFDTKLVAYDAYTPDDAWPHLPHHRAQSVQEVLETADVLTLHVPLTDETHNLISYEQLRQMKPDAILINAARGGIVNERDLVRVLSEGHLWGAGLDCHEQEPPSVERPRLDPLHPSAVPPDILYIPLHTIGDEQGSSILSPEATVGQIFPSFRGSNNPGLGQSFAVYDKDAPQTWMADYWICQTSLPLVGEVDVAIRGHYQIVGALETLEVAPGEQRCDFIGDWVKLEDALRASPFGSPSHLTHSVTILSSSGLFISARRIRPYGMSTKYKAPSGPLTGPSRKMSDGGPAKPPRHSVGCPEQRRDPRGQTLHRSWSYSCHSAYHSQNAMGLIADTKKAFRETPKGIFNIYLFSVTWIFALAGVAKGFDEDDEYAGTKGWIVSIATAGAVFGCLCSVPINDRVGRRWTLRLGTLVYIAGVLGQGLSGGSLAGLYASRVISGMGIGVTTIVPPVYISEISPKAIRGLLTLQYAACQQLGVVLGFFINYGVTKKYANTDTQWILPTLLQLLPAAIWGVGTFLCPESPRWLLSVGRKEEAAAALSRLRHLHAGHSVIAGELAGMGSQIQHEHESVASASSWQLIKETLVPVENRRRFFLLFMATLFSQWSGANAITQYSPTIFGYLGIVGEEATFLATGIYGIVKFASTLAFALVIVDFVGRRRSLLVGISLQILTLVFVGAYLGATKDMTIAGVKASRHAERASTAAIVAIYLHAVAWSIGWFSIPYLIGPEIFPTRIRSLNMSISMALHWAFYFGCSKAMPSLLAATHRWGAFLFFSCIGVLGLIYVSLAMPDTTGRSLEALDKLFERPWYTMYKVAYANQDELRAEQPGEMYSTIKGLQTSAEHVETA

SEQ ID NO: 23524 - protein, 421 aa, Aspergillus nidulans FGSC A4
MQPLHTLLALLPLCRSTTALLAFPGAEGFGANAVGGRGGDVYVVTNLEDSGEGSLRDAVSETDRIVVFAVGGVINIEDRLVVSKRVTILGQTAPGDGITVYGNGWSFSNADDAIVRYIRVRMGRGGDSGKDGITIAEGSNMIFDHVSVSWGRDETFSISGTAENITVQDSIIAQGLETHSCGGLMQTDGGVSLFRNLYIDNKTRNPKVKGVNEFTNNVVYNWGGGGGYIAGDSSGQSFGNYFISGPSTSVTAFTRGNENFHGYVENNYYDPDQDGTLNGNELGVSSSNYGGMDIVDTKYDYPAAQYIMTPDEAVSYVTENVGASLVRDGVDSNLIDQVLSYGTDGALISDEDDFGGVGDLDGGETPTDTDGDGIPDDVETQLGTDPNIADSTEIDSSTGYSWLEVWANSLVPEGYASTRKC

SEQ ID NO: 23525 - protein, 359 aa, Aspergillus nidulans FGSC A4
MSTDYKFEGWLGLDAGSVDGKMQWKEFEPKPWEETDVDIKISHCGICGSDLHTLRSGWGPTNYPCCVGHEIVGTAVRVGSQVKHIKVGDRVGVGAQSESCVGRKGECNECATSNEPYCTKHFAGTYNGVFMNGGKSYGGYALYNRSPAHFAIKIPDAIPSAHAAPMMCGGVTVYSPLKHYGCGPGKTVGIIGIGGLGHFGVLFAKALGADRVVAISRKSDKRADALKLGADEYVATAEDTEWMANNKRSLDLIVCTVSSSKMPINDYVSLLKVDGTMIQVGAPEDGALTIPAFTLIANRVKLGGSLIGSPDTIREMLELAAEKGVKPWVEERPMKDANQAIKDMDAGDARYRYVLVNDH

SEQ ID NO: 23526 - protein, 440 aa, Aspergillus nidulans FGSC A4
MKVTITPALVLALSTLALTAPVEREVRSLETRDLSVDARHLGKLPVVKHKFGIEGGVKGGFGLGKKGKEDDKKDDKKGGKWDDDKKDDDDWDDDHWDNDDWDDDKKDDKKDDDKKDDDKKDDNGNSGGFGFGVGSSNGFDSKNPKGKPDYDPHHGKGPEGKPGYIVDHKHDDKKDDKNGGFLRARGEPKKDDDKHGGYKPDDKKDDHDHGYGYGKGDDKYDDKYDDKKDDKKDDKGKGKGFGFGFGFGAGVHGGGKGGGKGFGFGLGHGKGYGHGKGEDEGKGKGGGFGFGLGLGLGGKGSHGGHGGYGGGEGGNGGNGGGFGGGGGGGGGGGFGGGSGGFGGGEGGFGGGSGGHGGHEGGHGGHGGHEGGHGGNGGGFGGGGGGGGGGFGGGEGGFGGHGGGEGGHGGGHGGGFGGGFEGGFEGKGGYEGKGGYGKGGY

SEQ ID NO: 23527 - protein, 483 aa, Aspergillus nidulans FGSC A4
MASGTLPPFPTKLFINNQVENTPHPSTLLPADRMIINLVERDAERLAILESLPTGKPVTPTIHFDIAHMLEVWRYYAGWTDKISGESYPESNGVYKIVRHEPLGVCAGIASWNATFMYIGWKIAPAVAAGNCFIFKPSEKSPFGTLALGALFAEAGFPAGVVQILNGGAETGAALARHMDIAKISFTGSLGGGKAVQEAATKSNLKKVTLELGGKSPAVVFADAELERALGGVCGFLFNSGQVCVATSRVLVQKPIFEKFTQGLKSAFEQTSSTLGADPLDKNVSYGPIVDKAQFDKIMSYIAIGKQTATLLTGGERKGDKGFFIKPTIFVNPEPESPIVKEEIFGPVMVVQTFETEEEAIALANATVYGLAASVYTSNIDRALRVSSALECGGVAVNSPFLPQVNTAFGGIKASGKGRELGLYGLLEYTEAKSVHITCCVNRGGWNDLGTQPDQLQTAGSVMNCLRQEAETIWIDEAYRTST

SEQ ID NO: 23528 - protein, 339 aa, Aspergillus nidulans FGSC A4
MDTPTRPSISPGPATNPLSAHSTWNSLSSLADLVTPKATNRADFIAECKSGALDGVVVAYRTFDSVSITGLFDEELVNALPSSLVYLAHCGAGYDQISTQACTARNPPLRVSNVPTAVDDATADVNMFLIIGALRNFNAGMHALRQGHWRGLTPPRLGHDPENKVLGILGMGGIGRNLKRKAESFGMKVIYHNRRELSAELAGGAKYVSFEELLKQSDVISLNLPLNKNTRHIISTEQFNQMKDGVVIVNTARGAVMDEDALVKALDNGKVYSAGLDVFEDEPKIHPGLVENPNVLLVPHMGTWTVETQTAMEEWAIENVRMALETGKLKTPVPEQADL

SEQ ID NO: 23529 - protein, 418 aa, Aspergillus nidulans FGSC A4
MSATTARSDPFKPAARVAGQRQDVWSIVNEAAAASPVQPIVNMGQGFFGYNPPQFALDAAKAALDRVDCNQYSPTKGRPRLKKALADAYSPFFGRQLNPDTEVTITTGANEGMLSAFMGFIEQGDEVIIFEPFFDQYISNIEMPGGTIRYVPLQPPKDGATKTLPASEWSINFDELERTINPKTKMIVFSRDELERIGDLAVKHNLIILSDEVYDRLYYVPFTRIATMKPEYYERTLTVGSAGKAFYATGWRVGYLIGPEHLIKYVAGAHTRICYSSVSPLQEAAAVAFEEADKQGFWDQSREEMKRKMERFCEVFDELNIPYSDPEGGYFVLANMASVKLPEGYPFPPHVASRPRDFKLCWFLIHEVGVAAIPPTEFYTDANAHIAEDYLRFAVCKEDDVLETAKERLRGLKKYIVR

SEQ ID NO: 23530 - protein, 360 aa, Aspergillus nidulans FGSC A4
MCIYKQPEDTAANNKRRRNRMGLPTFLYNQLLITPAIPTNPFTGQTAIITGSNTGLGLETARHIARLGADKVILAVRNTAAGENAAKDIEESTICKPGTCEVWPLDLASRHSVLAFAEKAKKELGRIDVLVLNAAVATKIFQLADGGYEHSITVNTINHFLLAIALLPKLQETGTNFTNRLAPPHLTVLTSQVHAWPEFPQSTDPRGIFVALSDKATAKMDERYPVTKLLNVYLTRELVEQLYSDSDGKDGEPSVVINMLDTGFCHSQLSRENQGVDALVFNLFKRLFARKEEVGARTTVTAASAGVESHGKYMVNGIVADEALSERIYNEEGRMIQKRLWKELTDIIKGFKPQIMEEFK

SEQ ID NO: 23531 - protein, 240 aa, Aspergillus nidulans FGSC A4
MRTENAGYMTEYVATRWYRAPEIMLSFQSYTKAIDVWSVGCILAELLGGRPFFKGRDYVDQLNQILHYLGTPNEETLSRIGSPRAQEYVRNLPFMPKVPFQRLFPNANPDALDLLDRMLAFDPSSRISVEEALEHPYLAIWHDASDEPSCPTTFDFHFEVVDDVQEMRRMIYEEVVRFRQSVRMPPQAQSLAQQQQIGNIPIPEHQQGVWRQEEPRPQEAGAVGGNHNDLESSLQRGMDA

SEQ ID NO: 23532 - protein, 401 aa, Aspergillus nidulans FGSC A4
MGPDQHAQLDGFSLFLPFPSRVAVLLLAGFWGWGANLQYLQQNNIDILALIRYHTRQSVNQRPPHVSAYRLAGLLTFPLLLSLLVFWPVTHGSREWVESVDYIPQSYLFILFILLLLPFNRLSRSGRRRFLYTLRRISIGGLAEAQDGKFGDILLADALTSYSKVIADLVVTFCMFFNSETSSTSKPDRHCGFDLTIPLVIAIPSIIRFRQCLIEYVRVRRMGFQNGNTGGQHLANALKYASAFPVILLTAKLRNYSPFSFHGISEVTLNRLLCFFTFINSSYSFYWDVTKDWDLTLFSESRNDNEYPYGLRRYRHFSDQQYYAAIAVDFAIRFSWMSKFFPGFGWLSETEFGLFVLMFSEIARRWMWVFLRAEAEWIRNSRGPAPSDVLLGEYNDKLDTD

SEQ ID NO: 23533 - protein, 438 aa, Aspergillus nidulans FGSC A4
MPISKIHARSVYDSRGNPTVEVDVVTETGLHRAIVPSGASTGQHEAHELRDGDKSKWLGKGVLTAVKNVNETIGPAVIKENLDVKEQSKIDEFLNKLDGTPNKSNLGANAILGVSLAIAKAGAAEKGVPLYAHISDLAGTKKPYVLPVPFQNVLNGGSHAGGRLAFQEFMIVPDTASSFSEGLRQGAEVYHKLKALAKKKYGQSAGNVGDEGGVAPDIQTAEEALDLITEAIEQAGYTGKIHIAMDVASSEFYKPEEKKYDLDFKNPDSDPSKWLTYEQLADLYKSLAAKYPIVSIEDPFAEDDWEAWSYFYKTSDFQIVGDDLTVTNPLRIKKAIELKSCNALLLKVNQIGTLTESIQAAKDSYADGWGVMVSHRSGETEDVTIADISVGLRSGQIKTGAPARSERLAKLNQILRIEEELGENAVYAGQNFRKSVNL

SEQ ID NO: 23534 - protein, 444 aa, Aspergillus nidulans FGSC A4
MASSSSNVVGVHYRVGKKIGEGSFGVIFEGTNLLNNQQVAIKFEPRKSDAPQLRDEYRTYKILVGCPGIPNVYYFGQEGLHNILVIDLLGPSLEDLFDHCNRRFSVKTVVMVAKQMLSRVQTIHEKNLIYRDIKPDNFLIGRPNSKAANVIHVVDFGMAKQYRDPKTKQHIPYRERKSLSGTARYMSINTHLGREQSRRDDLEALGHVFMYFLRGGLPWQGLKAATNKQKYEKIGEKKQTTAIKELCEGFPEEFTKYLSYVRNLGFEDTPDYDYLRDLLTQALKNAGEVEDGEYDWMKLNNGRGWEYKSYSSQQALQNSAMHTSARDLHGQQIRNSQRPGVTADRLNAAQPPPPSPAKPGAGKTREPQNVRGGIPPKRQSGGFDTTPAASTVAQFQNSNANISGHRIGSPATPAKNQPAPGGQQASNEPQPTLMQKVMKALCCG

SEQ ID NO: 23535 - protein, 363 aa, Aspergillus nidulans FGSC A4
MATAEPHHLFHAPIADHSFSSDKSVLAVARENNVELYQKTGSKFSLTDELKGHEKTVTSVDIAPNSGRIVTCSQDRNAYVWEQTPTGWKPTLVLLRINRAATFVRWSPSEQKFAVGSGARVIAVCYFEEENDWWISKHLKKPIRSTITTLAWHPNSVLLAAGSTDSHARVFSSFIKGVDTRPEPSAWGERLPFNTICGEFLNDSAGWIHGVCFSPSGNALAFTGHDSSVTIVYPSAPEQPPRAMLNISTRLLPFNSLIWNGENEIIAAGHDCEPYRLRGDENGWQLEGTIENKAGAGAGSVREESALNMFRQMDLKGQTQADTQLKTVHQNTINTIRVYEDTAGSVHKISTSGVDGRVVIWTI

SEQ ID NO: 23536 - protein, 268 aa, Aspergillus nidulans FGSC A4
MAGVLFSPEKDIPNLSGKVILITGGTAGLGAAAAIHLAKHSPSHIYISGRNAKSADAVIQQTQKSGTKVSFLACDLASLDSIKKAADTILAQESRLDLLMCNAGIMAVPPGKTSDGYEVQFGTNHLGHALLIQKCLPLLQQTAALPGADVRVVILTSLGFRMHPSAGIVFSDLKSEQNFPAFGSWIRYGQSKLANILYARELARRYPSITSVSVHPGVVGTGLVENLGWAKRTFVYVTNLWKLMKPEEGKLEERAALRAGWDPVVQVG

SEQ ID NO: 23537 - protein, 473 aa, Aspergillus nidulans FGSC A4
MLLDTTTFHNVINGQLTSTATTRHSLNPATKKENPAVPVSTAKDVDDAVSVAKTAFKSWSRTSYEERRRACLAYADTLEANKEALAALLTQEQGKPLDQAAVEVGMAVTWTRQLPTIEIPENVIQDKEECRIVQRYTPLGVAAAIVPWNFPVLLAVGKIIPAVYTGNTVIVKPSPYTPYCALKLAELAISHFPPGVIQALSGGDDLGPMITEHPGIDKISFTGSTATGKKVMASASKTIKRVTLELGGNDAAIVCDDVDIDKVVPNLAILSFLTSSQICMMIKRLYVHEKIYDKFLQKFVAFVSNFKVGAGTQEGVFIGPVQNEMQYKKAKDLFSSIESEKLCAVLGGTITASDGYYIAPTIIDNPPESSRVVQEEPFAPILPVLKWSDEDDVIARANGTDSALAASVWSVDMERAQRIAGQLAGGSVWINSHFEVSPFAPFGGHKSSGIGVEWGLSGLLGYCNSQTIWMKKA

SEQ ID NO: 23538 - protein, 387 aa, Aspergillus nidulans FGSC A4
MAHQDSKLFQPLAINNGNITLKHRVVHAPLTRNRGVPESPVSTPEKPNRVWYPGDLSNGMPGVPGLFTPSQIAGWKRVVDAVHEKGGYIYAQLWHAGRATIPQMTGSPAVSASATVWDDPTECYSHPPVGATERVPYSAHPPIELTVDHIKRTIADYCAAAKAAMEAGFDGVEVHGGNGYLPEQFLSSNINKRTDEYGGSPEKRCRFVLELMDELAKTIGEENLAIRLSPFGLFNQARGEQRMETWTHLCKELKRTHPTLSYVSFIEPRYEQIFSTAEKDAFLSSWGLSNVDLTSFREIFGDTPFFSAGGWDQTNSWGVLESGRYDALLYGRYFTSNPDLVERLRTGTPFAPYDRSRFYGPFEDNRICYTDYPPATGHTDIRIEIQQ

SEQ ID NO: 23539 - protein, 291 aa, Aspergillus nidulans FGSC A4
MVFGSRPPALTEANIGDQSGKNNGTVYLAARNAKKTAEVIADLKQRFPASRGRLDSISLNLSDLSTIKKSAEEFLAKETRLHVLWNNAGVMFPPAGSTTSQGYELQLGTNNVGPHLFTKLLYPTLAATAKEAPKNTVRVVWVSSDAASWAPKPAIDFNNLDYRRNESDRSKYGRSKAGTVMQAVELARRARKDGSGIVSIALDPGIANTGLQRDMGRLMSTMVKLIANKPEIGAYTQLFAGLSPEITAEVAEKEWVVPPGKIGCPRRDLFTDTETSRKWWEWNEEQVKAYL

SEQ ID NO: 23540 - protein, 1457 aa, Aspergillus nidulans FGSC A4
MDNDGPPEKEQTPASNLHQVYSQEKRVADSHDTLVVPPGTPTGATSTETLALAHPYPPTTSTAPVKNTTWRLTDQVVKNRDRDRAAGYKPRELGVTWQGLSVEVPTAEASVNENLFSQFNIPQVAKDYFRKPPVRPILSDSHGCVKPGEMLLVLGRPGSGCTTLLNLLSNRRQGYRMIKGDVRFGTMDPKEAERYRGQIVMNTEEELFYPHLQVGATMDFATKLKVPAHLPDGADSIDGYVKETKDFLLESMGISHTAHTKVGNEFVRGVSGGERKRVSIIECLATRGSVFCWDNSTRGLDASTSLEWAKALRAMTDVNGLATIVTLYQAGNGIYNLFDKVLVLDEGKQIYYGPAAEAKPFMEELGFVYTEGGNIGDFLTGVTVPTERRIKPGYESRFPRNADEIRALYEKSPIYSQMIAEYDYPQTPLAKERTEAFKESVAWEQAKELPKGSSLTVGFWSQLLACTIRQYQILWGEKSTFLMKQVLSLAMALIAGSCFYDAPDDSSGLFIKGGGVFFAVLYNNIVAMSEVTESFKGRPVLVKHKSFAMYHPAAFCLAQIMADFPVLLFQCTIFSVVMYWMIGLKHTAAAFFTFWAILFTITLCLTAMFRCIGAAFKTFEAASKISGTAVKGIVMYAGYMIPKPDVRNWFVELYYTNPFAYAFQAALSNEFHDQHIACVGENLIPSGPGYEDVGAGHQACAGVGGALPGAAYVTGDQYLGSLHYKFTQLWRNYGVVWGFWGLFAVLTIIFTTFWNAGAGSGSTLFVPREKIKQHQRHKDEESQSQVGAATARDGGDTSLDEGNISRNTSIFTWQNLTYTVNTPTGERVLLDKVNGYVKPGMLGALMGSSGAGKTTLLDVLAQRKTDGTIKGSIMVDGRPLPVSFQRSAGYCEQLDIHEEYATVREALEFSALLRQPRTTPREEKLKYVDTIINLLELQDLADTLIGGVGNGLSVEQRKRVTIGVELVAKPSILIFLDEPTSGLDGQSAYNTVRFLRKLADIGQAILVTIHQPSAQLFAEFDTLLLLARGGKTVYFGDIGENGRTIKQYFGKYGAQCPVEANPAEFMIDVVTGAIPEVKDNDWHQIWLESPENAKMIKDLEDMIADAASKPPGTHDDGFEFSMPLWEQIKIVTHRMNVSLYRNTNYINNKFSLHIISALLNGFSFWRAGPKTGVSDLNLKMFSIFNFVFVAPGVINQLQPLFIQRRNIYDAREKKSKMYSWISFVIGLIVSEFPYLCVCAVLYFLCWYYCVKLPYDSSRAGSTFFIMLIYEFIYTGIGQTIAAIAPNATFAALVNPLIISILVLFCGVFVPYTQMNVFWKYWLYYLNPFNYVVSGMLTFGIWGNNVICNDDEYARFDPVNGTCAEYLKDYVTGSGWAINLANPEATSDCRVCQFRDGSDFLTTLNIKHYYYGWRDAGICVIFAISGLHRVLALGIQRISVQVSAMNTRDVTCFRALLP

SEQ ID NO: 23541 - protein, 424 aa, Aspergillus nidulans FGSC A4
MNPSSFFRTASRSAGRLSKIPAASRGYATAFKWEDPLLASELYTEDELAIQETARQYCQERLQPRVLDAYRNENYDRKILEEMGELGLLGASIEGYGCAGVSTVASGLITKEVERVDSGYRSGMSVQSSLAMTAIHEFGTQELKDRLLPELAKGKLAGCFGLTEPNHGSDPGSMETIAREHPTKKGVYLLSGSKTWITNSPISDILIVWAKLQSTGKIRGFVVERSKCPPGTLETPALKNKSALRASITGMIQLDDCPVPVENMFPDVEGLTGPFTCLNSARLGIAFGAMGALEDCIDRARTYALERKQFKGNPLAKYQLIQKKLADAVTDATYGTLAATQVARLKDAGKCTPEMISLVKRQNCDRALANSRTLQEVFGGNAASDEYHIARHVANLFVVQTYEGQSDIHALILGRAITGVQAFV

SEQ ID NO: 23542 - protein, 331 aa, Aspergillus nidulans FGSC A4
MQSVLQPIIGPKKTAEDLSGRVAIITGGAFGIGYEISRTFVQNGARVIMVNRKEDQGQEAIDKIKEEAGSDAKIEWVPCDMGNLAQIREVASRFVEKEERLDLLILSAGINVHQYGETHDKIERHFQVNWLGQFYLTNLLWPLLRKTAKLPDTPAPRVVFESSEQHRAAPSGVKFGSLEEINNPDLGPLERYGRTKLAIILGVKYGLLEKVIKPNGDNIYALSVHPGAVNTAMQQQWKDAYPGLFGKLLTTVMLAAGRNVEQGSYSALYAAISPEVEEKGWNGYYLKDVGQPGKESSLASDSVLGAALWDLSHRMIRDILGNDAVADWASA

SEQ ID NO: 23543 - protein, 1361 aa, Aspergillus nidulans FGSC A4
MVEQQTDKDKRLGITWYNLIVKGIATDAAFHDNVGSQFNIPARVKGSRAKPLLRTIIDNSHGCVKPGEMLLVLGRPGAGCTSLLKILANRRLGYAQVTGEVRYGSMTADEAKPYRGQIVMNTEEELFFPTLTVQQTIDFATRMKVPHHLHSNSTKARFQQFNRDFLLRSMGIEHTRDTKVGNEFVRGISGGERKRVSIIETMATRGSVFCWDNSTRGLDASTAMEYIRCMRAMTEVLGLSSIVTLYQAGNGIYDLFDKVLILDEGKQTFYGPLHQAKPFMEELGFLYSDGANIADYLTSVTVPTERRVKPDMESRYPRNAEELRSYYEATQLKRKMALEYNYPISAEAAEATKNFQEAVHSEKSPALSRRSPLTVSFSTQVKSAVIRQYQLLWGDKVTFLIPQGLNFVQALITGSLFYNAPKNSSGLPFKSGSLFFAILLNSLLSMSEVTNSFAARPVLAKHRGFALNHPAAFCFAQIAADVPLILTQVTLFALPVYWMTGLKATGEAFMIYWITTISVTMCMTALFRAIGAAFSSFDAASKVSGFLMSALIMYTGFLLPKPSMHPWFSWIFWINPLAYGYEAILSNEFHGQLIPCVNNNLVPNGPGYTNSEFQACTGIRGVPAGASVITGDQYLQGLSYSHAHVWRNFGIMWAWWVLFVILTVYFTSNWSQVSGNSGYLVIPREKAKKTKHLTMDEEAQPGLDLHDSSHRGGTSPIDDEKGSHTNSSSKVDAQLIRNTSIFTWKGLSYTVKTPSGDRVLLDNVQGWVKPGMLGALMGSSGAGKTTLLDVLAQRKTEGTIRGSILVDGRDLPVSFQRSAGYCEQLDVHEPLSTVREALEFSALLRQSRDTPVVQKLKYVDTIIDLLEMHDIENTLIGTTAAGLSVEQRKRLTIGVELVSKPSILIFLDEPSSGLDGQAAFNIVRFLRKLADVGQAVLVTIHQPSASLFAQFDTLLLLAKGGKTVYFGDIGHNGATVKEYFGRNGAPCPQNTNPAEHMIDVVSGSLSVGKDWNEVWLTSPEYTAMTQELDRIIMEAASKPPGTLDDGHEFATPIWTQLKLVTNRNNASLWRNTDYINNKFMLHVISGLLNGFSFWKLGNSVADLQMRLFTIFNFIFVAPGVMAQLQPLFLERRDIYEAREKKSKMYHWSAFATGLVVSELPYLVLCAVLYYVTWYYTVGFPSGSDKAGAVFFVMLMYEFIYTGIGQAIAVYAPNAVFAILVNPLVIGILVFFCGVYVPYSQIHEVWRYWLYYLNPFNYLMGSMLVFTTFDAPVHCERSELAVFNTPDGQTCGEYLADYMQGLGSRTNLLNPNDTQDCKVCQYRTGSDYLYTINLKDYFYGWRDAAIVALFAVSSYACVYALM

SEQ ID NO: 23544 - protein, 466 aa, Aspergillus nidulans FGSC A4
MVVDTSYYDALGVPPTATELEIKKAYRKLAVVTHPDKNPGDETAHERFQAIGEAYQVLSDAELRKRYDTHGKEGAVPDQGFEDPNEFFGMIFGGDAFYDLIGEISLLQDLTTRMEITTEEAEEDLAASTEEKLNINEQEGTSVGETTSSGAGSRASAASPSPAASGTSTPRPRLGQQAIMDKSDEEIRMQAAGVTEEERELRKKEKKKGGLTREQAERLQAFELERQKAREERVDMLATKLIDKISVWTETDKGADVTRAFEEKIKLEVENLKIQSFGIEILHAIGATYVSKATSFLKSQKFLGISGFFSRLKDKGTLAKEAWTTISTVIDAQLTMEEMAKLEEKGGENWTDEMRAEYSVKVTGKLLAAAWRGSKLEIQSVLRDVCDKVLGDKKIKLEKRIERAHAMIIAGNIYSKAERDPDDEGDYMAFEQLMADATAKKAKDEKKKKKKHGHSELEASSPKAAS

SEQ ID NO: 23545 - protein, 462 aa, Aspergillus nidulans FGSC A4
MKLASTLAGLLLPLISTVSAADVDAWKSRNIYFALTDRVARGSDDTGGDACDDLSTYCGGTFKGLEGKLDYIKGMGFDAIWITPVVANHDGGYHGYWAKDLYSINENYGTADDLKSLVSAAHEKGIYIMADVVANHMGSPISDNQPESLSQESAYHSACTIDYSSQESIETCRIADDLPDVNTESEEIRTLFKEWITWLVKEYEFDGLRIDTVKHVEKDFWSDFSSAAGVYTIGEVFDGDPDYLAGYANTMDGLLNYAVYYPVNNFYQQAGSAQDIVDMHDKIDSSFPDPSALGTFIDNHDNARWLSNKDDKSLLKNALAYVILARGIPIVYYGTEQGYAGGNDPENREDLWRSNFDTDADLYKAISLLSAARSAAGGLGDNDHVHLHVAESAYAWSRAEGKLVVVTSNSGSGSENEICFDSKTPNGSWENIFGEGTISADDSGQICVSITNGEPAVLVAQS

SEQ ID NO: 23546 - protein, 399 aa, Aspergillus nidulans FGSC A4
MTFGKAAFLSFSLFGASWAGPSRTLQARAVCTPKAGGSSSIDDVPAIVKSISACGDGGTIVFPEDSTYYLNSVLDLAGCSGCELQVEGLLKFASDTDYWNGRTAMINVKNIDGLTIRSLTGSGVIDGNGQNAYDRFAEDSSYDRPTPLYITGGGDIKVSNFRLKNAPNVFVSVKGGTTNAVFSDMRLDATSKSENLPKNTDGFDIGESTYVTISGTTVSNNDDCVAFKPGCNYLTVTDITCTGSHGLSVGSLGKSSDDIVQNVRVEGATMISSTKAAGIKTYPSGGDHGLSTVTNVTWKDITIQNCDYAIQIQSCYGEDEEYCETNPGDAVFSGIAFEGFSGTTSSKYDPVTGNLNCGEDGKCDVSVVDYSVKAPSGGAAENLTVTTYKNRCLCQARSV

SEQ ID NO: 23547 - protein, 194 aa, Aspergillus nidulans FGSC A4
MASATTFYDFEPVDKKGEAYPLNQLKGKVILVVNTASKCGFTPQFKGLETLYQSIKAKRPDDFVILGFPCNQFGGQDPGSNDQIQEFCQLNYGVTFPVLGKTEVNGDNANPLWTWLKESQPGLLGLKRIKWNFEKFLISADGKVVGRWASTTKPEGLESRILEEIEKAEKQGLLASKAMQPEAAGTDGETAKLA

SEQ ID NO: 23548 - protein, 364 aa, Aspergillus nidulans FGSC A4
MPYPEEAEGFQVDSPETYTDFKKRFFKLKPFGDYDVDIKIEACGVCGSDVHTISVIGGWGSQKFPLCVGHGPEIIGRAVRVGPKVTLIKEGQRVGVGAQSYSCGECKQCKNENETYCPVLMIDTYGAEWPDTGIVSQGGYSSHVRTHEHWVFPIPDVLETNLVAPMLCAGLTAYSPLVRNGAGPGKKVGIVGLGGIGHFGVMFAKALGAETWAISRSRAKEADARKLGADGYIATAEEGWEKPHRCSFDLIINCANSSKGFDLEKYLSMMDVHGRWISVGLPEEEGQVIKAQNLISNGVLIGASHLGSRREMLEMLQLAADKGLRGWVEELQIGSEGLKEAMERMKKGDVHYRFTMTGYDKVFG

SEQ ID NO: 23549 - protein, 246 aa, Aspergillus nidulans FGSC A4
MGESRQELLAWLNNLLQLNMTKIEQCGTGAALCQIFDSIFMDVPMSRVKFNVNTEYAYLQNFKILQNVFARHQIDKPIPVESLSKCRMQDNLEFLQWTKKYWDQHYPGGDYDALARRKASGAPPGSAGTSRAGATSASSARRGTTPTVGRARPAAGGASSATVAALQAELNSTKEAISGLEKERDFYFAKLRDIELLLQNAIEADPELEKDDDSLVKHIQGILYSTEEGFEIPAEGEVAGDELETF

SEQ ID NO: 23550 - protein, 500 aa, Aspergillus nidulans FGSC A4
MSTLNNPLALLWALLPRIPLILRTAVLHGIGQSAGSGKQDLRTEMTVAIIRSFLTGRRVPVGKQQKGAMHDPGIKGPLWVSKVRISQPEMDVHDAVIKAIEELKVGEEKYDIPGVGPVEAEWTGYRRGVDKNAPEPQLSEEQKYAELKKENDADMVVLYFHGGAYYLMDPCTHRLAVSQLSKRTKSPVLSVRYRLAPQNPFPAALVDALTAYLYLIAPPPGSFHAPVPPNKIILAGDSAGGNLSLVLLQTLLTLHRKSTTVTFHNTSVPITPPAGVAVSSPWCDISRSMPSIRKNAPYDYLPAPSPFSSSEANGEPFRPPPVPADAIWPTNPPRVDYFVSASAILHPLVSPLAAPSDLWNNCPPVYISIGEEGLTDEGLVMARRMHKASVSVIAEQVEGMPHCFGLMMPGHRAAKAFYDSMGSFCVDAVAETLKERVDGKLRFLAFKPENNKEIPLSEVASHLPDEEVDRLLAETKQWRVIGEKVLVDEWSAKIENRARL

SEQ ID NO: 23551 - protein, 394 aa, Aspergillus nidulans FGSC A4
MKASLLTASVLLGYASAEVHKLKLNKVPLTEQFITRNIADHANALGQKYMGQFQQHVLEDEPVNAMRGHDVLVDNFMNAQYFSEIQLGTPPQTFKVVLDTGSSNLWVPSSECGSIACYLHQKFDSSASSTYKKNGSEFAIKYGSGSLSGFVSRDNLQIGDLKVKGQDFAEATSEPGLAFAFGRFDGILGLGFDTISVNRIVPPFYNMIHQGLLDEPVFAFYLGDANKDGDSSVATFGGIDKDHYEGELIKIPLRRKAYWEVDLDAIALGDEVAELENTGVILDTGTSLIALPSNLAEMINTEIGATKGFTGQYTIDCAKRDSLPDLTFTLTGHNFTIGPYDYTLEVQGSCISAFMGMDFPEPVGPLAILGDAFLRKWYSVYDLGNGAVGLAKAK

SEQ ID NO: 23552 - protein, 313 aa, Aspergillus nidulans FGSC A4
MALITRKYGEIRQITGLSDHAVILQSHKVQYCPPLDRYYAIKVFRRSPGQSTDEYTKQVNAEFAVVANLHHQHVVSTFELLPIGGGNLAACMEYCAGGDLHSLITAGPSHRLPSEEADCLFKQLLRGISYLHKSGIAHRDLKPENLLLTHRACLKISDFANAERVRFDGDDSQHANDLAETERRSLEPTPYLAPERYLDEGDRYMSRSDPRALDIWAAAVIYVAMRTGRNLWKAATEKDEGFRAYVEERKAEKTNTVIQDSCHERGRKVIYAMLSTDPGKRPIATEILSSEWLQNIDCCIFDHSQAESNGFSA

SEQ ID NO: 23553 - protein, 337 aa, Aspergillus nidulans FGSC A4
MAGLIRLLRTQFIPPTEPSISFAGKTVVLTGATAGLGFEAAIKMLNLGVESLIIGSRNLQRGEATKTELEQRTNRLGVVQVWELEMSSFQSVKDFAARVESLKQLDVALLNAGIWNREFTTSTEGWEETLQVNTLSTSLLALLLLPKLRSCSTDSSPTHLTVVSSQQFVRVQAKSLRTDGPLLEHLNDARRFSGPKQYGVSKLLLEYVLKSVAAQLHNENGTVPVVVNTVSPGLCVSSLGRQYTGLHHRLVVWIMYKLFARTAEQGSRSLVSATYQGLESHGRRWRSDGYLDESTALTTGAEGKQFQAKAWKEIMAVLKEQSNLAVVLDSNTGVSAN

SEQ ID NO: 23554 - protein, 361 aa, Aspergillus nidulans FGSC A4
MAQQDYKFEGWMGLDKNAADGNMVWQEFEPKEWEETDVDIKITHCGICGSDLHTLRSGWRPALYPCCVGHEIVGTAVRVGSKAVGGIKLGDRVGVGAQSDACVGRFGDCPECAMGWENYCSHKFVSTYNSVHFNGGKSYGGYALYNRCPSHFVVKIPDAVPSAEAAPMLCGGVTLYSPLKHNNCGPGKRVGIIGVGGLGHFGVLFAKALGADKVVAISRKNGKSEDALKMGADQYIATDDEPDWATKYARSLDLIVCTVSSTKMPLAEYVGLLATNGSFVQVGLPEDGVLNAPVANLRRRLKMESSLVGSPNEIREMFALVAEKGIKPWIETVPMKDANKAIVDMHEGKARYRYVLVNEEH

SEQ ID NO: 23555 - protein, 483 aa, Aspergillus nidulans FGSC A4
MPLKRVAVIGTGPSGAIAVDALVQEGAFDVIRVFERQEKAGGNWVSRKTERAEPLDIDNLSARTADKPVEIPANLPCYTPPLKAHRYTDSHIYPNLHTNVDASVMEYSGPGEKIPTVRSEWSIGLHGEDTPFRHHEVICGYVESLLNRNGYQDLVEYNTTVERAVKNEEKDEWILTLRKAGGEEEGKERMDYWWTERFDALVVASGHYHVPYVPSIPGLKEFAEKYPGSVEHAKQYRGPGKYKGKVVTIGASVSAADTAVSLIGTAQTPIYAVTRGKYNIYFGDHAFKHPSISLRPAITHIDDTNESRTVHFEDGTSVSGVDHLIFGTGFTWTLPFLPQIPIRNNRVPDLYLHVFHQSDPTLVFIGAVGAGLTFKVFEWQAVAAARVLAGRAKLPPLQVQKKWEEDRIAVKGDGAGFLMVYPEFGEYFEQLRAIASEPDGTKGRRLPVFEQKWADDFAAGHERRIRMWKRANEAAAKALKVPA

SEQ ID NO: 23556 - protein, 404 aa, Aspergillus nidulans FGSC A4
MASQVQPGQKPKVQPCRYKTGKTLGAGSYSVVKECVHIDTGQYYAAKVINKRLMVGREHMVRNEIAILKQVSTGHQNILTLVDYFETMNNLYLVTDLALGGELFDRICRKGSYYESDAADLVRAILSAVAYLHDHGIVHRDLKPENLLFRTPEDNADLLIADFGLSRIMDEEQLHVLTTTCGTPGYMAPEIFDKSGHGKPVDIWAIGVITYFMLCGYTPFDRETNLEEVQAIATANFSFTPVEYWRGVSQEARDFIKRCLTVNPKKRMTAHQALQHPWINPPYDTTDDLGSGEDLLPNIKKNFNARRTLHKAIDTVRAINKLRENGGLMMDGIMSVDPKPEHVNGSEVVEDRTTPRERENEDAMEIDSRSNARGQTEQQIREQERKVKETVAGLWSRTAPRSER

SEQ ID NO: 23557 - protein, 1679 aa, Aspergillus nidulans FGSC A4
MSELWYQRPAAGWDEALPVGNGRLGAMVYGRTDTELLQLNEDSVWYGGPQNRLPEDALKCLPRLRELIREGAHKEAERLARRAFFASPNSQRHYEPLGTLFLEFGHPCEEVTGYRRSLDLNEGITHVHYEHNGVQYHRQVIASYPDNVLAMRVQASRCSEFLVRLSRLSELEYETNEFLDDLVVDGQSIKMHVTPGGKDSNRACCMVAIRCGSDDQEPIKVDCVGKNLIINARDALIVIVAQSTYRCDDADLDRATVADLEAVLASSVEDIWARHITDYQSLYGRLELNLGPDATDIPTDQRILHVRGPELVAIYLRYSRYLLISCSRPGRKGSSDRVLPATLQGIWNASFHPPWGCRYTININLQMNYWPANVGNLLECEEPLFALLERLAVTGTETARKMYGCRGWTVHHNTDLWADTAPVDRWMPATLWPLGGAWLCTHVWERFLFNGNKAFLKRMFPVLRGCVEFLQDFLVDDVSGQYKVTNPSLSPENTFRDEKGQEGVLCEGSTIDIQLVRAVLKAFVESLEVLGYSQDELLPSVHDTLRRLPPARIGSKGQLQEWMFDYDENEPGHRHVSHLWALYPGNDINLETTPELAKACAVTLQRRQAAGGGHTGWSRAWLLNLHARLRDADECAEHLERLLAQSTLPNLLDTHPPFQIDGNFGGGAGILEMLVQSHEDGIIRLLPACPLAWRSGRLRGVRARGGFELEFEWKDGVIRGPEASAFFYTSHSRCEDSTTYGKHNALGISTIMDLTSVQDLKGALRNDFFHGYATAAAQVEGAWNKDGKGPSIWDTFGHTPGKVKDNSNADDAVRFYDFYREDVALMKSYGVNAYRFSLSWSRIIPLGGADDPVNEQGIKYYQDLVDELLNNGITPFVTLFHWDVPQALEDRYGGMLNQERFIPDFVRYARVCFERLGPKVRHWITFNEPGVYSLAGYAAGVHAPARSSFRELNEEGDSSTEPFIVGHTELVTHGHVSKLYREVFQPQQKGTIGITLHGNWSEPWDEDDPRDQEAAERAREFEIAWFADPLYKTGDYPASMRAQLGDRLPRFTPEESKLVLGSSEFYGMNSYTTFFVQHKDTPPDINDHKGNVIVHDTNSKGVSRGEESDTPWLRTAPTGWRKLLNWIWNRYHVPIYVTENGTTAKGETAPTPEVLIDTFRMRFFEGYVGGLARAVKEDGVDIRSYFAWTFTDNWDRKGPIQMVEIFRRSYASTVRPATAPRPSPNVKHVRENAELYAQNCRDRNYPAHAEYPFKIQQLSEELRQIDKQLMPFRSRIKALERTIGRLQNPATGPEEKEQEPAIRAEAQQLKNESAALITRRELCDEQIHDLALSLPNLTSPHTPVGLEPALVEYLNFDPQSPPAWVSSPDPLRSHVSIGTDLGLIDFTSAATTTGWGWYFLTGDGALLEQALIQYSLSVARRHGWTPISPPSIVWSYLTEACGFQPRDQNNEQQIWAIEQAEKDKAKPPRSLAATAEIPLAAMHARNELDPAALPIKLVGPSRCYRAEAGSRGVDTKGLYRVHEFTKVEMFGWADSSPTSSSPTSDDLFEGLLTVQKEILTSLQLPCRILEMPTSDLGASATRKRDIEALFPSRMRGNGLEDAWGEVTSASICTDYQSRRLGTRVRGVKSVFPHTVNGTAVAVPRVLAAILENGWDAERKVVVLPEVLRPFMGGAEVIGK

SEQ ID NO: 23558 - protein, 329 aa, Aspergillus nidulans FGSC A4
MILLQWSWQILINCDTECEMAHHELQECLVSDTIGTETVHIPAEDNAGVPSDDTMPTAMYGWLDTNVPADLMAFTHTPLPEENSPISVERYGDGNATRPWYTVAQYLLELVEWLQGSISFETTVVSVEKTWSGKWRLTLRRPEAVEGGKRDLWWQEEFDAVIVATGQYSEPFLPKIPGLDRVVNTHPETLEHVNAVRSREQYASKRVVIVGGSFSASDAVGDIYMLVRGPLYVSRSSHSPYITEIWNLSNVEVRPTIGQIEGQDRTKLKLTFSDGSKLDDVDKLIFATGYRFSVPFLSHQPVIKADRVPGTYQHVFRIGDPSLAFSRAC

SEQ ID NO: 23559 - protein, 1279 aa, Aspergillus nidulans FGSC A4
MSFLGGAECSTAGNPLTQFTKHVQDDKSLQRDRLVGRAPGMQEGMRSQGMMGGHDQMMDEFAQQSAQLPGGPQQHMRMEMEQVRQQLEQMHTTPRTGSPGWAAEFDPGEQARMEAAFAGPKGPMMNNGSGFTPAEFARFQQQSTMSVPQSASPVTAGQSPMMGGYQRSMGMGYMGYGGMGMMQPGFGPMGMQHQQPAEASTQDKGKGRMIELDDENWEAQFKEIETADQGKLDDEANAAIEAELNDLDRSVPTTSSTEDLSHFERVWERVQAETATNRKLAEDSEYNIDDNLHMGDMAEWDGFDNLNTRFREPRLGDYSFEQENVFRDIANPFEEGMKIMQEGGNLSLAALAFEAAVQKDPQHVKAWTMLGTAQAQNEKELPAIRALEQALKVDPNNLDALMGLAVSYTNEGYDSTAYRTLERWLSVKYPQIISRDDLSSDADLGFTDRQILHERVTDLFIQAAQLSPSGAQMDPDVQVGLGVLFYCAEEYEKAVDCFTTALASTESGTTNQREQLHLLWNRLGATLANSGRSEEAIEAYEQALNINPNFVRARYNLGVSCINIGCYPEAAQHLLGALSMHRVVEEEGKERAREIVGGNDGRINEAELNRMITANQSTNLYDTLRRENTVMAIRTGAQIIARSLRDLGVTVIFGIVGIPVVEIAEEAINLGIRFVAFRNEQACSYAASVYGYMTGQPGVCLVVGGPGVLHALAGIGNSSANNFPLLVLAGSAETSAVTKGAFQELDAISLLTPHTKFAARASSLDFIPDAIKNAYRTCWYGRPGPTFIDLPADIIQGKLTSQFELPKPENLLVSAPPKASGDPALILKATQLLKAASAPLIIVGKGAAYARAELGIRKLVDQTQVPFLPTPMGKGVVPDSHPLNASSARSAALKHADVVLVLGARLNWILHFGEPPKWSPKVKIIQVDICAEEIGRNAGTSELGILGDISLVVDQFRASLSSWKYSSSAKFPLLLAESAKKNEDKAQKAALRQTPAGKPLTYQRAYHIIKTALNALTPVEDGNIVYVSEGANTMDISRSIFPLYHPRQRLDAGTYATMGVGMGYIVAAHEAFNANPGASTSRPKKIVAFEGDSAFGFSAMEIETLARYRIPALIFVINNSGIYHGDSISKEDWKTLQNQTVANDTKTSESDSGTNAKTKGLRSTSLLYETRYEMLATMCGGKGYFVKSEEELERATKEGFDTLFAYFFVIFVAENLMRSHAPSSIAEWRCFTLISTTSTWKLNPIHRYITIGSQLASLLISMGLWVPTVAVRPCAVSRM

SEQ ID NO: 23560 - protein, 490 aa, Aspergillus nidulans FGSC A4
MSGIISDVAFNDVFTATKDDATMQALVTAVYELGCLAGAVYALMFGDRMGRRWMILSGAAVMILGVIIQVTSFPGHIPLLQFFIGRVITGIGNGMNTSTIPTYQAECSKTSNRGLLICIEGGIIAIGTAIAYWIDFGSHYGPPDLVWRFPIAFQIIFGIIIVVGMWFLPDSPRHLIAKGRIEEGEYVLAALNGCEVHDHETQIQKQLTLDSLRASGALGKKTSFRDLLTGGPSQHLRRMLVGSSSQVFQQLGGCNAVIYYLPVLLKSNLHQDNDQALLIGGINMIVYAVFATFSWFFIERIGRRKLFLGGSMVQTTAMIITFACLIPGDEQSSKGAVFGLFLYMAAFGATWLPLPWLYPAELSPVRTRAKANAVSTCNNWLFNFAVVMFTPPMVAAIGWGTYLFFAAWNAFFIPVIWFFYPETANRSLEEIDLIFAKGYHEKISYVRASHELPKLSDDEIEAEAAKYQYSPETEAEVEKGHVAHPGSTSE

SEQ ID NO: 23561 - protein, 480 aa, Aspergillus nidulans FGSC A4
MAPRYDSVAVIGTGPSGLSTLKALVDEGTFSRIRVFERRDRVGGLWHYDPVPDVFPTPGAPHIRNEIPASLPAFTEPVAEDTTARTGIHDQLDSNVGSGTMSFTHTPFPEVNSAVSVRQLGRGNPSRPFRVVSGYLEDLARPYLDRISFNTTVERVEKIDNRKKWRITARQSGHFQRNKPAEYWWQEEFDAVVVASGHYNVPLIPEIDGLAEAHKALPGHFEHSKSFRSANDYVDKRVVLVGGNISSADLIADLHAVVRGNLYLSQRGGNEALANVFSLPGVEIRPTIGRVDAEKAGLTVTFTNGSTVADVDKLIFATGYRLVYPFLVPDPVTPSNRVAGLYQHIFKIGDPSFAMVGQVRGALSFRVYEYQAVAVARYFANHNAKPLPSPAEQDEWEVGRLKYKGPTTLFHEIKPDFKEYFEYLREFAGPPGPGTNGYELPVFGEDWPNLGFAILQLKDKYWQSIKAASQNGKEKVQAKL

SEQ ID NO: 23562 - protein, 1084 aa, Aspergillus nidulans FGSC A4
MYLFRILAILTAFTCASAGRLPSRTCVVPASGTNETDDAPAIISAFERCGRGGKVVFKPTTYYVNSVMNISWLQDVDIDLRGNLLWSTDIQYWLNNSLEVGYQNQSTAWILGGDNVRIDGHGIGTLDGNGDYWYEWISQQENTSNYPGRPIALTLSELTNSVVKGVNFLRSQMWTLAIIYSHHVEFDSILVNNTGNRVDSSNTDGADTIRSSHISFNNLTVYNGDDSISFKANSTDITLTNSHFYNGLGVAIGSIGQLKDQFETVERVKVENIVYENTLHAVYFKTWTDDQNGYPPNGGGGGLGYASNMLFKDLDTTSLRGSAVAISQCTRFSGAPGEGNCTNSQFQIRDITVANLHGTTKSERVTSFQCSAVAPCTNIGVFGVDLEFANGTKAEEYLCGNVKNPRGFPWATYTQKDPSNNSSMISLPLLALATGAVASASCWRNTSCTGPSKPSFPGPWDSNNFAPGSRLIQPKSILSLPDGTYISDYTSDSHPSITTEDAGLVFDFGLEVGGIVTIDYSSSVPNTTLGLAFTEAKDYIGRTSDNSNGGTGADGALATLLTEGEGSYTMPDSQLRGGFRYLALFIPSSSSSNASLTIQSITLELAFQPTWSNLRAYQGYFHSSDPVLNKAWYAGAYTLQTNSVPRTTCRVSVSSATGWNNNAVCGPGETLLLDGAKRDRWVWIGDMGVAVPSASVSTGDTESTKNALLAIWDNQTPSGLLPKAGPPYLRADSDTYHLWTIIGTYNYFLFTEDYDFLAGIWQKYVKALDYSLAKITPLGIMNATQTADWGRWNYGTLASSANMLLYRSLTTAAFLAPYAGDNPENYTDLASTLRSAIVTHLYDSAVGAFRDSPNSTLYPQDANSMALAFSFFSQSPLNCSSSFNLAEAARVSSYLESNWTPIGPEVPELPNNISPFISSIELEGHFASGHADRAIELIRMLWGWYLAHPNGTQSTVPEGYLVDGSWGYRGDRGYRNDPRYVSHAHGWSSGPTSTLTEYAVGLKITKPKGSEWSLRPASFGIQGFEEAQAGFTTGLGKFKAAFRVQGKRATVTWDTPAGTKGWVQLPGEEGSWVEGGMGSLTVKL

SEQ ID NO: 23563 - protein, 377 aa, Aspergillus nidulans FGSC A4
MVAETKLYDALGIKPDASQEDIKKAYRKAALKYHPDKNKDDAKAAEKFKEVSQAYEVLSDPEKRKVYDQFGLEYLLRGGPAPTPGGGGPNPFEGGGMPGGFSFGGMPGGGTRTFHFSTGPGGSGGFQFSSADDIFRNFTKASGGMGGFDDDDIFSMLGGGLGGGARSGGPRFRSSRGASASGNGAGAGFQRQSQRAPTPEPTVVEKQLPLTLEEIMSGCKKTVTVKSKTFDASGKRTVQDVTLEATIKPGLRTGSKIKYRGVGDQEEGGRQDVHLIVTEKEHPNFKRHGDNLITTVDLSLKEALTGWTRIVRTIDGKSLRVSKPGPTPPGYEEKFPGLGMTISKKPSERGDLIVRVNVEFPKTLSSSAKEVLRDILP

SEQ ID NO: 23564 - protein, 512 aa, Aspergillus nidulans FGSC A4
MGFMLRKPDDAAGSAAPAILIGLFVAFGGVLYGYDTGTISGILAMKYWRRQFSTGYVNPNDHIPDVTSSQSSMIVSLLSAGTFFGALTAAPVADYFGRRIAMILDCFVFCFGVVLQTAATAIPLFVAGRFFAGFGVGLLSATVPLYQSETAPKWIRGTIVGAYQLAITIGLLLAAIVNNSTKDRNDTGCYRIPVAVQFAWAIILVVGMIILPETPRFLIKQDNHEAAIKSLARLRRLDINDLAVVEELEEIKANHEYELSVGKASYLEILRGSIVTVYYGTTFFQHSGINNSFVITLITNIVNVVSTLPGLWMVEKWGRRPLLLFGAVGMCVSQFIVAIVGTTTDSGVANKVLIAFVCVYIFFFASSWGPVAWVVTGELFPLKARAKCLSITTAANWLLNWAIAYATPYMVDSGPGNANLQSKVFFIWGGFCLIAGIFVWTCIYETKGLTLEEVDELYAKVPVAWRSKGFVPSVHYTDVRDVAAGRKGSGLAELEADAQAKQISEHVEKASV

SEQ ID NO: 23565 - protein, 1045 aa, Aspergillus nidulans FGSC A4
MGSSSPALSTLAGPTYVTAQTLIQQVAYALSDKVFSYSPDSFDLDAAIREWALKQELNANGEAPAVQAMETRQGAGNIALGYLFSQDFDLKKRHVPQGIVASSATLPYMRAALEQLSLLYSVASPVAAHVAAVDYAGEDGLVSDYVSALSLAEELGLGLVSSASAHESQHMALLTTLLASVLPSIHIYDGVRVGRDNTRVIDVLDQAGLGRVYETVRKTLDDQRSRHLDSQGKLLELIRSLNGELGTDYGAFEYHGHAEPTSVLVAFGTIEASLTAQVARSLAKDGVRVGVVNVRVYRPFVEEEFLRVLPKSVKTVGVLGQVANEQAVQEPGVRSTLYEDVLAAVTFATDREQAPSCIDIKYARSQRWDLINIAASFQLVSDKPIVQVDSTVEPLQLLDPATVQEFTFWDVDTSAAVDVATIISQTLAADSASNITTSKAFDNLIQGGVVRVDIRKSSKTLDAPYPVNAADTAYIGNVKLLSELDILSSVKNNGKVLLNVAGIKGDELEKKLPAAFKQAIAERGIGLHRFDASVIEEPALEPLALQVAFLHVALPAIEESAVKKLAAISGNADSLDKVSKDLEKTLLQAEIPESWKSPEEGAEVAQLVKDLKPNSFVPFDKDESEPATFLKDWQTVAKGLAFKEAYGAQNALRPDLPTKTFTVHVKENRRLTPVTYDRNIFHIEFDLGDSGLTYDIGEALGVHCENDPEDVLEFIKFYGLNADDVVEVPSREDPTVLENRTVYQALMQNVDIFGRPPKRFYEALAEFASDEKEKKDLLTLGGPEGAVEFKRRAEVDTVTYADILLEYPSAHPDFHDLVRIVSPLKRREYSIASCQKVTPNIVALMIVVVNWVDPRGRDRFGISTRYLSRLQPGTPVTVSVKSSVMKLPPKSTQPIIMAGLGTGLAPFRAFVQHRALEKAQGKEIGSVLLYMGSRHQREEYCYGEEWEAYQEAGVITLLGCAFSRDQPQKIYIQDRMRETIPEIVQAYIREEGSFYLCGPTWPVPDVTAVLEEAIAIEAKNTGKKIEPRKEIEKLKDEERYVLEVY

SEQ ID NO: 23566 - protein, 1466 aa, Aspergillus nidulans FGSC A4
MGVPDELPPGSSETDTIVSSSQPTNRSPMDLISEAESLNLRRIATNQSKAQCRPGSAAVPSHDNPPNDDLEDATLDPNSASFSLEKWLRAAVSDASQHGLSTPSGGILFRNLTVSGSGSALQLQPTVGSVLTAPLRFASLLRHRRIEPRRILHGFDGVMKTGELLLVLGRPGAGCSTFLKTVCGETNGLHIDADSVLHYNGVSQQRMMKEFKGEVVYNQEVDKHFPHLTVRQTLEFAAAARTPAHRFQNMSRDEFASYAASVVMAIFGLSHTHNTKVGNDFVRGVSGGERKRVSIAEMALAMTPFAAWDNSSRGLDSATALKFVQALRLSADLAGAAHAVAIYQASQSIYEVFDKVTVLYEGRMIFFGPTGTAKEYFERMGWVCPARQTTGDFLTSITNPLERKARAGMEDVVPKTPKDFEIYWRQSPEYKTLLGEMTEFETQHPTGNDEQASAELRARKENSQSRNSRAASPYILSIPMQIKLNTKRAYQRIWNDMSSTMSTVVGQIVIALITGSVFYDSPNTTAGFQSKGGTLFYAVLLNALTAMSEITSLYSQRPIVEKQASYAFYHPATEAIAGVVSDVPVKFLLAVAFNVIMYFLANLRREPAQFFIYFLMSFTVMFVMSAVFRTMAAVTKNAAQAMGLAGVLMLALVVYTGYVLPVPSMHPWFEWIHYLNPIYYAFEAMIANEFHGRDFDCIAFVPSYADLDGDSFSCSSLGSVAGERMVSGDSYINFNYTYTYSHVWRNFGVLLAFLIGFMAIYFLASELNSSTTSTAEALVFRRGHVPEYMRPGYTRPTDEEKAVTQSDIKPSSPSPTNTDLPLPPQRDIFTWKDISYDIEIKGEPRRLLDDVSGWVKPGTLTALMGVSGAGKTTLLDVLAHRTTMGVITGDMFVNGKGLDASFQRKTGYVQQQDLHLETATVRESLRFSALLRQPASVSIREKHDYVESVIEMLGMGDFAEAVVGTPGEGLNVEQRKLLTIGVELAAKPKLLLFLDEPTSGLDSQSSWAICTFLRKLADSGQAVLCTIHQPSAILFQEFDQLLFLAKGGKTVYFGPIGPNSRTLLDYFESNGARKCDEAENPAEYMIEVVNAEVNDRGTDWFDVWKGSKECQAVKEEIERIHEKKRGTAGAIEETDDGSTKSEFAMPFWFQLYVVTVRVFQQYWRMPEYIISKGALAIVAGLFIGFSFYDAKTSLAGLQTLVFSLFMVCALFAPLVNQIMPLFITQRSLYEVRERPSKAYSWKAFLIANILVEIPYQVLMGILTFVCYYYPVVGSSQGPDREGLVLLFCIQFYVYASTFAHMCIAAMPNAETASPIVILLFSMCLTFCGVMQPPDALPGFWIFMYRVSPFTYWVAGMATTQVHGREVVCGENELSIFDPPTNQTCGQYMERYISVAGGQVLNPSATAGCEYCSLTVADEYLAASQIYWSDRWRNFGLIWVYIGFNIFVATAVYYLFRVKKWNGRRKK

SEQ ID NO: 23567 - protein, 1411 aa, Aspergillus nidulans FGSC A4
MPARLHSRPQGNSTLASSQEAGDHADRPSSPQVHLTYEDEDAIAEIHRTLTKKDHDYSEPHLSFDKFLEEELRAGRKKPNLGVCFQSLSTWGTGGEHVNVKTLGTALWRTLIFQDVYEWTIKPWLAKPEPESGRSGCSTFLRTIAGYHSSFLGVTGSIAYSGLSLEDVRKHYRGQVAYVPEDDVHFPTLSVRQTLEFALQSKTPKRYHDRIPRYLEIYGRVFGMSHTMDTLVGNEYIRGVSGGERKRISIIESLATDSSVMCWDNSTRGLDASSALDYARSLRIMTDTCGKATLMTLYQASDAIYDLVDKVLLIDEGRMLYQGPAHEAKAYFHDLGYECGPMQTVSDFLTSITIPERRKFREGWEQRAPKGPIELEQAFRKSAAFMNVQKEVRSYDSQGFGGRSRAESHSDTDYESLEDVKEALQTDKSRFVSSKSPYTISLFRQVVLCAKRQIWQIRGHMSPLYIKLISSVIYGLLVGSMFYDQPQTTDGMYSRGGVIFYSSILLAWLQMSELEEAMQGRDILSRQKKFAFVRPSAVCLARVVADIFIAALLTFLYLVVVYFLSGLKSDAGAFFIDFLFIYMCTISLTAQFRLFAAASSNFEVALRYTGFLVLLCIVFGGYVLSVDKMMADVPWVGWIAYITPALYTYEAMMAAEFHNTNFTCSPASVVPAGPVYTDIAYQTCAYAGSQIGSTIVNGDDYLAVKYGFYFSHVWRNFGILCLFTVASVAATCLLSEIMEWEPDSAGPVQYKKSRKQLRKIANISDEEERPVQVNQTSPSASDTDGPSVGALTATKSTFTWDNLELFVRVGKENRKLLDGVSGYCKPGTLTALVGASGAGKSTLLTALTQRQSSGDLTGTIIGYCEQMDIHDESSTIREAFEFSALLRQDSTVPDQEKLAYARTVLETLDLVELQNAIIGSLDIEKKKRVTIGVELCARPELLLFLDEPTSGLDSQAASSICALLRRLADQGLAILCTIHQANQEQFEMFDRVLALSPGGKTYYFGEVGEAGHSIFDYFAKYGQKPENITNAADYIIEVVVGGMKNTASTVDWAAVWNQSVEAQQVQQDLERFRNMKQESLPSLDMQSQAMPAISRQIFLLTQRTSRQFWRSPEYPYSRLYASFLHALINCLTYLQIGNSTTDLQSKAFSCFLVLMLVPEFINAISARFIMNRDLWKAREGPSGAYGWVAFCTAQIISEIPYAIISAVVFFVLYYFSVGLPLGFAAGYSFLMFFLFFLFATSWGQWIAALSADSVVAATLMPFFIIMCETMNGILQPHKYMPAFWAYTMYYVTPFTYWIGGVLTSVLRGVPVICDENELTVFQSPPNITCSEYAGSWLAEKGVGYLSNPDGSGECGYCEYSYGDDYLSTIGLDSSKIWPYFGIFVAFVVSNYLMVYLLVYIRSVMKPFRRRT

SEQ ID NO: 23568 - protein, 336 aa, Aspergillus nidulans FGSC A4
MPSQDVPLPEPFASVPRETLTFGPSPIQYLPNITAALGGKVNIYAKREDVNSGLAFGGNKTRKLEYLASDALAQKADTLVSIGGFQSNHTRQVAAVARKLGLEVALVQEKWVDWDDKNGVYDKAGNIQLSRLMGADTRLDMSGFGIEHKLTLKNLEEEIRARGGKPYYIPAGASDHPLGGLGFARWAFEVEMQEKELGVFFDTVIVCAVTGSTMAGMIAGFKLAQKVNGSRKRKIIGIDASATVEQTFEQILRIAKFTGVKIGLDEEDITAEDVILDDRYHAGVYGIPDEATIEAIKFGARTEAFITDPVYEGKSLNGMMDMGLLSCCRIVFRVKS

SEQ ID NO: 23569 - protein, 485 aa, Aspergillus nidulans FGSC A4
MSAKSIFEADGKAILNYHLTRAPVIKPTPLPPSNTHNPPPKLASLYFPDDLSVKDVLDQAEVTYPWLLTPGSKFVAKPDQLIKRRGKSGLLALNKTWAEAREWIEARATKEQQVETVVGVLRHFLVEPFVPHPQETEYYINIHSVREGDWILFTHEGGVDVGDVDAKAEKLLIPVNLKNYPSNEEIASALLSKVPKGIHNVLVDFISRLYAVYVDCQFTYLEINPLVVIPNADATSADVHFLDLAAKLDQTAEFECGTKWAVARSPANLGLAALPTSDKVNIDAGPPMEFPAPFGRELSKEEKFISDMDAKTGASLKLTVLNPNGRVWTLVAGGGASVVYADAIASAGFVSELANYGEYSGAPTETQTFNYARTILDLMLRSPIHPDGKVLFIGGGIANFTNVASTFKGVIRALREVAPVLNEHKVQIWVRRAGPNYQEGLKNIKAVGEELGLNMHVYGPEMHVSGIVPLALQGKQTDIKEFGTA

SEQ ID NO: 23570 - protein, 508 aa, Aspergillus nidulans FGSC A4
MALWKDQTSQIQNEVDEASPGSNHDYDHDPALDEQEERGVAKCHRQALGEMATAIPVTGSFTEYAQRFVDDSLAFGLGWAYWYLWVTVLANEYNAVSLVIMYWTDAVPQWAWILIFWILFLGLANFGVRAYGEMEFWLSLYVSPCVRLVKRALADPRRIKVLALIVFFILAICISTGGIGGDVIGFKYWHNPGAFADSINGVARTFVVAGTLYAGTEMVGITAGESSNPQKAVPIAIRQVFWRILVFYIGTMFFIGILMPYTEPQLLNSSSYGANSPLTIALSSAGILPAAHLINALIVVSVISAGIGSLYVASRTILFMARNGKAPKILGRTNAAGVPWVAIIFSNIFTCIVFLTLGESAGKVYNALITLSGVATFLVWTSICIAHIRFRAALTAQGQSPSTLPFRAALYPYGTYFALVLNIFMIFFQGYTAFLNPFSSDDFVINYILLPVFVLFVVGWKVWHKTKIVRLEDMDIWTGRRERAPEVEESSRWKGKGWREKVWRGVVG

SEQ ID NO: 23571 - protein, 495 aa, Aspergillus nidulans FGSC A4
MVDRDPGTPTWKFTQCFGDKGDVEDITEADIISTVEFDHTGNYLATGDKGGRVVLFERNETKKTCEYKFHTEFQSHEPEFDYLKSLEIEEKINKIKWCRRQNASHFLLSTNDKTIKLWKVFDKSLKVVAENNLSTELTPGGVGGGGAPRAPRVSFKDSSALKLPRMTHHDTVVAAVPRRTYANAHAYHINSISVNSDGETFISSDDLRVNLWNLNIQDQSFNIVDIKPANMEELTEVITAAEFHPTSCNWFMYASSKGTIKLADMRQRALCDTHHKRMCFSSLSSSRDTFESSSNLPYVVFEQEEDASSRSFFSEIISSISDVRFSHDGRYIVSRDYLTVKIWDVNMERQPVKTIPIHEHLRPRLCDTYENDSIFDKFEVVFSGDAENVMTGSYNNNFMIYPTDPAKETEIVLQADKSAFKAKKVGVPTPMNKGANGKKSNSRTSSPAGPGSRMKKETDADQIDFNKKILHMSWHPFEDSIAIAATNNLFVFSAL

SEQ ID NO: 23572 - protein, 502 aa, Aspergillus nidulans FGSC A4
MKPPYYMETGCKRNPGSDSTLKVRWTLYTRLLQSANQGLGIDPGSGQVFASCPTNTVADVDAYVSSAHRSFLSYRETNPRARAKMLLNWHNLIAQSKNDIAKLVVYETGKPMAEAVGEVDYALGFAWWFAGEAERVRGSIAQPSISERRTFVIKQPIGVCIALVPWNFPVAMIIRKAAAALAAGCTVVIKPSPETPLSVLALADLALQAGFGPGVINVLTTDNLNTPDVSEALCKHPLVRKVTFTGSTAVGQLIARHCSEGLKKVTLELGGNCPFIIFDDGDLEQALAALMILKWRTAGQACTHANRVYVQSGVYDTFLRMIVNATKQLKVGHGASPGTTMGPLTTSRGIEKLERHVADALAKGARLELGGHRLQLEGNYFQPTIISGMSAYMLTTQEEIFGPLLGLYRFETEEEAVRMANDTSMGLASYFFTRDVSRTWRLLENLEAGMIGMNTGNSSAAESPFGGIKASGYGKEAGKDVAIEEYLIAKTGTLTVGAVSKL

SEQ ID NO: 23573 - protein, 350 aa, Aspergillus nidulans FGSC A4
MSIPTMQWAQVAEKVGGPLVYKQIPVPKPGPDQILVKIRYSGVCHTDLHAMMGHWPIPVKMPLVGGHEGAGIVVAKGELVHEFEIGDQAGIKWLNGSCGECEFCRQSDDPLCARAQLSGYTVDGTFQQYALGKASHASKIPAGVPLDAAAPVLCAGITVYKGLKEAGVRPGQTVAIVGAGGGLGSLAQQYAKAMGIRVVAVDGGDEKRAMCESLGTETYVDFTKSKDLVADVKAATPDGLGAHAVILLAVSEKPFQQATEYVRSRGTIVAIGLPPDAYLKAPVINTVVRMITIKGSYVGNRQDGVEALDFFARGLIKAPFKTAPLKDLPKIYELMEQGRIAGRYVLEMPE

SEQ ID NO: 23574 - protein, 458 aa, Aspergillus nidulans FGSC A4
MPFHADIPQFQPTNDDIERTQAEKKHKETPTMAVDEQKAESVPYRQDVFGDEEHAEVKYKVLKWWQCGLLMVAETISLGILSIPAAIAGLGLVPAIVILLVMGLIASYTGYVIGQFKWRYPHVVSMADAGEVLMGRFGREVLFGGQMLFLIFLMASHILTFTVAMNRLTNHGTCSLVFGVIGLLVSLVFSLPRTMKNMSWLSLASFISIFTAVMIAMVAIGVEHPGGPVKATAETNLVTGFTAALNIILSYASHNAFFNVIAELKEPRDFPKALTLLQCIDITLYLVSGVVIYYFAGDDVKSPALGSINPLVSKVAYGVALPTIIIAGVINGHIACKSIYTRVFAGTSHMHKQDFRAVGSWIGIAVGLWVIAWVVATAIPVFSNLLSLMTALFASWFSFSLPAAFWLFMNRGLWFSSPRKTGITIFNCLVFGMGVVMSLGTILLACICVSSGNGKSSS

SEQ ID NO: 23575 - protein, 511 aa, Aspergillus nidulans FGSC A4
MADLFVDLVAPNGTHYSQPTGLFINNAFVASSGQTITSLDPATDKPIATVHAASAEDVDRAVIAARAALVHPSWKKLPGTERGQLMARLADLMEKNKELFATIDAWDNVLSLTEKSGKPYHIALSEDLVEAIGTIRYYSGWADKTFGQTISTTPAKFAYTIRQPVGVVGQIIPWNYPLSMACWKLGPALACGNTVVLKPAEQTPLSVLVLGSLIKEAGFPPGVVNIVNGYGREAGAALAGHPLIDKIAFTGSTVTAREIMKLAAGTLKNITLETGGKSPLLVFPDADLEQAVKWSHFGIMSNQGQICTATSRIYVHQDIFQLFLSKFKAAVETTSKIGDQWDESTFQGPQITRAQYDRILSYIETAKKGGMAVVTGGSAHAPSSEKNKDGYFIQPTVFTGTDDSHAIVREEVFGPVVVILPFASEEEAIRRANDTTYGLGAAVFTCDLERAHRVAAEIEAGMVWVNSSQDCDPRVPFGGVKQSGIGRELGEAGLEAYTQVKAVHVNMGNKL

SEQ ID NO: 23576 - protein, 1009 aa, Aspergillus nidulans FGSC A4
MPEYTESRDSIKNIWGERTPYKHQWPTRCDSHLVDTPDTWVQSACVLCSNGCGLDIGVKEGKVVGVRGRTVDRVNKGRLGPKGLNGWVSINHPDRLTHPLIRRNGKLERASWDEAMSLIVERAKDIQTRLTNHGIAFYTSGQLLLEEYYVLAMVGKAGLNTLHMCATLNLSPSYRSQDAKPMNRDGNTRLCTATAAASMRESFGSDGQPGSYADIDYTDCLFLVGHNMAATQTVLWTRVLDRLEGPNPPKLIVVDPRTSDTAKKATVHVRPRLGTNVALLNGLQHLIIKNGWVNDQYVASHVCGLEELKKVVEKYTPEYVEKITGVPVAQLHETAEALALSGSLLSTALQGVYQSNQATAAACQINNINLLLGHIGKPGSGILQMNGQPTAQNNRETGCDGEFPGFRNHQNPNHIRDIARVWNINYEQVPHWSEPTHIMNMLNYIESGSIEMFWVSGTNPLVSLPHLYRVRQLLTKPDLFVVVQDLFLTETAAIADVVLPAAQWAEKTGCFTNVDRTMHLSRKAVDPPGEAKADLDIFLDFAQRMDFRNRDGGPLIPFTNPEEVFEEWKKMSYGRPLDCSDLTYEKLSGGSGIQWPCTKEYPFGKERLFDDGKFFTDTDYCESYGHDLETGTPLTKGQYEAMNPAGRAILKAAHYRKPWESPDEEFPFYLSTGRNVFHFHTRTKTGRSKRLQNADKDACLVICQADADELGVTNGEMVIVRSRRGQVELPVKTEGISKGHVFIPFHFGYWDSKDQRARAANELTIEQWDPVSKQPMFKSGAVRIEKCVQKENEPPISRERQSEAIQNVEANKANATETRKDGQDSRVRWLEMWLGATHESLEMLRQIYDKLIPQLVHDLEIQAGLGVMRRITADIIAKLEPIVHRYHESRVYGRRVCERLRKALFPMEDDKDNSYETLIVLQSLEMFLTYIDGHLTALSPASQALWDQEFVDAVSFAAQHIQRQKAWVNTHIKVKSPQTLLVPQRPPMEVDADRDEEAAENVLVREFYY

SEQ ID NO: 23577 - protein, 449 aa, Aspergillus nidulans FGSC A4
MGFKRTIGLLLGILLALDQVSVLAQPGRPTFAKRPDIQPNPIQPYKAIPLHSRRNSHKVCYVKPSLNGGDDAGRVEAALRRCNNGGTIVLDKEYSICTPLDLRFLKHVDVALTGKVEFCPELEFWQQNVFQFHFQNASSWWVWGGEDIHLYGAGTGVIHGNGQPWWDAAAGNSSVRRPLLFITDGWHGGSITGLKLRQSPNWHNFIANSSDLLISDMDIFSRSSSEAWASNLDGWDTFRSDNVVIQNSVINHDDDCVSFKPNSTNIIVQGLHCNGSHGISVGSLGNYPYQYDIVSDLYIYNNTMANTTTAARLKVWPGAEAVKKGNPPWVGGGGKGYVRNVTYDLMINDNNDLAIQIDQCYGAINASECLDHPSGVILTNVLFKNMWGTSNGANDPVAGQLICGSADSCDNIRAENVTLTNSSGQPSEWQCRYMDEELLDLGGVGCIPA

SEQ ID NO: 23578 - protein, 356 aa, Aspergillus nidulans FGSC A4
MSIPTRALGRNGPEVSSVGLGLMSIGGIYGAAPSDEDRLALLDRAHAIGQWFWDTADVYFDSEDIVGIWRAKNPIKAKDIFLASKFGITMRKDGSQTVDTSPEYARIALKRSLERLQTGTIDLYYAHRVDGKTPIEKTVEAMAQFKKSSRLPLVFSRTNTNYREGKIRFLGLSEVSADTLRRAHAVHPITAVQVEYSPFTLDIEDPRVALLETCRELGVAVVAYSPVGRGLLTGRYVTRESITKDFFLSVLPRYSEENFPAIQRLYESIKDVAEKKGVTPTQATLAWLLAREPFVIPIPGTRSIKYLVENTASAQIQLTDDENRRITEAANATKLVGARYPAGFPENYEFGTTPEL

SEQ ID NO: 23579 - protein, 282 aa, Aspergillus nidulans FGSC A4
MHAIEPFWGPQTSYLNFCEEDYVITRYVAEFINTLSSLIYCSFGLFGLYQLSQRKQGSFSRCIPYYGLIGVGVCSAGYHMTLKYHTQMSDELSMHLLTTPLLYRILTFQKTESYTRRVGVILSILFTIVMVTHMIMDEFLLHAVSFGAAVLLITIKTIKTIPQQIHDSDIRLNIKIVSRFGLICFISGYALWLVDNFLCLSLTSVRSVLGMPLAFLFEFHGWWHVLTGIGGYIAVAVVDLITAGEAGRDPTPDMAFPVPLATRAIRGLINRKGDGNKKGNCP

SEQ ID NO: 23580 - protein, 434 aa, Aspergillus nidulans FGSC A4
MSKPAIGFVGLGAMGFGMATHLVKQGYPVHGFDVFPASVERFKAAGGIPASSLRESAEGKSYYVVMVASSPQAQSVLFAEDGIVQHLPPNAVLMLCSTVSSMYAQSVVTELQNRGRSDIRFVDCPVSGGALRAANGTLSIMAGASDEALAAARDLLQEMSDENKLYLVPGGVGAGSNMKMVHQVLAAIHILGASEAQGFAAQLGLDARATAEKIQSSDAWTWMHENRFPRMVEEDWNPGVSALTIILKDAGIITTTARQQRFPSPLCSTAEQTYISALLHGWGPKDDSAMVRQYYAKPLSDVTPCTDAEAATELVLDYMRGVNLVAAAEAVAFARYLNVDLSMFHVLVSQAAGASKIFIEQGLEMIEGRIGDKAPAGSPTVDQVATKLESAVQKARDLHCPLHLGNEALNLLFMAQRHGWGDQSSTSVIRVYGQ

SEQ ID NO: 23581 - protein, 409 aa, Aspergillus nidulans FGSC A4
MFNKLSGQPESYEKKSLYRFGRTLGAGTYGIVREADCSSGKVAVKIILKRNVRGNERMVYDELDLLQKLNHPHIVHFVDWFESKDKFYIVTQLATGGELFDRICEYGKFTEKDASQTIRQVLDAVNYLHQRNIVHRDLKPENLLYLTRDLDSQLVLADFGIAKMLDNPAEVLTSMAGSFGYAAPEVMLKQGHGKAVDIWSLGVITYTLLCGYSPFRSENLTDLIEECRSGRVVFHERYWKDVSKDAKDFILSLLQVDPAQRPTSEEALKHPWLKGESASDRDLLPEIRAYIARSRLKRGIEIIKLANRIEALKMQEEDEEDIPSAVDVQASEASDKSGLSPFPALSTENSNTHPASTGNGESGGTKKRSLSKIARGAIFREVVLAKVREMKENEEREKVEREARERAHS

SEQ ID NO: 23582 - protein, 497 aa, Aspergillus nidulans FGSC A4
MTPSLQRQLFYDGKPQHASSGRTFQSINPADATLLAEIPVASQSDIDAAITAAERAFPSWAQTPPIARARILQKAAALLRERNDEIARVETLDSGKAYSETSTVDVVTGADVLEYYANLVGGGGLNGETTQLREEAWVYSKKAPLGVCVGIGAWNYPIQIALWKSAPCLAAGNTMVYKPSEFTSLHGQTLAEIYKEAGLPDGVFNVVYGAGDVGSYLTSHPTVAKVSFTGQVSTGMKVSGAAAGNMKYVTMELGGKSPLLILPDADLENAVDGAMMANFYSTGQVCTNGTRVFIPKSMKKDFESRLVEKMQYIRPGPLFDENTNFGPLSSAVHQEKVTAYIRHGIEQDKATLLYGGLGKPSLPKDLEAGFWVRPTIFTDCTDDMRIVKEEIFGPVMSILTYDSVEEAVKRANTTELGLAAGVFTKDLNLAHRIIDQLEAGITWVNTWGESPAEMAVGGWKKSGLGVENGRRGIEAWVRNKSTLVDMGNAVATVFAKL

SEQ ID NO: 23583 - protein, 333 aa, Aspergillus nidulans FGSC A4
MARVYADVNKHMPRSYWDYDSVNISWGVLENYEVVRKIGRGKYSEVFEGINIVNYQKCVIKVLKPVKKKKIKREIKILQNLAGGPNVVALLDVVRDNQSKTPSLVFEYVNNTDFRTLYPRFSDYDVRFYIYELLKALDFCHSKGIMHRDVKPHNVMIDHEKRKLRLIDWGLAEFYHKGTEYNVRVASRYFKGPELLVDFQEYDYSLDMWSLGAMFASMIFRKEPFFHGNSNSDQLVKIAKVLGTEELFEYLDKYEIELDPQYDEILSRFPRKPWQSFVNAENQRFISDEAIDFLDKLLRYDHAERLTAQEAMAHPYFAQIRAEEAANRSTASS

SEQ ID NO: 23584 - protein, 508 aa, Aspergillus nidulans FGSC A4
MEPMLPEAGEAALLSSYAPQASGSMGVDPDPITGLVSTSAAPLVRVEEAPKFELESYIANYTANSWLIPSQKGRTRFNRLYLIGTCSSYLAVDALKAAIAEAKSGKDVARYLRAVQALADVAPNEPEATIDSDWVERSQKVVKAETDRLEHELRGYKNNLIKESIRMGNEELGQHYHRIGDLTSAFKAYSRMRDFCTTPSHIASMLFKIINVAIERGDWLNVQSNVHRLRSQGGKPEEQAKHQPKISAAMGLSQLHSGSYLEAANSFIATDPSLGDTFNEVLTSNDVAVYGGLCALASMDRNELQRRVLDNSSFRNFLELEPHIRRAISFFCNSKFRPCLEILEAYRADYLLDIHLQRHVQVLYNRIRTKSIQQYLIPFNRVSLESMAKIFVLGNPTSQSSQSDSKSAFVQELISLIQDGTLDARIDLEKHVLVSTQGDKRIEVQEAVLDSLDNYVREAHLRLLRSNIIRAGLEVRPLGEDRRTKLEERGKKGHSAIGNLLRATGMKQ

SEQ ID NO: 23585 - protein, 313 aa, Aspergillus nidulans FGSC A4
MEQLNVGGPLSRWWSHTTTTYSPTTIEFFGSAAVLFIGFWVPSLIFTWMDTLGPKHIPWRKIQAPARQPQYAAVKKGLVNSLQNQLLTSVLHLAYLGMLHFFTSGAKTTIYNVDSALPSPTRMARDIVISIVLQDIIFYHSHRGLHHPKIYRHIHKKHHEFTTPIALAALYAHPVEYFLSNILPVALPPALLGAHVVTFWFMLTWALLLAIIAHCGYELPPIYGWNMEVHDMHHELFVGNFGTIGFCDVLYGTRLTDSKATRVARDRLKEDTTEDTITAKNISSSAFNPLQRNGLGLEQGDWQGFFSHHTRHH

SEQ ID NO: 23586 - protein, 501 aa, Aspergillus nidulans FGSC A4
MATAVSLTAPNGHKYEQPIGLFINNEFVASKSGEKFATVNPSDEEEITQVYAAGEEDIDIAVKAARKALKDPSWKLLTATDRGNLMLKLADLIDQNKETLAVIETWDNGKPYQVSLNDDLSEVVNTIRYCAGWADKIHGQTISTTPAKFAYTLRQPIGVVGQIIPWNFPLAMAAWKLGPALACGNTVVLKPAEQTPLSILYLAKFIKEAGFPPGVVNIVNGLGRVAGSALVTHPGVDKVAFTGSTMTGKEIMKMAAGTMKNVTLETGGKSPLLVFDDADLEQAAKWAHIGIMYNQGQVCTATSRILVHEKVHDEFIRLFREAVATTSKVGDPFSDDTFQGPQVTKAQYERVLSYIESGKQEGATLVDGGVPYKNVKDGKGFFIAPTIFTNVKDNMRIYREEVFGPFVAIARFSTEEEAIDRANDTTYGLGAAVFTKDIERAHRVASEIEAGMVWINSSNDSDFRVPFGGVKQSGIGRELGEAGLEAYTQIKAVHVNMGTKL

SEQ ID NO: 23587 - protein, 490 aa, Aspergillus nidulans FGSC A4
MRSPLFLSFAATVLAATPAEWRSQSIYFLLTDRFARTDNSTTAECDTSAKYCGGTWQGIINQLDYIQGMGFTAIWITPVTANLEDGQHGEAYHGYWQQDIYALNPHFGTQDDLRALSDALHDRGMYLMVDVVANHFGYDAPAASVDYSAFNPFNSADYFHTPCDITDYDNQTQVEDCWLYTDAVSLPDVDTTNEEVKEIWYDWVGDLVSDYSIDGLRIDTARHVQKDFWRDYNDAAGVYCVGEVFQGDPDYTCGYQEVMDGVLNYPIYYPLLRAFSSTSGSLSDLANMIETVKYTCSDATLLGNFIENHDNPRFASYTDDISLAKNVAAFVILSDGIPIIYAGQEQHYSGAGDPANREATWLSGYDSTSELYQFISKTNQIRNHAIWQNETYLSYKNYAIYNENNVLAMRKGFDGSQIITILTNAGADAGSSTVSVPNTGFTAGAAVTEIYTCEDITVSGSGEVSVPMESGLPRVLYPKAKLEGSGICGL

SEQ ID NO: 23588 - protein, 1680 aa, Aspergillus nidulans FGSC A4
MNSAGLSSGSMEGLTGSDWPVRTCCYPWLFLASSASSSALMFLIKHPLPPDVSSCLCLAIAYSSRALDSLYRAVRTPEITRQIVSNLLIATAHSRSHPRFLILTLHRAARFYFFAPKLWEFFLRDDVESFQRFLASASYTSGGQRAPAGGGTHLNAGSPGPMISSLGASPKGKKSTGTSPVTSVFERGGGPRSTKPISRDELNARDQHGRTLLHHVASSPKPTAADFALALLEVPYLDIYAQDLESGWTALHRALYAGNATIAQALMARDVRDATDPSKPGFSGHPSGGLIKIKDREGYSPFDVYASTITSRSLGPLVPDHGLDDASSVSSSDDEDVAEALEKPSTNLFGDEVFTFGSNKNLNLGVGDQDDRQYPERITLTRPTHLLHRFFREHQERHDDVKTASSPDPSDQDLPAFIKARPLKIQTLAMSKLHTAILTDDPESNLFICGFGPGGRLGTGDESTRFSFVCIEGGGLANKKVASVALGQDHTLAITEHGDIFSWGSNKFGQLGYGLPRANNKDDVPVQLSPRQIFNPFKKEVILGAAASAVHSVVYSTSGLYTFGKNEGQLGLVDSDARSLEVQTTPRRVGASLFSTPIQSVSATDQATAILLQNHEVWVFAHYGYSRLSFPLEINSRFIRDSFMATRYDTSINRIVKIRSGGNTICALSSSGDVFTVQVNKLENLPSLTSTTNPAKIRNSLSPPVRVWSVKKAHMAVKDVDVGQDGSIIICTASGSAWRKERRRKSKNGSSGEYKFARVPCLSRVVGVCSNAFGAFAVVQRECDVTKEQINVNPTSLWGDIWPLSPFSAIRATTKQKDYFADEEVRDLESVTALRQVLMNGPNPELYFRPTFAGLPAGTVWVMTTASDMRVPVHEFILTGRSSVLRRALHDYRHQHSASVPEILTIEKDYNGDCQILLQGMDVLSVLNLTFYLYTDALLDVWQHARSSPENASRYRQVRTEVMRIASHLDLPALERAAALMVRPAKSMKTDFSTAFNDPSFFESCDVVIELNGDCMVAHSQVIRQRCPFFYALFVGRSGGIWVQSRRKSPQDKVHVDLKHIDRSIFEFVLRYMYADTDDRLFDDVRTKNTQDFVDIITDVAFVADELMIDRLSQICQRALGKFDNVCHDNQMAAFPISRGRNAMEYIYEKYPELVSFIEADKRRLIDSIRLKSRVSKIDSPEGKPRAPSEKLAPSPAASRFKTGVDKDRPVYDSPLLKSKHSTGDLMFQMDDEPLSSLDLGKGKAIDRGVKPANENDTRPWNETPVLGASLQDGASSVGRSYLDTRMASPQGTSPARLQPTTPQEKQNGSASPPYPSQVPWNSTTISGSKKTLKDIMSEASEARVSNLSLGMSSVRRENSGSFAPKLSQKERKKMQQQQIQEMAIAQQRAKEAAQSPWKIPSPGPAVPVGPSTDKITNGQDIPSPTPSKSAQRPGMTLRQTVAGAPSPKRESAAKPTPSSSRSHVVSATTTRPPLAPRPADAVAPSTPPTDQVTIKSVRHIPRPEPYQTSFYADTPGSMSLATILMQQQTEKDEIREAATARHNLQDIQAEQAFQEWWDKESRRIQGIPEPGAEDEDTQKKAERDGRGGRRGRGSKGPGGQSQRTRRGKGPQAQTQGQSQGASSPAQQSQASRNGSEAGAPDRGQHQQLSTPTPKKPHTQTHSAHSGNPSRRGRGGYRAK

SEQ ID NO: 23589 - protein, 472 aa, Aspergillus nidulans FGSC A4
MAKSVQEKAAATVAADSEVGQVVDYQAHDHGADSGLSRTLETRHLLMFSIGSSIGMGLWLGSGTSLASGGPAAIFLGYWIAGSIAWLLNQAVGELAVLYPVPSAFPQWSRKFIDHAVALTVGWAYWFSGSITLANELQAIVTVLRFWDDTVPTAAWLSIFLVTIFVINVCAVRVFGEAEAIMSTVKLLWIIVVIICGIIISAGGAPNHKTTGFEYWNSMPFTHGFKGFLSVMGTCIFAMSGSEMGGLVAAEARSPLKAVPRAVNAIWLRLSLFYILGALIVSITVSPTNGNLFGGDGVNASPFVIAFRDAGLPGLAHAMNAVIFISVLSCGNAQAYGATRTLVGLAEIGMAPSFLQKCDKQGRPYYAVALTFLVGGGLCYLNVSNSGATVFAVWPLGEPSSAKTFFANYVSIVAIVVLYIAAKIYYRGPLWVRAKDIDLDAGRRFYVDDIDALKRRTFMNKVVDFFTGDGSV

SEQ ID NO: 23590 - protein, 454 aa, Aspergillus nidulans FGSC A4
MTSNGTNGSATAYHASSTQEAIQAENDFAAHNYHPLPVVFARAQGTSVWDPEGRHYLDFLSAYSAVNQGHCHPKLVAALVDQASRLTLSSRAFYNDVFPKFAEMVTKYFGFDMVLPMNTGAEAVETGIKIARKWGYKVKGIPENEAIILSAENNFHGRTMAAISLSSDPESRENYGPYVPNIGCTIPGTEKPITYNDKAALREAFEKAGSNLAAFLVEPIQGEAGIIVPDDDYLQLARSLCDQHNVLLICDEIQTGIARTGKLLCHEWSGIKPDMVLLGKAISGGMYPVSCVLGRKDVMLTVEPGTHGSTYGGNPLACAVAIRALEVVQEENMVERAEKLGQAFRSGLEAIQNPIIQTVRGKGLLNAIVIDESKTNGHTAWDLCMLMKEKGLLAKPTHQNIIRLAPPLVITEEEIAKALEIIKAAVAELPNLKGAAEDKVVPPPEKKVKITLEN

SEQ ID NO: 23591 - protein, 490 aa, Aspergillus nidulans FGSC A4
MGRKLSLFRAIYLASASCMGSFAFAFDTGVISGVLTLESFQRDFRYTESQKTTVNSNAVSILQAGAFFGCFLTTPVASRFGRRSGLIISSLVFTVGTILQIINAHTLATFYTGRVIAGVGIGAATVLIPMYSAEMAPKEIRGRLGACFQLFFALGVMIAYWVTFAVSETQPPKPKQWQIALGLQLLPSTLLLIGMVTVKESARWLAVKGRNEEAWESLKWVRGGEDTPELQQEFDEILAGIAEEARVKENFTWRELLLPANRYRIFIAITIQLCAQLSGNTSLAYYATQIFSAVGAGSSAKLVTGFFGVVKVVGVSIFQLFVIDKIGRRVPFMAGAFAMGSFMLIIACVLATHPTSSDGADSGATPAGIAMIIMVYAEAFSFNMSWGALPWLYVGEIFSSRLREVGVTVGAASQWLFNFMMSQVTPHAISNIGWRMFLMFAIFNYAIVVYSWVFLKETLKVSLEEMQGIFGAGTEPDGKPTVEAHESLTK

SEQ ID NO: 23592 - protein, 421 aa, Aspergillus nidulans FGSC A4
MTSKQIPDIEVKPAPGISYFTPAQEPPAGLAADPQSDGAPIPKLFQPLKVRGITLHNRIGLSPLCQYSADDGHMTAWHMAHLGGIAQRGPGFLMVEATAVEPEGRITPQDLGLWKDSQIEPLKGVIEFAHSQNQIIGVQIAHAGRKASTVPPWLSSGDTATEKVGGWPDRVKGPSNVPFTSRFPVRKQMTRDDIENLKTAWVAAVKRAVRAGADFIEIHNAHGYLLMSFLSPAVNTRTDEYGGSFENRIRLSMEIAKLTREAVPDHLPVFLRVSATDWLEESRPDLPSWRLEDTVKFAKALAESGYIDVLDVSSGGTHADQHIHAKPGFQAPFAAAVKKAVGDKLLVGTVGMIDSAHLANSLLEKEGLDLTLVGRGFQKNPGLVWAFAEELGVEIGMANQIRWGFASRGGGPYLRKRSGKI

SEQ ID NO: 23593 - protein, 511 aa, Aspergillus nidulans FGSC A4
MLSPTLFSAYVLVGAIVAVLVNVIRQIFFRNKNEPPMVFHWVPFVGSTISYGMNPYKFFFSCREKYGDIYTFVMLGKKMTVYMGVKGNDFILNGKLKDLNAEEVYSPLTTPVFGSDVVYDCPNSKLMEQKKFIKFGLSQSALESHVPLIEKEVLDYIKTSPRFKGDSGVLDAPAAMAELTIYTAGSALQGKEVRKKLTAEFADLFHDLEMGFTPINFILPWAPLPQNRKRDIAHARMRETYMEIINQRRKNPDAQDHDMIWNLMHSTYKNGNPVPDKEIAHIMITLLMAGQHSSSSISAWILLRLASEPQILEELYQEQLANLKRDPRTGAFEPLQYKDLDLLPLHQNVIKETLRVHLSIHSILRKVKNPIPVPDTPYIIPTSHTLLASPGATALSDEYFPNANMWDPHRWENQRPDKEDEEGELIDYGYGAVSKRMSSPYLPFGGGRHRCIGEKFAYVNLGVIVATIVRNLKLYNVDGKTGVPATDYSSMFMGPMKPAVVGWERRFPARS

SEQ ID NO: 23594 - protein, 484 aa, Aspergillus nidulans FGSC A4
MGSDPQYIKFPDLSLAQHVFNLSNPACPQTLRQSSQKKLQEAITEKKMAPFYRHLAHPVEGILNHSSEGASQPPSSSAVKPLSTLASRRLSQKIDFPWDEALYQSLVEDNRKELAEFQKEEDEAEEAAGDTEVQAARGKRAEFWARVGDKDKAIESHETLLEKTTFLGSKIDLVLAMIRIGLFFGDTLYVKKNIERAEGLIESGGDWDRRNRLKAYKGLHLLTVRSYSAAAPLLLDSLSTFTSYELCSYSALVIYAVLAGSLSLKRVDFKAKVVDAPEIKAILGSGEDRLAALTGEISSGPGAQDEEMKDASSSGATTAVNLTAFGGNTGIQAEAENPIDFTPLSNLVSSLYNGNYRTFFLALAAVEDHFLTQDRYLYEHRAWFVREMRLRAYQQLLQSYRVVGLNSMANDFGVTVDYLDRDLARFISNNRIACTIDRVNGIIETNRPDDKNKQYADVVKHGDALITKLQKYGQAVRLRGSERS

SEQ ID NO: 23595 - protein, 179 aa, Aspergillus nidulans FGSC A4
MIIYKDIISGDEVLSDTYNIKTVDGVLYECDCRKYLKKTNEDFELEGANPSAEGGDDEGGAEGGEVMVHDIEDQFRLVWLKAEDGAKPPKDAFKGHLKTYMKKVLKALQDKGAPDETINEFKKGAPAAVNKILKNYDNYDVLMGESMDGDAMHILIDFREDGVTPYATLWKHGLEEMKV

SEQ ID NO: 23596 - protein, 1029 aa, Aspergillus nidulans FGSC A4
MTGSECQPRHSASSGTGRDIHTLSWDGDHDPANPFNWSISRKWAVTYLAALISFLTMMNGTIITVAHFEIAELFNIDETAFPHTYWPVTTWAVGGAFSALFLLPLAEDFGTRPVFLVTYFAFVCFLIPQAVAQNFATLVATRFFAGACVAILANTAAGVIGNVWDTEWSRSIPVSLYIFGYMAGSSMGPVIGAAVLQSLSWRWIGYMQLIWFGALFPIYYFFFYESRGDIILAQRDRKMGKNGKDILPGHPAHSKLNLQNLAVSSTRPVILFCTEPVLFVSTLWSAFTVGTIFLFTQSVEQVFIGTYDWTISKTGYVQAAVVIGEGIGFFFSFLSRELYFASASRNTEVPNSLIPEARLYMAVLGGLFGISGGMFTYAWTSYPFIPWIAPAISLAMVGAGSVLVVTGVSDYVVDAYSQYAGSAIGAVATGENIFSAFLPLATMSMYNNLGFQWASTLLAFVSLVLALVPTLMFVWGRELDNYALPTIATYAYSPANHYCTTQQAFQCHCSNFPSLHSCPTTTRHRPTNHLLKMPSLANTLKDPTLFIESSYIDGKWVTSSSSRTFNVYDPATEEFIGTCPESNIDDINSAIRAAATAFPKWRALSGRQRGRILRRWFDLIVENKEDIGKIITAENGKAKGDAEGEALFSAGFFEWFSEEAARIYGDVVPHSNPSSRVQVLKEPVGVCGLITPWNFPMAMGARKVAAALAAGCTVVLKSDGLTPYSSNVLALLAERAGVPGGVFNVVTALENTPALGLALCESDNVKKISFTGSTRVGKLLMKQSSHTLKKLSLELGGNAPFIVFDDADLETAVTSAVACKFKVTGQTCVCANRFYVQEGIYEAFSKRFVEEVKKCQVGHGLDPGVTHGPLTNGIAKTQEHIQDALNKGATVLLGGSRLPSLGKNFHELTILGDVDDSMKVASEETFGPLAALSKFKAEDEVVRRANGVEVGLASYLITSDLGKAHRVSEKLEFGMVAINTGVISDSAAPFGGVKHSGMGREGSKYGIDDYLNIKTIVTGGIHTAYSAHL

SEQ ID NO: 23597 - protein, 1205 aa, Aspergillus nidulans FGSC A4
MKFGRNLPRNVVPEWSSSYIRYKALKKLIKSLADRVRAGHEADLAGFFYSLDRNLEDVDHFYNKKYADFSRRLKLLSDRYAHNLDGSHLDSDDVEDLLAALLELRGQFRKLQWYGEVNRRGFNKITKKLDKKVGAQAQQKYLETKVEPLPFASNTRVTEALKKINDWLSALGDQKTFDDASSTHSSLSLKRGPSRPNLNLPANTLLTIDDALRKDDTHVVLELLEDLKTVADEAGENVFPKVLRSLLQRAIHYRSKACISAVIGRSGSLEEEDDINKRNCIHRLVIAIGRAQTTTDSEQSASMVLDFPMDTPNYITPAALPTLQPPRSFAKESDHVQHLTRSDPAVSVLEYLLDHLRPDQRESLLSKDISGRTPLHYAAQYGFRVVCEVIIEHLQAWNMFDVSEGIDGPRWQDNDGWAPLHLSVVGGHPLTTQALLKAENWKGQIQDKAEIRKHVSRSSAVLALAVKANFIDIVQLLVDAKVDINYQDQQGETALHVAARFDHEKCARILLKGNDVQKADTELAESTYSWTPLFIACVDGSLSVVEALIEAGADLERLDSSGWTAKEHAALRGHLDVARCLAKVTPEPELSEEPALTVPTASGSTTSGPLSSQPQSSLMEKKSNGGSAAGSSPSRNPEPVKSFGHRYLTDEAMILVSLGTMDTRKHVHAVNLDRIPMENAHATQLDTALSIVVSANGAHGEPEIIDLPVQENISTEPIVFHAADPTKVRLLFDLVPTYSGSKDQIVGRGVALLSSVRPSVGSHRTNLQGDSTVPIVAANTLEVIGSITFNFLVITPFKHPNMSINREQTYWRSMSSTMVIGHRGLGKNFATRNSLQLGENTIQSFIAAANLGASYVEFDIQLTKDHVPVIYHDFLVSETGIDAPVHTLTLEQFLQLGERGTTRTPGSPGQIAIGGTERSKTPPLPPRHRSMSVGGTESDISELNERIKHTRDFKKKGFKGNSRGNHIQAPFATLEELFKKLPQNVGFNMELKYPMLYESEEEEMDTYAVELNSFVDTVLEKVYTLGQGRNMIFSSFNPDICLLLSFKQPSIPVLFLTDSGSSPIGDIRASSLQEAIRFASRWNLLGVVTQAECLVLCPRLIRVVKESGLVCVSYGTSNNDPHKVKLQAAEGIDAVIVDSVLAIRKGLTEHEGKNSFTPGPTPHASPLSQPTINAALKDAHRIPVLNNNTEVKDNYLQVKSDAASL

SEQ ID NO: 23598 - protein, 392 aa, Aspergillus nidulans FGSC A4
MTTMSLLKDTVLSSRSTRQIYRLSKAVNIAHSERCLSTSPATGAAAAEVEAAQKYCLNLLAKYDRPSYTLSTFIPSQARPAYIALRALNSTLSLIPDTTSSHTIGLMRLQFWREAIAKTLTGSPPKEPIAILLASAIEDLHHRSGGRAKLSKNWLNRMINAREQTLTNDPYPNLEALESYAENTYSTLLYLTLSVLPMTSVTADHVASHIGKAAGIAAVLRGLPIVAFPAQTQSATSAGDSMAALQGGAKQGAVMLPLDVMAQAGVKEEEVFRRGAEAEGLRDAVFTVATRASDHLITAQQMLSNLRAGQNVGHDYEHEGEEDHQYSVEEGRHESQLDEVNRAFGVFMPAVGTRLWLDKLESLDFDIFRPELLRSDWKLPWKAYLAFQRRSL

SEQ ID NO: 23599 - protein, 479 aa, Aspergillus nidulans FGSC A4
MSSQIDTTHYPGNIINNQFVPSARTRHSTNPSTGEPLYEVPWATEEDVDRAVEHARTAFKSWSRLPFQERSRLLVAYADAVEAERAPLAKLLVLEQGKPLSLAQTELDMSVQWLRTFVTMEVKDELLDDNEERSITQTFPPLGVCCGIVPWNWPVLLALGKVGPALITGNTMIIKPSPYTPYCDLKLGEIGMRIFPPGVLQVLSGGDELGPILTQHPGIDKITFTGSSATGKLVMQSCAKTLKRVTLELGGNDPAIICEDVDIDAIVPKITSLAFLNSGQICMLIKRVYIHESIYDAFRDAMVAFAKSIKTADGFEPDAFVGPIQNSMQYEKVKDMYSEIGKRNWKQALEGKVFENSKGYYISPAIIDNPPEDSRIVLEEPFGPIVPLLKWSDEEDVIARANSLKDGLGASVWSKDLDRAERIGRQLSAGSVWLNSHFDVAPNVPFGGHKWSGLGSEWGMTGLKQYCNSTSLWKWKKVM

SEQ ID NO: 23600 - protein, 343 aa, Aspergillus nidulans FGSC A4
MDIKFVLVTGATGFIGAHIVDALLGHGLRVRGATRSLAKGEEMLKARLHYKEQLEFVKINDFENPGGLAEAVKGVDGIIHTASPFTYDTKDNEKELVIPAINGVKAVFEAAAAADASTTKIKRIVLTSSFASVIDVNRRAGPGSGPDGYFTYTAADWNPLSYAEAIDTSTNAVVAYRGSKKFAELAAWEFIRDRKPSFDLVTLCPPMTFGPVVHPVPSVESLNESNAMLWKVAVGEPLPVARVPFWIDVRDLADAHIGALLKPGVGGRRYTVAAPERFSYGLAAGIIKEEFADLRERVTGTRQDVDESHGLDGETAGRELGISYRRFRETVRDLVRQGVERGW

SEQ ID NO: 23601 - protein, 1499 aa, Aspergillus nidulans FGSC A4
MSSFLGTGTFNTSVSPSQAVESRGIENHGNAITETETLHNESHAESPGEKLASSSNSILSSTETAREKDERDYELDAEEEVTRLAQQLTHQSTKYSTHNIENPFLEVGEDSTLNPHSPNFKAKNWMKNLLALSSRDPERYLPRQAGVSFTNLSVHGYGSPTDYQKDVFNSVLQIGGLVRSMMGHGKQKIEILRNFDGLVKAGEMLVVLGRPGSGCSTFLKTIAGEMNGIFMDEKSQLNYQGIPAKQMRKQFRGEAIYTAETDVHFPQLSVGDTLKFAALARCPRNRLPGVSREQYAVHMRDVVMAMLGLSHTINTRVGNDFVRGVSGGERKRVSIAEATLSASPLQCWDNSTRGLDSANALEFCRTLNLMAKYSGATMAVAIYQASQSAYDVFDKVTVLYEGRQIYFGRTDDAKQFFIDMGFECPERQTTADFLTSLTSPAERIVRKGYEGRVPQTPDEFAAAWKNSDAYAQLMREIEEYNQEFPLGGESVNKFIESRRAMQSKNQRVKSPYTMSVMEQVNLCMIRGFQRLKGDASLTLSQLIGNFIMALVIGSVFYDLDNDTGSFYSRGALLFFAVLLNAFGSALEILTLYAQRPIVEKQARYAMYHPFAEAIASMLCDMPYKITNTFTFNIPLYFMTNLRREPGAFFIFLLFSFVTTLTMSMLFRTMAATSRTLSQALVPAAILILGLVIYTGFTIPTRNMLGWSRWMNYIDPIAYGFESLMVNEFHGRLFPCSESELVPSYGDTANRVCAVVGATPGELMVNGTTYLRESYQYTKSHEWRNLGIMFAFMAFFLFTYLTATEYISEAKSKGEVLLFRRGQAPPSVNDVETHSPATAGEKVDQSTQDVANIQRQTAIFHWKDVCYDIKIKNEPRRILDHVDGWVKPGTCTALMGVSGAGKTTLLDVLATRVTMGVVTGEMLVDGRPRDQSFQRKTGYVQQQDLHLHTTTVREALRFSALLRQPAKTPRQEKLDYVEEVIKLLGMEAYADAVVGVPGEGLNVEQRKRLTIGVELAAKPQLLLFLDEPTSGLDSQTSWSILDLIDTLTQHGQAILCTIHQPSAMLFQRFDRLLFLAKGGKTVYFGEIGEKSSTLASYFERNGAPKLPADANPAEWMLEVIGAAPGSHSDIDWPAVWRESPERQAVHQHLAELKETLSQKPTETSASDPSEYNEFAAPFSVQLWECLVRVFSQYWRSPVYIYSKAALSILTSLYIGFSFFQAQNTRQGLQNQMFSIFMLMTIFGNLVQQIMPNFVTQRALYEVRERPSKAYSWKAFMTANILVELPWNTLMAVIMYFCWYYPVGLYRNAEPTDSVHERGALMFLLILAFLLFTSTFAHMIIAGIETAETGGNIAQLLFSLCLIFCGVLAGPDVLPGFWIFMYRVSPFTYLVSAMLSTGVSGTTAYCEQVEYLTLYPPSNTTCSEYMDPYISQVGGYLQNPDATSECTFCQISSTDTFLSAVYSNYDDAWRNFGLMWAYIAFNIAAAVFIYWLARVPKGKKN

SEQ ID NO: 23602 - protein, 327 aa, Aspergillus nidulans FGSC A4
MPSALLIGDITHARKEWEDLSSILTLKEFPSGNREDFIRNLKDGKYDDLVAIYRSNTSTKFTGPFDAELISLLPKSLKYICHNGAGYDNIDIPACSEKGISVSSTPVAVNNATADVGIFLMIGALRQAYVPLTAIREGKWHGQTTLGHDPKGKVLGILGMGGIGREMANRARAFGMTIQYHNRSRLSPELEQGAKYVSFDDLLATSDVLSLNLALNPSTRHIIGEKEFQKMKDGVVIVNTARGALIDEKALVAALESKKVMSAGLDVYENEPIVELGLLNNPRVMLLPHIGTMTYETQKEMEILVLDNLRSAVEKGELITQVPEQKK

SEQ ID NO: 23603 - protein, 236 aa, Aspergillus nidulans FGSC A4
MHEHELSYMGPRAFNHSQSNDAESEYDRLRDLARQEASKRNSCFQRSQEAYASGDGAAAKELSEQGKAHGRKMEEYNRQASEFIFRENNAPGRVDADTIDLHGQFVEEAEDILEERIKYARSQGQTHLHVIVGKGNHSANHVQKIKPRVEKVCRELGLQYATEENEGRIYVNLTGGAADSLPSKPSHGHGHQQQHYQQPHQHQQQQQGNQDEIEQVVNAILPRVLRKLEKACCVVM

SEQ ID NO: 23604 - protein, 1141 aa, Aspergillus nidulans FGSC A4
MTYAATSSTSAVHGDPQASLKLAASRPRPKLHHIFTSSAIPAALAPTYASSYTTTPTSLPPSCTPSNDSSPLGTPFLSAVDSLRDRVTPLPPTSAPSLELGDSIMAVPATISASYPGDTVIPNSIKGTGLMRRISRGAANKLTRRRTSNSHNDKRDRSSGPVIMRRRSDSKTGTQTGRDSALDSSYEEDSNDALDALGGWAGSEASSVPNDNTPTVPRNPAVVAPTVDSAIQRGTILTKVTKKRRKQVRFLLNLDAGKVYWDPSNPAKRFYIDDVKEIRVGADARNYREEHQVSQDAENRWFTIVIADAERSKGRPVKTIHLIAPNERLLKLWTTTLEYISRYRVGLMAGLAASNQNESVLKAHWQREMTRLFPNGMKAGDTETLDFAAVESVCQSLHINCSQNMLRAHFLKADTGKHGKLNFDEFKDFVTRLRERRDVREIFRSHADDHREGLTLEEFLIFLRDVQKEDIDSDRAYWISVFDKLVRKSKSRTQSPTGTSSEDQSSRMSLDAFSSFLASARNGVYASRSPQSRFDRPLNEYFISSSHNTYLLGRQVAGSSSTEAYISALTQGCRCIEIDCWDGADGRPIVSHGRTMTTSVLFADCITVINRYAFFSSEFPLVISLEVHCNPEQQIAMVKIMKETFGEKLILEPLSNSFVLPSPEELKRRILIKVKTCDETENIRQDPITSFHGRKRSSSSPFIRPSMSDGPTLPNLPSLSSPPTIGADCPGPFLVPERRSLTTTSISSATEDSDGGLVSVRKERRRRQKSKITKPLSDLGVYTRGYKWHSFASAESQAFNHVYSFAERSFESICREPSNKALFEKHNSKYLTRVYPSGFRLRSSNFDPLKFWRRGVQMAALNWQTYDIGMQMNQAMFAAGSDRTGYVLKPESLRVVSSEKDTRITERKLVRFSVDVISAQQLPRPQNMSSDGNINPYVEIEMFSADDRGQSFAFGEGGMNASARNGMSGIGFPHRRRTKIEQRNGYSPNFNESFRLSLETKYPDLVFVRWTVWSSLDGRSTGTNGSVQLATFTAKLTSLSQGYRYLPLYDGSGDQYIFSTLFCKISKEEPISVRRLNADELRAERLGILRQIGQTVFKRTSSTEREKQDQSDKGTETPICLEGKEISPALTPTISTTSTAS

SEQ ID NO: 23605 - protein, 292 aa, Aspergillus nidulans FGSC A4
MSEITHPTIKDGWFSEQSEMWPGQAMNLRVNQILHHEKSKYQDVLVFESSDYGTVLVLDNVIQCTERDEFSYQEMITHLAMNSHPNPKKVLVIGGGDGGVLREVVKHETVEEAILCDIDEAVIRVSKKYLPGMSIGFQHPNVKVHVGDGFEFLKQRQNEFDVIITDSSDPEGPAESLFQKPYFELLRDALRDGGVITTQAENQWLHLPLIADLKKACNEVFPVAEYAYTTIPTYPSGQIGFMVCCKDANRNVKEPVRTWSREEEERLCRYYNQDIHRASFVLPNFARKALGN

SEQ ID NO: 23606 - protein, 438 aa, Aspergillus nidulans FGSC A4
MVPPMTSAVLHRDTRFVPKKAVGGKGSYLLLEDGTKFLDSTGGAAVSCLGHGHEKIIQAITEQFTKVEYCHTAFFGTEASENLASLLVDSTGGKLSKLFVVSSGSEAVEAALKLARQYFLELPTPQPQRTRFIARKPSYHGTTLGALGVGGHALRRQPFEPILSQNVSHVSPCYAYRGKNDGESDADYVARLAGELDAEFRRVGPDTVCAFIAEPIVGAALGCVPAVPGYFAAMKTICEKHGALFILDEIMCGMGRCGTLHAWEQEDVTPDLQTIGKALGGGYAPVSGLLISDKVVQTVDKGTGAFRHGQTYQGHPISCAAALAVQTVIVEEQLLDNVKSMGEYLEKRLRGTLEGMQYVGDIRGKGLFWGVEFVKNKATKEPFSSETALAFKIQETGTVNGTRGDHIILAPAYNVTKEEIDIIVDTTAKVLAEVFAQL

SEQ ID NO: 23607 - protein, 1104 aa, Aspergillus nidulans FGSC A4
MPLLDGPRNGETVTASAHNGIPIIDGVDPSTLRGDIDQDPNRRQKIVVVGLGMVAVAFIEKLVKLDSERRKYDIVVIGEEPHIAYNRVGLSSYFEHRKIEDLYLNPKEWYGSFKDRSFDYYLNTRVTDVFPQHKTVKTSTGDIVSYDILVLATGSDAVLPTSTPGHDAKGIFVYRTISDLERLMEFAANHKGQTGVTVGGGLLGLEAAKAMTDLEDFGSVKLIDRNKWVLARQLDGDAGSLVTKKIRDLGLEVLHEKRVAKIHTDDDNNVTGILFEDGQELDCCCICFAIGIRPRDELGGSTGIQCAKRGGFVIDESLRTSVNDIYAIGECASWENQTFGIIAPGIEMADVLSFNLTNPDKEPKRFNRPDLSTKLKLLGVDVASFGDFFADRDGPKFLPGQRPSAESIGAADPNREEEPQVKALTYRDPFGGVYKKYLFTMDGKYLLGGMMIGDTKDYVKLNQMVKSQKPLEVPPSEFILGAQSGGEENADDLDDSTQICSCHNVTKGDVVESVKSGTCKTIADVKSCTKAGTGCGGCMPLVQSIFNKTMLDMGQEVSNNLCVHIPYSRADLYNVIAIRQLRTFDDVMKSAGKCPDSLGCEICKPAIASILSSLFNPHLMDKEYHELQETNDRFLANIQRNGTFSVVPRVPGGEITADKLIAIGQVAKKYNLYCKITGGQRIDMFGARKQDLLDIWTELVDAGMESGHAYAKSLRTVKSCVGTTWCRFGVGDSVGMAIRLEQRYKSIRAPHKFKGAVSGCVRECAEAQNKDFGLIATEKGFNIFVGGNGGAKPRHSELLAKDVPPEEVIPILDRYVIFYIRTADKLQRTARWLESLPGGIEYLKDVVLNDKLGIAAEMERQMQELVDSYFCEWTETVRNPKRRKYFQQFANTDETVENVEIVKEREQVRPTYWPKDGANEDFKGHQWSSLSWQPVIKADYFSDGPPAISSANIKRGDTQLAIFKVKGKYYATQQMCPHKRTFVLSDGLIGDDDNGKYWVSCPYHKRNFELNGEQAGRCQNDEAMNIATFPVEEREDGWIYMKLPPVEELDSVLGTEKWKVKKGEAVDPFEAYDKKYSGMKGKRAGAKGIEGSKPTRSPSNTIDW

SEQ ID NO: 23608 - protein, 507 aa, Aspergillus nidulans FGSC A4
MDFAKLLVASPEVNPNNRKALTIPVLNPFNTYGRVFFFSWFGFMLAFLSWYAFPPLLTVTIRDDLDMSQTQIANSNIIALLATLLVRLICGPLCDRFGPRLVFIGLLLVGSIPTAMAGLVTSPQGLIALRFFIGILGGTFVPCQVWCTGFFDKSIVGTANSLAAGLGNAGGGITYFVMPAIFDSLIRDQGLPAHKAWRVAYIVPFILIVAAALGMLFTCDDTPTGKWSERHIWMKEDTQTASKGNIVDLSSGAQSSRPSGPPSIIAYAIPDVEKKGTETPLEPQSQAIGQFDAFRANAVASPSRKEAFNVIFSLATMAVAVPYACSFGSELAINSILGDYYDKNFPYMGQTQTGKWAAMFGFLNIVCRPAGGFLADFLYRKTNTPWAKKLLLSFLGVVMGAFMIAMGFSDPKSEATMFGLTAGLAFFLESCNGAIFSLVPHVHPYANGIVSGMVGGFGNLGGIIFAIIFRYSHHDYARGIWILGVISMAVFISVSWVRPVPKSQMRE

SEQ ID NO: 23609 - protein, 204 aa, Aspergillus nidulans FGSC A4
MARSSTLWAISLPPQLPPGIIYEDLHLVPTFAKAHGVAMGIAFGIIFPLGAILLRVLQLKYGVYAHIGCQLLAYVLMIAGLATGIRVGKILDRLHNNSHTILGTVIVVFLLIQPFIGFWHHHQYKKTQKAGRWTHVHIWIGRIFLLLGIINGGTGLKLADNTTGGIIAYAVVGGVFGVVYFSIAALHQGKVILGKETTPEMTQT

SEQ ID NO: 23610 - protein, 337 aa, Aspergillus nidulans FGSC A4
MTTSRWWLYVQAVFWRCLMRLGMIFHNIPHPRPPSPSFSRSFPSGSSKVVLQFYCPPGYSQTRKEGRRLPVVVNFHGGGFTLGGPSDDSRWAQAVLSEVGAVVVSVGYRRAPEHPFPAAVDDGVLALQYLASHAVELGLDISRIALSGFSAGGNLAVTVPLRFRDMLIQAEHEGWLSRADSTVQLVSPTASDLHIVALFCWYPILDFEEPREHRRAMSIEPNKTLPSFFTNLFDESYLPDLEQRKSPYASPVHATDDALRDSLPHDIFFFICEWDMLLNEGQLFCRRLQDINKHVRAMMVEKARHAWDKSPNPFRNTTEVNILYKDACADMKAIFEK

SEQ ID NO: 23611 - protein, 435 aa, Aspergillus nidulans FGSC A4
MSDLATAPSPSYPGAPGLTYFTPATNPGAAINPAAKETPTLFRPLTIRSVTLKNRVIVAPMCMYSAESDPSSPSVGALTDFHMAHLGHFALKGAGLVFTEALAVQPNGRISPNDAGIWQEGTESEQFKGLKRVADFVHSQGAKFGVQLAHSGRKGSTVAPPLAASRGVRALKADEGVFGWPKDVVGPSGGEENKWEPGNISYWAPRELTVAEIQEIVKAFAKSAEIAVKAGVDVIEIHAAHGYLVNEFLSPVTNRRTDQYGGSFENRTRILREIALAIREVIPEGTPLFLRISATEWIEDQPAAKDFGSWDLKASIELLKDLPEFGVDFLDVSSGGNHKDQKFHFFTDYQTEMAAKLRKELRASGARTLVGAVGFITQPDAAAQIVQGADEEGVEAKADAVLIGRQFLREPEWVLNAAKKLGVQVNPPIQFGRAM

SEQ ID NO: 23612 - protein, 237 aa, Aspergillus nidulans FGSC A4
MANDEYDVSPRPLTFLFKVVLIGDSGTGKSNLLSRFTRNEFNLDSKSTIGVEFATRSIQVDSKTIKAQIWDTAGQERYRAITSAYYRGAVGALLVYDISKHQTYDNVNRWLKELRDHADSNIVIMLVGNKSDLRHLRAVPTEEAKQFASENNLSFIETSALDASNVELAFQNILTGIAPVGISKRRSLTAILFFVEIYRIVSSKALEGESGGASVGERRQIIDIEKTQDTENKGGCC

SEQ ID NO: 23613 - protein, 264 aa, Aspergillus nidulans FGSC A4
MMEDFNSETDSDYTSYWRDWFISSRGNEYFCEIDEEYLTDRFNLTGLNTEVPYYQYALDLVTDVFDLDADDDLREQIEKSARHLYGLVHARYIVTTRGLAKMVEKYKKGDFGKCPRVMCEGHPLLPTGQNDVPNMSTVRLYCSKCEDIYNPKSSRHASIDGAYFGTSFTSMLFQVYPALLPEKSIRRYEPRIYGFRVHASAALARWQDRYREETRNRLRDAGVEVRYLEDDEEEELEDDDEDELVETKERVPGDAASGRMDIGN

SEQ ID NO: 23614 - protein, 504 aa, Aspergillus nidulans FGSC A4
MRLSPAWYQFLVGVFASLGSFLYGYDLGVIAEVIACESFKTTFKEPDSTQTGLVVSMFTVGAFCGAAFAGPTGDYLGRRWTIIIGCIVFCLGGGLQTGAQTIEYLYSGRFFAGVGVGFLTMIVPLYQAEICHPNIRGRVTALQQFMLGVGALCAAWISYGTYVGFDDTNDAQWQVSLGLQIVPAVFLGLLIMLFPESPRWLIDHGRQEEGLKTLARLHAYGDVNDAWVRAEYTQIQEFILREHEEEAKSYLELFQSRSSFRRLFLCCALQASVQMTGVSAIQYYSVTIYAQIGISGDETLRYQAINSIIALIAQFLCMMLIDRFGRRWSLISGNLGNCLTFIIACILLARFPPEVNNTGAHWGFIIMTWLYNFSFSCTCGPLSWIIPAEVFDTRTRSKGVSLATMTSYAFNTMIGQVTPLAMEDVGYRYYYLFIICNFTNAVFFWLLLPETKKLPLEEMNYLFSNAPWIIPGTKKEDYVPHDLERRVVEQEEKQHAYASHEEKK

SEQ ID NO: 23615 - protein, 472 aa, Aspergillus nidulans FGSC A4
MPPVETKQYDYIVLGGGSGGSGSGRRAAGWYGAKTLIVESGRAGGTCVNVGCVPKKMTWNFASITESIEAGRHYGYDLPHNIDVNYTHFKKLRDSTIERLNGVYEKNWGNEGIDLVHGRARFVEKKTIEVTNQDGSRTRYTAPHILIATGGRPSLPDIKGSEHGISSDGFFEIEELPPKLAVVGAGYIAVELAGVMGTVGVDTHMFIRGETFLRKFDPMIQKTMTERYEAVGIHVHKKHPGIKEVQLLRDGKGKDKLLKLIMNDGSEMEVNELLWAIGRVPEVEDLHLEIPGVELNKSGHVVVDEYQNTNVEGIYAIGDVTGQAELTPVAIAAGRQLGNRLFGGPQFKNAKLSYDNIPTVVFSHPEVGTVGLTEPQARERFGDENVKVYHTRFPAMFYSVFPPEEKAKNPTEFKMVVAGPEEKVVGLHLLGLGVGEMTQGFGVAVKMGATKKDFDSCVAIHPTSAEELVTLR

SEQ ID NO: 23616 - protein, 128 aa, Aspergillus nidulans FGSC A4
MSDPLLFEDTFTVTGVNQEKYDRVSRLTCTSSDSQTTFTLDINSELYPCTTGESLSMALASTLSLDGKEDGAKTGWREVGMGEQTLANDYDYVCHGKVYRFEEASDSPGNMSLQEARAPTDRLRVPPS

SEQ ID NO: 23617 - protein, 236 aa, Aspergillus nidulans FGSC A4
MTLTTRQLKKAARIILIGAPGVGKGTQTERLLSKFPELASISSGDLLRENVRRRTALGREAEATIQAGNLVPDSMILNLISSEFNSRGWLSKSQSSGSSVSPSASFILDGFPRTASQAASLDSLVPINFVVHLVTPPSIILSRIASRWVHEPSGRVYNTDFNAPKVPGKDDVTGEPLTQREDDSIETWKQRLHKFEETSKALLQHYQQKGCLWRVEGNSSDEITPKLLAEFERKFC

SEQ ID NO: 23618 - protein, 1103 aa, Aspergillus nidulans FGSC A4
MTRSLYDRIWLREAGGGSTKANIRGIYGSKEWVNDLDIVNELGGHTGCVNALSWSRSGRLLASGSDDFHLNIYSYQPDSSTAPFALNTSVFTGHTGNIFSVAFMPHSNDQTLVTAAGDSQVRVFDIEYSSSRNGSQGIPPAFANQARNPHLNRFFGNTRYLGVGNTNARIYRSHADRVKRIVTESSPYLFLTCSEDGEVRQWDLRLPSSAYPKPRGGLLYMTQRVGEGHDDSNVPPPLISYKRHRIDLNTISCSPSQPHYIALGGAHLHCFLHDRRMLGRDMTAERGDPGTSPGIGSGYDEELMGQATRCVRRFAPNGKTRTKSRYKGHITACKISNANPNEMIVSWSGDHIYSFDLVRSPDALSTQEQQSSVQGQSSSRKRRSSKDRKRKRQPRTSQSSQSSQSSGGRRRSARRSEETHGEGELAVRVRYGNGETEDIPFPSLLHEGSTASAVASAEAMEQARYSVLNEVQRQSLRIAKGLVKLRKALFSLEASAREHANMATPFSVVAFHDSFSSALMLALTFLPQMEEIMRTWRYPLNPTPEIVRVQQTLRRNRESAYRFVQAAGTLARALGGDVQDYGVDDDVLEKFQQIGPAPGEDNVIGRREQFGYDFLKALILFAEGGRSAVLAGFKRSAAHGRNRDRFPIPQFATEGALEAVLIPYLHDLADDSLVVNVDSSRFEHDETRILFPSQKAAVDAFENALRSAIPNDTASGTEAGEGCANGADGTNRLGGSDSSATDPATSTTHFWLLSVGRGILMDAGTGVNFEFVNRSYGGLNATVEDDSDEEIEVERSQDDTEANVEEEAIQDISLAINRGSSQQSHRARSDEIPESQTPMSTDTGSEMENFGIAVASSSSDEHENDEDDDDDDDEDMDDSSESDAAERLFRSYGFERSGREDVENHVPCSSHTRVYRGHCNVKTVKDANFFGLNDEYVVSGSDSGHLFIWERDTCKLVNILKGDDEVVNVVQGHPYEPTIAASGIDDTIKIFSPDQRAQEDARNGINILDPNNPANTLGGGYGGLKSAKCMHDSYRIMSENDVQRQGGMSDAFLTRHMLAQFAATVRQQQGGLVPGEHSRIVLDENCSSQVNVEGKRKREIITI

SEQ ID NO: 23619 - protein, 400 aa, Aspergillus nidulans FGSC A4
MADEQKPVTAQATNAEAEKDVQNVLAELKGEAEVPVNGTEKEEAKEASADKSEEAEEARIVAAAAKLGEKSEKSENGNQAEDRGRANRRRNESKFDPSTQKETDDPVEIRKQVEFYFSDSNLPMDKFLLSKVGGSKNNPVPLELLHSFKRMRRFQPFSAIVEALKNSETLELTDNDTAVRRKVPLPETVKDTHDPTVVKVFEDKAMARSIYAKGFGEETPTTQLDIEAFFAPYGPINAIRLRRTNEKYFKGSVFVEFASEEKQKAFLELDPMPKWKDQELIIKSKKDYCDEKVREIEAGRVKPSGGRGRGGARGRGGRGGRGGRGGRRDNNRDWRERRDADQKQGFKNGQDEQPERREVQKDARYSGVPVVQSTADAGQKRTREDEASAEHPAKKVDTKE

SEQ ID NO: 23620 - protein, 472 aa, Aspergillus nidulans FGSC A4
MVLYGYDASVYNSVQGSDNWVAYFDDPDANLIGAVNTAYTVGAIFGGFFLGGPCADYLGRKMGMGIGCVLVIASTFMQTWAPRHNLGCFIAGRTIIGVGQGIALTSGPIYIGELAPPEIRGKIMTFWQMFYSVGSFICFWVNYGCTNHKENLGEWDWKMVVIFQLLVPSLILVLLPTIPGSPRWYIQRGNNIEKARAALARVRETDQEVEDELLRIREALEYEKEAISSNYSALWKDKSLRKRMVLALIINAGQQVTGQGSLNSYSTKIYQKVFPSSSQIALINALNATFGILFTLNAVWIIDRFGRKFLLIVGGIGMGICMIIVSAVETETPSPNDTKSTPVGISIVFLLFLFIFFYKPSWGATVWIWTSEIFSMNVRAQAVGMASQTQNVANAIFQQFFPIFLDNCGFYAFYMFAGINFLLAVFVFFFIPETKQVPLEEIDALFGGANHVTRGEELIGSEKQEVTTTHKE

SEQ ID NO: 23621 - protein, 468 aa, Aspergillus nidulans FGSC A4
MSFVRAASRRMPLAKRLVSAVESPMQRRYVSATLKAQGAVVTPDPGADSVSAAFVNERAPYLVPTYVRPAPIMVKGQGCYLWDMENRRYLDLTAGIAVNSLGHCDPEISKIIAEQAETLLHASNLYHNAWVGALSKDLIILTRESGAMRDAAQVFIANSGTEANEAAIKFARKTGRARDPSGAKHEIVSFHNSFHGRTMGALSATPNPKYQTPFSPMLPGFKYGKYNDVAQLKDLVTEKTCGVIVEPIQGEGGVNVATPEFLSALRKRCDDVGAVLIFDEIQCGLSRTGSFWAHAHPSLVPSSGEAAHPDILTTAKALGNGIPIGATIVSGKTVADNIKAGDHGTTFGGNPLACRVAHHIIHRLASPELQKSVQDKSAILVAGFQALQQKYPDLVSEVRGRGLILGLQLSKDFSARAGEIVTAARERGMLIITAGEGCLRFVPPLTITEEQLKTALRILEQAFEAVKA

SEQ ID NO: 23622 - protein, 1468 aa, Aspergillus nidulans FGSC A4
MAESKRLSSSSRPGQDESEKIQEVQYQTRSRQNSRIDQDDTTFFDEINPGGRAELTRIASNFARRTSTAASTTTGKGIERMDTVDEMTLEDPAFDPTSDQFNHYKWARKIMKLMDEEGAPRPPSTGITFQNLNVFGSGSALQYQDTVVSLLTAPLRLHELLFKRAPERHILHDFNGLIGSGELLIVLGRPGSGCSTFLKSLCGELNGLKLGEGSHIQYGGIPMKTMHKEYKGEVVYNQEVDKHFAHLTVGQTLEFAAAARTPEHRLRGASRQQSAKYVTQVAMAIFGLSHTYNTKGNLSVQALAEMALSRAPIAAWDNSTRGLDSASALEFVKALRIAANVGGSCHAVAIYQASQAIYDIFDKAVVLYEGREIYFGPCDKAREYFVEMGYYCPPRQTTGDFLTSVTNPQERKAREGMEKRVPRTPEEFEKYWKNSPYFAELQREIAEHLEQFPVGGEVEQTFGQAKRYIQAKHVRPKSPYVISIPMQVKLCTIRAYQRTPDASAGFQSKGASLFFAVLMNALISITEINSLYDQRPIIEKQASYAFVHPFAEAFGGIVSDIPVKFVAAVVFNVIYYFLAGLFFIFFLFTFLSTLAMSAIFRTLAASTKTLSQAMSMAGVMVLAIVIYTGFVIPTPQMSDIPWFSWIRWINPVYYTFEAMIANEFHGRQFECSQFVPAYPNLSGDSFVCAVRGSVAGERTVSGDEYIYSQYRYTYDHEWRNLGILIAFWIFFTVVYLVATELNSATSSKAEFLVFRRRHVPPQMRILGKSQGDASPENVALAEKPTEVAPNTSAIPEQHSIFTWRNVCYDIPVKGGQRRLLDNVNGWVKPGTLTALMGVSGAGKTTLLDVLAKRVSIGVVTGDMFVDGRPLDTSFQRKTGYVQQQDLHLPTTTVREALQFSAVLRQPKTVPRAEKYAYVEEVIDMLNMQDFADAIVGTPGEGLNVEQRKLLTIGVELAAKPALLIFLDEPTSGLDSQSSWSICSFLRKLADRGQAVLSTIHQPSALLFQQFDRLLFLAKGGRTVYFGDIGEDSRTLLDYFEANGARACGSSENPAEYILEVIGAGASGKSDLDWPSIWKESTEAREVLQEIDRIHKDRASASSVEDKNTHREYAMPFTDQLWQVTSRVFQQYWREPIYVWAKLILAIASGLFIGFTFFKPDSSQQGFQDVLFSAFMLTSIFSTLVQQIMPKFVIQRSLYEVRERPSKAYSWAAFIIANVLVEIPWQILAAIVSWASYYFPVYGASQPPHRQGLILLFVIQFFIFTSTFATLIISSLPDAETGGTIATLMFMMTLVFNGVMQAPSALPGFWIFMYRVSPLTYLIAGLTATGLHGRAIECATEELNVFNPPNGMSCGEYLTEYLAVAPGLLYNPDATANCQYCGLTNADQYLAASNIYYSERWRNWGIGWAYIGFNIFGTVALYYIFRVRHWNPTSLIRSVKQGAQVVCRVFKRRSGETPRGKEAENGRLY

SEQ ID NO: 23623 - protein, 334 aa, Aspergillus nidulans FGSC A4
MSSHPSTIRPPLDPELAVAQKSFPRTPLRESLSARRKAAILTWESISGGREALISHSEVDIPGPAGTLRTSVLRSTKAEHQAQPASKTVGIVHFHGGGHVTADRFVGLNTLFDIIEKLGAVVVSAEYRLAPEHPQPAQVEDSYAALRWAHSHASELGFNPDKLVTCGGSAGGNLTAGVSLLARDRAGPKLLGQMLFYPWVDDATTSHSIEQFGDVAPWTKDDNAYGLDLALGKNREYASIYSLPARAAETQQGLSGLPPTYLDVGEADVFRDQDMEFAGNLWKAGVQTELHVWPGAWHAFDTFAPEASVSKRAFKARLEWLEKLLEATDAGISA

SEQ ID NO: 23624 - protein, 1486 aa, Aspergillus nidulans FGSC A4
MGQDSAVGEASSQSTRGDGPLSAVEQEDKLHNEVSKVAKRLSTSSASENGQPQVLNPMPGSNLDPSSPAFDARTWVKEFNRLLESDPESAPPRALGVAFKQLGVFAYGTAAEFQKTTGNVLIEAAVYLARWFRGNRHGRRVDILRNFEGVVEKGEMLLVLGPPGSGCSTLLKSLAGETADLNIAPESYINFRGLDLASVRSSFRGDVLYNDELDTHLAHLTVGETLTFASRARSVRHVPGAFSRRQLDTARRDVMMATFGLNHTIDTRVGDDFVRGVSGGERKRVSIAEASLAGAKFQCWDNSTRGLDSANAINFCSSLRLQADLLDVTSVVTLYQAPQAAYDLFDRVTLIYEGRQIFFGHITEAKGYFEKLGFFAPSRQTIPDFLTSMTSAEERRVRPGFEESAPRSPDEFAERWRLSDERRKLLDELASYEQKHPPEVRMAEYDRSRRAEQAQQQRAKSAYTISYPQQVSLTLWRAYRRLLADPGFTIASLLFNVVMALILGSMFYNLKPDTSSFYYRGGIIYFSLLFNAFASQLEVIPSKLNFSVLTIYAERPVVEKQNRYAFYHQSAQAIASYLMDLPYKIINMFVFNILIYFMANLRREAGAFFFFCLTTLLSTLVQSAVFRTLACITRTSEQAMIPSAILSLGLMIYTGFTTPPGYMPGWSRWMAYINPLWYGFEALMANEFHERDFPCASMVPTGQGYANLPSASQICSVVGSEVGSALVNGDSYISKSFDYWNVHKWRLVNSKNTIDTEGQCTNGSRSNRNIGILCGFLAIFFPTYVLAAELAKPPKTRGEILVFGRGKGFHRREQPLDAESQEKDRPVVADKTHGSLQSDTIIAGKDVFHWEDLCYDIKVKGGTRRLLDHIDGWVKPGVSTILMGVSGAGKTTLLDVLATRVTTGVVTGQAMVNGKPTDPSFQHKVGYVQQQDLHLSTMTVREALQFSAVLRQSAEIPKSEKLAYVEQVIDTLEMREFADAVIGVPGEGLNVEQRKRLTIGVELAAKPQLLVFFDEPTSGLDSQTSWVISELIKKLTNSGQAVLCTIHQPSAILFNQFDRLLLIAPGGKTVYFGDLGSGASTLIQYFEKYGTPPCPAGANPAEWMLRVIEPPADGSKGLNWHQIWLDSPEYQAVKAELGHLRNLRTLGSTRGEGLEVENSSQHQEFVASFWTQFSQVLQRTWKHFWRSPTYIWSKIILVVLSSLYLGFSFNVNNSIQGLQNQLWAIFMLLILFINITEQIMPMFLPQRALYEARERPSKIYRWTTYLLSNILIELVWQTLMAVLLYFCWYYPVGFVQNTTSDDQAIRGFAVFLFLWVYLLFTSTMAHFAIFWINLPETAGVLTSLLWMLVGVSMADLPKFWTFMYRVSPATYLVGGIMSNAVANSDVICADREILRMAPIGNLTCNEFLTPYINVAGGLVLNPTSQSTCEYCPLATTNEFLDRFQISYSTRWRDLGLVWVYILVNIVAGMGLYWAFKVPKRRGSKHA

SEQ ID NO: 23625 - protein, 410 aa, Aspergillus nidulans FGSC A4
MPPGLPTTMTETRLFKPIKIGTVQVQHRIGMAPLTRLRANPDRTPTSLMKEYYTQRASVPGTLIITEGTLISTASAGAFPGAPGIWRADQVAAWKEITDAVHKRGSFIYVQLFSMGRAAEKKLAESEGIEVVAPSAIPIPYDEKPDAPIPRAMSVAEIQQTIVDFVKASKDALTAGFDGVEIHGANGYLLDQFLQDTSNQRDDEYGGSVANRSRLLHQVLQKVAKAIGADKVGLRLSPWSRFQGMRMDDPIPQFADIIDKASDLNLAYLSLIEARVFGARDYEGSLDGDKETLDFVYERWHGPVLVAGGYELEKARRLVDEQYPKKDIVVLFGRHFISNPDLVYRFKEGVELTKYQRETFYEIRSAVGYVDYPFSKEYSATINLAGSRVGRLSDLRKCGSPGLDFSSSKS

SEQ ID NO: 23626 - protein, 512 aa, Aspergillus nidulans FGSC A4
MALLGLLETYRDPLAFVAALSAVFYLLSCLHRRWRRYQFAKENGCEPVVGKIPSYDPFLSLDRLYRLTKLARNRKLLENNVQRFKEFGNTHRAKRITTPMIVTRDPQNIKAILSLKFGDYSMGDRIRIFGPLLGHGIFTSDGEDWARSRHMIRPNFVKEQVAHLEIFEELMDDLFALIPTDGSTVDLQELFFGFTIDSATEFLCGHNVHSLKKRRSGVIDDEPDFAEAFNYSLDNISKNGRFGPLMFLNRDPKAVESHRICHESMDQFVDKAIRMRERYNEEKIVDEAAERRYMFLYGLAQQTGDRRRIRDEVLNILLAGRDTTASLLSNMFFLLAKHPSTWAKLQEEVATLEGRAPTYEQLRNMKYLKYCLNETLRLFPVVPVNSRTAIRDTVLPVGGGPDGQSPAFVPKGTMVAYSVYAMHRREDYYGADAEEFRPERWADLRPGWEYLPFNGGPRICVGQQYALTEAAYVTTRLAQRYSILESRDPGPWEEKLTLTLCSYNGTQVSLRH

SEQ ID NO: 23627 - protein, 439 aa, Aspergillus nidulans FGSC A4
MADTLITAIARRGAENIHSLTAVSNNAGAPGKGGLSTLTQSGQVDRLIISYLGNNKALEKKYLTGNIAIELCPQGTLAERLRAGGAGIPAFYTATGAHTFLQDGRIPVRVDASGNVLEHGKPRETRVFNNKTYLMETALTGDVAILRAWKVDEAGNCVFRYTTKAFGPIMAKAATLTIVEAENIVPVGSIDPNDVDLPGIFVDRIVPSTAEKQIEIRKLRQSQEDGSTAAGVSPAIIQRNRIAKRAAKELKQGYYVNLGVGIPTLAPSMLPEGVKVWIQSENGILGMVRQERRGNRTDIINAGKETVTLLPGAATFDSTESFGMIRGGHVDVSILGALQVFKGMGGAMDLISNPDQTKIVVATSHTAKDGLPKIVTECSLPLTGANCVSTIVTELCVFQVDRQKGELTLTELAPGVDVNEVREKTGAPFHVADKLEVME

SEQ ID NO: 23628 - protein, 497 aa, Aspergillus nidulans FGSC A4
MKPTQVLRLAVAAPDVNPQTRKARSIPVLNPFDLYGRVFFFSWIGFLVAFLSWYAFPPLLSVTIKKDLHMSQDDVANSNIVALLGTFVMRFIAGPLCDRFGPRLVFVGLLICGAVPTAMAGLVTTPQGLIALRFFVGILGATFVPCQVWCTGFFDKNIVGTANSLAGGFGNAGGGITYFVMPAIYDSFVHDRGLTPHKAWRVSYIVPFIIIVSIALAMLFTCPDTPTGKWADREKTSGQSIVDLSSTPNASSANSINISSDEKKAVHPEVTDSEAQVHVRAGQIESSDAVIEAPTIKRYLSIALDPSALAVAVPYACSFGAELAINSILGAYYLLNFPLLGQTQSGRWASMFGLVNVVFRPMGGFIADLIYARTNSVWAKKMWLVVLGLAMSGMAILIGFLDPHRESVMFGLVVLMAFFIAASNGANFAIVPHVHPSANGIVSGIVGGMGNFGGIIFAIVFRYNGTQYHRSLWIIGFIILGCTLFFSWVRPVPKQNH

SEQ ID NO: 23629 - protein, 497 aa, Aspergillus nidulans FGSC A4
MSDLFTTIETPVIKYEQPLGLFINNEFVKGVEGKTFQVINPSNEKVITSVHEATEKDVDVAVAAARAAFEGPWRQVTPSERGILINKLADLMERDIDTLAAIESLDNGKAFTMAKVDLANSIGCLRYYAGWADKIHGQTIDTNPETLTYTRHEPVGVCGQIIPWNFPLLMWSWKIGPAVAAGNTVVLKTAEQTPLSALYAAKLIKEAGFPAGVINVISGFGRTAGAAISSHMDIDKVAFTGSTLVGRTILQAAAKSNLKKVTLELGGKSPNIVFDDADIDNAISWANFGIFFNHGQCCCAGSRILVQEGIYDKFVARFKERAQKNKVGNPFEQDTFQGPQVSQLQFDRIMEYINHGKKAGATVATGGDRHGNEGYFIQPTVFTDVTSDMKIAQEEIFGPVVTIQKFKDEAEAIKIGNSTDYGLAAAVHTKNVNTAIRVSNALKAGTVWINNYNMISYQAPFGGFKQSGLGRELGSYALENYTQIKTVHYRLGDALFA

SEQ ID NO: 23630 - protein, 178 aa, Aspergillus nidulans FGSC A4
MKAYWYDNKPGDQREPHDSGRPVSEDYLASLGVIYRHFPELSDVDALAKERGYKNRDEITVSPATMGEAYEDKVKMFFAEHLHEDEEIRYIRDGEGYFDVRGKEDEWVRIRLVKDDLIILPAGIYHRFTTDNKNYIKAMRLFQEEPKWTPLNRAPELDENQHRKSYLEGLTATSIAAN

SEQ ID NO: 23631 - protein, 442 aa, Aspergillus nidulans FGSC A4
MLRSWPNRCRRNLRTQRGHLSVRVLHSESFVHNPPPWRPVSALDEYVERQIRPISLRQLTFFGRTLTESRLLSSANYVRTELPTRLAHRLRDIQKLPYAVVANPHFSLVYELYYKAFERFRTVPEIRTLDDNDRFCDILRKTLKEHLVVIPRLAMGVLECRGLLPAEAMDQFMNTLLRARISRRVIAEQHLALTETFNSPWHFPGSQDRTDLNADFVGEVFLKCNAKEVVERCGKLVQDIIRQSSGSDKIPEISVQGHLDATFPYMLSHLEYIIGELLRNSIQAVSERYQGLNQTPPPIEVLICEAPQHVIMRVSDQGGGIPREILPYLWSFTKGPHSKVRLENLGQVPAMAATLQELSVSSDIKHADKETFRESSLDTLTSRPPDLRLGIGLPMSRVYAEYWAGSLELHSLEGYGVDAFLQISKLGNKNEQVTTRAAIDAV

SEQ ID NO: 23632 - protein, 135 aa, Aspergillus nidulans FGSC A4
MRVPIITTLLTLALTGLSQAASLGVETTHGVECNRKTTKGDTVKMHYRGTLAEDGSQFDASYDRGTPFKFKLGAGRVIKGWDEGLLDMCVGEKRTLTIPPEYGYGDRGIGPIPGGATLIFQTELLEIEGVPKDEL

SEQ ID NO: 23633 - protein, 1462 aa, Aspergillus nidulans FGSC A4
MDPITDSRPKAVDRDSTATSCNSTLDENQIENDREVTNLARVLSERSKHSHHQLPFNFGKDPSLDPQNAQFNARAWAKAFYNVRYSSTDAPPPRVAGVAFKNLNVAGYGSPVDYQMSVGNALLKLPTLAWQWLGGKKQRTEILQDVDGLLLPGEQLCVLGPPGSGCSTLLKTIAQETHGFEVDPSSYVNYQGITPKQMSKKFRGEAIYTAEVDAHFPQLVVGDTLYFAALARTPRHVPGGMSREEYAVHLRDVIMSTFGISHTINTKVGNDFVRGVSGGERKRVTIAEAALSYAPLQCWDNSTRGLDSANAVEFCKTLRTQGDVFGITSCVAIYQAPQAAYELFDKVTVLYEGRQIYFGPAKEAKDYFIRLGFVCPEAQTTPDFLTSMSSPVERVIRPGFENLVPRTADDFAQRWKESPERQALLRDIDRYNTEHPFNATDLDLFSSSRDAEKSKNQRPKSPYTLSYWGQIRICLWRDFQRLKNDPSVTLAMLILNFFEALIISSVFYNLPGNTSSFFSRGALLFMMVLLSAFSSVLEIITLYEKRTIVEKHSRYALYHPSAEAISSMIMDMPYKIVNSLLNSLVLYFMGNLRREAGAFFFLYLISFAMMMGMSMFFRFFASLTKSIEQALAPSSIILLALVLYTGFAIPVSYMRGWASWIRWLNPVSYGFEAVMVNEFNGREFPCVSFVPSGPGYENVSPQERVCSTVGAVPGSDVVQGADFVRSSYGYEYSHRWRNFGIIVALTVFLTMCHLVTSELVSSQRSKGEVLVFRRGKAQKMREKRHHTDEEQIAAPAAQNEKVIQEEPGLVSGVEQQSSIFHWEDVTYDIKIKGETRRILDRVDGWIRPGTLTALMGVSGAGKTTLLDVLASRTTIGVVGGNMLVDGRSRDESFQRKTGYVQQQDLHLHTSTVREALKFSALLRQPPQYSRAERLAYVETVIDLLNMREYADAIVGVPGEGLNVEQRKRLTIGVELAARPKLLLFLDEPTSGLDSQTSWSICNLMETLTKNGQAILCTIHQPSAMLFQRFDRLLLLAKGGKTVYFGEVGQGARTLMDYFVRNGGSACPPGANPAEHMLEVIGAAPGAQTDIDWPEVWRSSPEYQQVRSELARLRELANRPSPVSDPNDKSSYAEFAAPFSEQLLQVGRRVFQQYWRSPSYIYSKALLTVGCSLFIGFSFFKADNTRQGLQNQMFGVFVFLFVVVQLVMQVIPSFVTQRTLYESRERQSKTYAWQAFVLSNIIVEFVWNTIMAIFCYLVWFYPVGLYQNARYTDTIHSRSTLTLLIIWAVFLFASSFAHMLIAGVDSAEMASALSNIFFIMMYAFCGILAGPNALPGFWIFMYRVNPLTYLVSSLLSATLGDAPMHCANNEVLTFFAPPGLTCREYMEDYRSVNGGYLLNPDAQGSDQCQFCSLEYTNQYLSSLSIDFNNRWRDFGLLWVYVIVNTVGAIVFYKLFRVPRAKKD

SEQ ID NO: 23634 - protein, 380 aa, Aspergillus nidulans FGSC A4
MFYALGPLALFAFATEVMATPVAYPMTTASPTLAKRDSCTFSGSDGAASASRSQTDCATITLSDITVPSGTTLDLSDLEDDTTVIFEGTTSWEYEEWDGPLLQIKGNGITIKGADGAKLNPDGSRWWDGEGSNGGVTKPKFFYAHDLTDSTIQNLYIENTPVQAVSINGCDGLTITDMTIDNSAGDDAGGHNTDGFDIGESSNVVITGAKVYNQDDCVAVNSGTSITFSGGTCSGGHGLSIGSVGGRDDNTVDTVTFKDSTVSNSVNGIRIKAKSGETGEIKGVTYSGISLESISDYGILIEQNYDGGDLDGEVTSGIPITDLTIENISGSGAVDSDGYNIVIVCGDDACSNWTWSDVEVTGGEDYGSCENVPSVASCST

SEQ ID NO: 23635 - protein, 230 aa, Aspergillus nidulans FGSC A4
MSLQAHAQALVTSLSQAALVPGSAPLIPDDFKPTTELNVTFGEKAVNLGNLFRVSEVKSAPTVSFVKEEQSPECQLYTLLLVDPDAPTPDDPKFAYWRHWLVSGLTASQSINAESAKTLTEYLGPGPKDGSRPHRYLFLLFREPEGLALSKEDVGGEEFVQRRSFQAAEWVQKHGLVLVGVNWMLGAGDGWTENSLPLLLGVAFLYLLSMFVITSITVPPYTSMTTVPVS

SEQ ID NO: 23636 - protein, 461 aa, Aspergillus nidulans FGSC A4
MLSFKTVFSAIFLAVGGLGFLFGYDSGIITSTISLPTFIDYFSNPSSTVTGGIVSSFQGGAILGTMVNMAGADWAGRKMTVLAGAIVSVLGCALQAGAVNMTMLIIGRFIAGVAVGMLTSTIPMYAAELSEPKWRATLSGLLQWMLSWGFLVAQWLGYGWRFPLAFQNVPGLILIAGIWFLDESPRWLMEKDRHEEAKAVLTRIRKGASADTVELEFREIRDVIAADRAVGNTSWRTILTKPSWRRRLILGCGVQAFGPLSGINTSLMIIGISGALSIVYCSIGLYLVDRVGRVKPLFVSALFLGAALLVNAVQAQYMDQNNENQLRSMVAMNFVFSLFYTPVGIISWVYPAEIFPVEVRALGNALTTFTNWTVNLVFAQFTPSALDSVGFKYFYLFFVLNLIAATCYYFFFPETKGRTLEQIDELFGDQLVPHALEDPDAAYAAMEKEHATHMEERGARA

SEQ ID NO: 23637 - protein, 1425 aa, Aspergillus nidulans FGSC A4
MSTLTVGDTALPRESRETMVSIRDSDSTTTVLGEDSASTTDPNVSRADGWALMPQVKEQNEREAESGFKRRELGVTWQNLSVEVVSADAAVQENFLSQFNVPKLARESRNKPPLRTILDNSHGCVKPGEMLLVLGRPGSGCTTLLKMLANQRLGYKAVQGDVRYGSMTAKEAEQYRGQIVMNTEEELFFPSLTVGETMDFATRLKVPFRLPNGVESPEAYREEYKKFLLQSMGISHTVDTKVGNEFIRGVSGGERKRVSIIECLATRASVFCWDNSTRGLDASTALEWTKAIRAMTDVLGLSTIVTLYQAGNGIYDLFDKVLVLDEGKQIYYGPMTQARPYMEALGFVCREGSNVADFLTGVTVPTERKIRSGFEARFPRNADAMLEEYNKSAVKADMISEYDYPDSEYAKLRTEDFKQAIAEEKAKQLPKSSPFTVDFMNQVKICVTRQYQILWGDKATFIIKQVSTLIQALIAGSLFYDAPNNSGGLFVKSGALFFSLLYNSLLAMAEVTESFQGRPVLIKHKSFAFFHPAAFCIAQIAADIPVLIFQVTIFALPVYFMVGLEMDAGVFFTYWILVFATTMAMTAVFRACGAAFKTFDDASKVSGFLISALIMYTGYMIRKPEMHPWFVWIYWIDPLAYGFDALLSNEFHGKIIPCVGTNLVPAGPGYENATTQSCTGVGGSIPGRNYVTGDDYLASLSYSHGHVWRNFGILWAWWALFVVVTIIATSRWKGASENGPSLLIPRESVEKHRQHGHRDEESQSNEKTSTKGKSEGVQDSSDIDNQLVRNTSVFTWKDLCYTVKTPSGDRQLLDHVYGWVKPGMLGALMGSSGAGKTTLLDVLAQRKTAGTIQGSVLVDGRPLPVSFQRSAGYCEQLDVHEPYATVREALEFSALLRQPRTTPREEKLKYVDVIIDLLELHDIADTLIGRVGAGLSVEQRKRVTIGVELVSKPSILIFLDEPTSGLDGQSAYNTVRFLRKLADVGQAVLVTIHQPSAQLFAEFDSLLLLAKGGKMVYFGDIGDNGSTVKEYFARHGAPCPPNANPAEHMIDVVSGSLSQGRDWHEVWKASPEHTNAQKELDRIISEAASKPPGTVDDGHEFAMPLWQQTVIVTKRTCLAVYRNTDYVNNKLALHIGSALFNGFSFWKMGASVGELQLKLFALFNFIFVAPGAIAQLQPLFIERRDIYDAREKKSRMYSWVAFVTGLIVSELPYLVLCAVLYFVCFYYQTGLPTSSDKAGAVFFVMLLYEGLYTGIGQFISAYAPNAVFATLTNPLVIGTLVSFCGVLVPYGQIQEFWRYWIYWLNPFNYLMGSLLTFTIFDVDIKCRESEFATFDPPNGSSCIDYLSTYLQGLGVSANLINPDATSQCQVCQYTRGSDYLYSLNLKDYYYGWRDTAIVALFVLSSYALVYGLMKLRTKASKKAEE

SEQ ID NO: 23638 - protein, 253 aa, Secale cereale
MGRKFFVGGNWKCNGTVSQVETIVNTLNAGQIASPDVVEVVVSPPYVFLPTVKDKLRPEIQVAAQNCWVKKGGAFTGEVSAEMLVNLGIPWVILGHSERRSLLAESSEFVGEKVAYALAQGLKVIACVGETLEQREAGSTMEVVAEQTKAIADKIKDWTNVVVAYEPVWAIGTGKVASPAQAQEVHANLRDWLKTNVSPEVAESTRIIYGGSVTGASCKELAAQPDVDGFLVGGASLKPEFIDIINAATVKSA

SEQ ID NO: 23639 - protein, 109 aa, Mycoplasma genitalium
KASDGIMVARGDLGLEIPYYQVPYWQRYMIKACRFFNKRSITATQMLDSLEKNIQPTRAEVTDVYFAVDRGNDATMLSGETASGLYPLNAVAVMQKIDKQSETFFDYQY

SEQ ID NO: 23640 - protein, 305 aa, Arabidopsis halleri subsp. halleri
LVYLNNVAEGCVGRVAAKLEMMEPCSSVKDRIGFSMISDAEKKGLIKPGESVLIEPTSGNTGVGLAFTAAAKGYKLIITMPASMSIERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVKSAILSGGKPGPHKIQGIGAGFIPSVLNVDLIDEVVQVSSDESIDMARQLALKEGLLVGISSGAAAAAAIKLAQRPENAGKLFVAIFPSFGERYLSTVLFDATRKEAESMTFEA

SEQ ID NO: 23641 - protein, 104 aa, Arabidopsis halleri subsp. halleri
YMLQQFENPANPKIHYETTGPEIWKGSGGKVDGFVSGIGTGGTLTGAGKYLKEQNKNIKLYGVEPVESPILSGGKPGPHKIQGIGAGFIPGILDVDLIDEVVQV

SEQ ID NO: 23642 - protein, 410 aa, Rhodococcus rhodochrous
MSTTAQKLAELREKLEIAKEPAGELAIAKRAKKGIPSARERIDMLLDRGSFVEIGALMKTPGRDDAMYGDTVVVGHGTVDGRPVAVFSHDQTVFGGSVGEMFGRKVAAVLDFALKIGCPVVGINDSGGARVQDAVTSLAWYGEIGKRHEPLSALCPQISVIVGNCAGGAVYAPINTDVVVATEGSHMFVTGPDVIKAVTGESVSLEELGGARQQAEYGNVHHIAPDEKAAFEWVRQYLSYMPSNAQEKPPVINPGLEPEITPDDLELDTFMPDADNSGYDMHDILLKIFDDGEFLEVRSQTAPNIITGYARVDGHAVGVVANQPLYLSGALDAAAADKAAHFVRVCDAYDIPLVFVVDTPGFLPGVEQEKIGIIKRGGRFLFSYVEASVPKVTVVVRKAYGGGYAVMGSK

SEQ ID NO: 23643 - protein, 457 aa, Rhodococcus sp. DK17
MSYYATTSPLTGQRVQEFPRATDHEISDALTSSDAAYRQWRTSSLEERADVLRALAKLWHERADELAPILTLEMGKPIPQARGEVALCANIFEYYAEHGPTFMEDEVLEIAGGGEAIVRTEPIGPLVGIMPWNFPYYQVVRFAAPNIMLGNTLLLKHSRNCPQSALAIETLFVEAGLPEGVYVNVFADNAQVARMVADPRVRGVSLTGSERAGSAVGEIAGRHMKKFVLELGGSDPFIVLDDTDLDTTVAAAVNNRMANAGQACTASKRLIVLDDVYDRFLDKFTEAMRNIVPGDPTDPATTFGPLSSRSCVDEIAEQVDDALAKGAKLLTGGCRGEGPGAFYEATVLAGVTPQMRVYSEELFGPVAVVYKVATEAEAIALANESPFGLAAAIFTSDRNQARRVAEDLEVGMAWINGTSKSAPDLPFGGVKRSGVGRELGRYGFNEFANKKLVRTVR

SEQ ID NO: 23644 - protein, 413 aa, Rhodococcus sp. DK17
MPESTTVIVGASIGGVRTAQALRSEGYPGAIVLIGAEGELPYDKPPLSKSILAGDSTMAEITLLTTEQARELDLELRLGQPAIRLSTANQDVELADGTRVAFDNLVLATGARARPSPWGTPNGLHVIRTAADARALRRHLGTTDHLVIIGGGFIGAETAATAVELGIRVTLVDPEPVPMARVMGAEIGELFIDLHRCRGVDTRFGVGVESVHGEHRSFAIGLSDGSTLAADTVVVGIGAIPNDDWLESSGLEVSNGVVCDVYCRAIGHDNIYAVGDVCRFDNTRRGGSTRLEHWTNAVEQAVVVARNIARPDEKIRHEPVEYVWSDQYDWKIQTVGLAGSSTHTVIGEVTNKARFAVCYPDENGKLTGVVVVNWPKALVTARKAIALGVEYAEFAARLEAMTVSARTTVKETT

SEQ ID NO: 23645 - protein, 459 aa, Rhodococcus sp. DK17
MSLAPSRVTLPDFIDSRPVSRYQYIVIALCGVVMFIDGFDTQSISYMAPHIAEEWGLSKQVLGPIFSAALAGLMVGYLALSPLSERFGHRRMILTSTVIFALGTLAAAWSQNVTELMALRFITGMGLGAAAPSAIALTGEFSPKRLRATFVLVIYCGFSLGFVAAGLVSGWLIPILGWRSVLVVGAVAPLLLLPALLRYLPDSLTSMINRGAEPNRIQAIFRKMDPALAVGPDITYEAEKRTDGQRTALRSLFTRDRVLGTLLLWLVFVINLGEFYALQSWLPSIMTSLDYNMGTVVTATTLTTVGGIAAAFVTGPCMDRLGAYVTLGTVYVVGFAFVALTGVAFTAPLWVLLTANFFAGVCISGGQKSLIALSAVFYPTPMRSTGVGWALGVGRLGGIVGPIAVGAALGMGWSASAVFYAMSVPMLVAGAAVFLLGRWVRSDNHPDRKSAESHSLARK

SEQ ID NO: 23646 - protein, 485 aa, Rhodococcus sp. DK17
MAPAYLPWLLAEPFGSAPAIRDDLREFSFEQLDARVAAVAAQFAGRDVGRGDVVAVMLPNRSELVVAIFAAWRLGAAVTPVNPNFTEQEATHQIADAGATLVVNAGPGAPTGGKPTIAVDDLAEHSTGEVPAPVVLADSDMALVIYTSGSTGRPKGVMITHGNADAMTASIVEVMALTTSDHCLLILPLFHANALMVSLLASLRVGAQLTVVGKFSPDTFFHAVEKHRPSYFSGVPTIFALLVTKAAERDTDLSSLRFAICGAAPATRELLQASEEMLGAPLLEGYGLTEATCASAINPLVGLRKIGTVGPSLPGQSIRVVDDELRDVPTGETGEVLITGPVVMAGYLGNPEATEKTIVDGWVRTGDVGVLDSDGYLTLVDRIKDMIIRGGENLYPKEIENAIGSLPGVLEVAVIGRPDDVMGEVPVAFVVPYPDASLTPETVIEHCRNLLTRVKVPVAVDIVTELPKNPVGKIDKPGLRKALVG

SEQ ID NO: 23647 - protein, 2434 aa, Botryotinia fuckeliana
IYTRGGNFLKGDLAAFDPSFFSITAEEAKAMDPQHRLLLETTYQALENAGIPLSKASGTKTGVYTGSMADDYRFTSLKDPEDLPKYAVTGTAMSLLANRLSWFFNLGGPSINLDSACSSSLMALDIACQGLRNGDSSMAIVAGSCLISCLETWISLCNMGFLSPDSRCYSFDNRANGYARSEGVGVVIIKKLSDALKDNDTIRAVIRATGSNSDGHTPGITQPSREAQTRLIEETYIKGGLDPAKTRYFEAHGTGTPLGDPIEAGAIGSVFREYRSATEPLYVGALKSNIGHLEGGSGIAGLIKTVLVLEKGIIPPNANFEQANSNIDAEFFHLRFPTEQAPWPSQGLRRASVNSFGFGGSNSHCIVNRATAKSFKFVSDPQLLVFSAVDKDGIRRVAEAYRSYFAGHALKTQRSQLSFLRDLAYTLSVRRTAFVWRSFVVTDTLTDLLDLPTKISLPIRAASSLGVAFIFTGQGAQYSRMGTALLSLSVFRDALKKANEIFRQLGCTWCLFSRIIFLYHLYELAHDKSASNINDPAYAQPLCTALQLALIKLLRKYGVSPTIVLGHSSGEIAAAYACGGLSFKSACKVAFFRGQVAQKIRQDFKRPPRAMISINLAEFEIQPYLTKLVGSSNSGSFTTACVNSPCNVTLSGLESDIDLLQQQLNTDGIFGRKLKTGVAYHSPQMNEVAHEYSHLIQSLTIGRTPLSPVVMISSVTGERIANVDCLSQAQYWVRNLVGQVNFLKAYGELVSTATSSPKRKLGAKNSSFKVCDVLEIGPHPALQRYVKDISDKLSPKPELRYHSTLSRNASNTIFIKDLAGRLSSLGYKINFDCVNEPQDPCTSQQKLLVDLPEYPFNHSRSYWHEPRRQRELNLRESPELELLGTPMSDGNPLESRWRKIFDPARVSWIQDHKVNGKVIYPATGMIVMAIEASKQMAPKDQKINGFRLRDIIISNPIQISSQDPKTEAQLCMRPLQNSSDKNCTSYDFRIHAINNGYWKEVCRGIIQVEYETDITEVDHGKVERDEQEDYTLKHEAAARECIESISKEALYQCTSDMGVELGLSFKRLDKILYDGNKVAIADLATFDWAGQEGIDSVESHTIHPTTLDALVQLSWIPLTDGFSTKIPTMIPTRIENAWISNTGLSYQETRSIQVYCTAERKGHQKAEVSSFALDRMGELRLSLSRLESSIVSDTTTFQEKLQPRQLSWYISWKPDVVFLKPHEVLRFCRSETIEEVDRIKVYQTLESMLKYFAKKALNTISEAEEKNAKPFIQKYLASLRRYLKVGEKSTCSNKLLSSAIELDDDYEIDLTIFRDMEDHPLLKSYLSIGKELPGIIRGQVNPLEILFSEEKIAELYYRDICVRGTYGKDIARYLDLLAHKNPGLDVLEIGSGTGSFTECILSALIGFDGTERCTERFNSYHYTDISPSFFEQAREKFGPFSNRLHFRVLDIEGDLASQGFGEGSFDLVLAHSPRTYTPELSQTIETVSQKLNCVVLLLIALVQIGTEEFRSGGPCVSEETWRKVLVKNGFTGVDFSICDTDDPRYHEYSLIVSTANEEDIPTTIQKLIFLVDLASSRQVEVVRNIRAYLKPSINMEIQLLSYKQTISIKDAQSSFLVFLPEIEVPFLHDLSSSDFDVLKHMCISAKNILWVSHSSTGTRFAAFNGLVDGMARALRSELDIAFVTLHIEGSGTDLKKWGETIASVLSQKLLITGMSKDMEYVAHDNLLYTGRIIEAKALDQQIHTRIHEQTRKVRVDQAGAVALTLKKPGLLESLQFTRDENFHLEIGPDEVEIKVQYIGLNFRDLLVSLGRYHNNDNLLGCESSGIVTRVGVNCKTFVPGDRACMAKFGCMNTYVRAHSDLVFQIPKGMTSEEAAGSIMPGSTAYHSLINVAKLKRGESILIHAASGATGQMAIQIAKYLNCDIYVTVGFDKKKKILMEQYGIPEDHIFYSRNLSFVKGIRRMTQGRGIDVVLNYLSGDALIATWELIAPYGRFIELGTLDIYTNTKLPMSSFAKNVTFAAITIDSLNIERPKEFREIMLNVIDYFHRGIFHSVKPFHLISIGNLKEAMRLLQGGKTSGKIVLSLDSADIIPATIQPQALWTFDSKSTYIIAGGLGGLGRSTALWMANKGAKYLVLLSRSGPVTEAATSLLTKLSDMGVSVEVPICDITYSDQLRKVISQFPKTFPPIKGCIQATMDILFEKMNFEEWSAATSPKVRGTWNLHEALPDNLDFFILLSSIAGVFGSMGQSNYAAGNTFQDAFCLYRSSQGQKTISLRLGIMSDVGIISENPDVLKIRDLATESASVKEAEFLALLDHYCSPDNPLELLGSQETLPIIGLLAPSQFSNQELEIPSWAQTPTFSPLAYVGRDDTFSADTKPAKTNFKSQLQTAESANEVKEVVSTAIITKLTKSLGVELADIDTNKPFHAYGVDSLL

SEQ ID NO: 23648 - protein, 2420 aa, Botryotinia fuckeliana
MSHHSQEPVAIIGFACRLPGGNTTPKKLWEFLERGDIASNKVPKSRFNIEGHWDGSQKPRTMRPCGGMFLEDIDPADFDASFFEISRSEAISMDPNQRQMLEVVFEGLENAGIPLESLDGAPVGCFVGSYASDYGDMQNRDPEDRPASITVGVGRAIMANRLSHFLNIKGPSMTIDTACSGSLVGLDVACRYLQSREIDSAIIATSNLYLNPEHVMDLGAVGNAHSPTGLCHTFDIDADGYVKAEAVSSIIVKRLSDAIRDRDPIRAVIRGSATNSDGRTPGIASPSAEAQSAAIRAAYANAGITNLNDTAYLECHGTGTQAGDPTEVKGAASAFSGTRSADKPLIIGSIKSNLGHAEPSAGISGILKAVMAIENGIIPGNPTFLKPSPKIDFAGLKVKATRTAIPWPESSIRRASVNSFGYGGSNAHVILEQPKFPDGPHHITSYLSVADELTLDEDDSDHPYTLVLSANDNVSLKANIKALSNHLINPRVKVNLEDLAYTLSERRTKLWHRAYITTRSTEIDENDFVVGKKNPEALRIGFVFTGQGAQWPQMGKDLLQFFPWTRNILNNLDDALQSLPQPPNWLLIHELTKVRSAEHFRQPEFSQPLVTALQLCIIDVLRKWGIKPQSVVGHSSGEIAAAYAAGFLDQATAIKVAYYRGRAAVNRKNEVESDVGMLAVGLGTEALFPFLEKYAGRAWIACFNSPSSLTVSGKREALEKLAEELKANGHFARLLQVDLAYHSELMEVIGEEYEKLLKSGFASLGGSSDVSMFSSVTGLKKATTTDALYWKTNMVSPVRFDKALNEMLSDEKAPNYLIEIGPSGALAGPISQILKSLPNSGGISYSPSWSRGQNAGKAIFDLAGRLFVAGHDISLRSVNQYTNAKTLIDLPNYTWNHSVKYWHENASSKDWRFKQFVNHDLLGSKVIGTTWKSPTWRKLLNLADVPWLKDHKMGSDVLMPGAGFIAMAVEALYQKTRSTATEDIIISSPNELSYRFRNIRFDKALVLEDDKESPVLLSLTQQHGSKDWQEFRISSTTGDLLIEHCSGLIRIQDPVDEHLADSDNTSLQYPTSGKVWYKAQEEAGYGFGPSFQKLLKVESSSGQRQSRAQVSLSEPASKWSPQSYYPIHPAALDGCFQTVTPALWAGERSSVNAVLVPSIIDDLIINSVPSGLQEGLSLATSEYSGRGRLEEAKSYFANCSVYHPDNGALLMQMSGLRFAKLDMGARTDPHVFDRISWKPDITFFSQEKLGSLDAANPETQLDSVINLIAHKRPALKILEVSLNHSETRSIWFESEDSLSRSAYLQYDYASGDAKGLVSVQNKYKAKSNSSFFLINPTKDALDLPQDAIYDLVILKVAKNPVVDQSLNDSLDYIKSHLSDKGFALVVQESDLQSSISSVTTPLLDEKSQSPLSAGSPNTPGIAIESSEFIVKDSEIPIVTENITPNELQESETKLLESDATLAGVTQRLSISLTIQEAAKLKGITSVLQIADNNDSPAWSLYTSEVKITSQPRNLSVIRLSETTPSLDSSLKAVLEVSGWTVTEVAYSPNNVATTGTVVLILDELHTPVLTQINAIQWEGLKMLINSGTHLLWVTKGAQYKVTDPNNALVHGLFRVARREDPSVKLSVLDVESSAGSATNYAIDAVLNSLQINQDPKTVIETEFVERDGTLYVQRVVPDLRVNEFKRAEVEGAEPILKNLHETEAAVQLRAERLGTFQGLTWCETAVGEVPVDSGKIEVEVMAVGVNFKDVAVTMGIVPENEYTTGYEGAGIVKRLGPDVTKFKVGDRVCFLNGGSYANRLQLGVGRAHIIPDSMSFEDAATIPSVYLCSIYSLYDIANLREGQSILIHSASGGVGIACIQLAQYKKAEIYVTVGTEEKRRFLTDHYGIPPSRIFSSRNTKFAKQIMHATNGRGIDVIINSLAGELLDASWRICADGGTMVEIGKKDIVDRNTLSMEPFDRNCSYRAMDFSYTENIILTFCATLFRLLDQIFELVHGGHVKPIHPVTIFGFNDIPAALAYIRSGRHIGKVVISDKGIDSQVPIRPATRKLNLRSDASYLIVGGLKGLCGSLAIHMARHGAKHIVACSRSGISDVASQKIVKNCLAYGCEVVDAQGDAASASFMSKVFKETSPRIAGIIQGAMILRDKPFETMTLDDYHTALHAKFNGTWNLHHVSQEQKEPLDFFTLLSSISGIVGNKGQANYAAGNTFLDAFAQYRETLGLRANSVDLGLIEDVGYVAEQEGFDARFDKRQWTPVTENTLRKILSYSILQQDEKAPINASSSTQLIAGIGFPLPEDSDLSYEGRFGYLFQSAAGGNKDGGSSQGDETIEAFRMMRKSGADKAALAKVCVEVIAAQFTKILRLETEMETAKPLISYGLDSLAAVELRNWIRIELGAELTTLDITNASSLNALCEKLVSKLS

SEQ ID NO: 23649 - protein, 2544 aa, Botryotinia fuckeliana
  misc_feature (1719)..(1725): Xaa can be any naturally occurring amino acid
MGSLGPTRVTNGNPVNNGSAAVNGDSPTAAHGGHLEPIAVVGMSCRLSGDASDTQKLWELLIKGRSAWSKVPKDRFNQEAFHDPSAEGKPGRTSTDGGHFLKDDIKAFDASFFGINPIEATAMDPQQRLLLEIAYEAFENAGLTLEQLSGSNTGVYVGQWASDYQEMLLRDIDFPPIYQASGVGAAISSNRISYCFNLHGPSLTLDTGCSASLVALHQAVHSLRAGETDKCFVAGVNLQLDPQRYGYQNKLSMFSKQGKSFTFDHRAKTASGYGRGEGCSGVVLMPLSQAQKQGFPIRAVVQNSVANQDGKTNGITVPSAEAQSAAIEKAYSQVGLVPYADYVEAHGTGTAVGDPIEARAIAKVLGAGRESDSPLPIGSLKANIGHTESAAGLTGLIKAVLMLEHNMIPPQVNFEKANPEIDLDALNLRIPITLESRPLKRISVNSFGYGGTNAHVVVDAAREIATVKPTSQNNGISTTYDHHVPEDASRAKERLFVLSAASEKSCQDMSSKVAKYLESKADSPDADTLLSRLAYTLSRRSVMANRVGVIASDLNDLVAQLTSLSTEAIPRADHQTTPRIGFVFSGQGAQYPRMGQSLLGTWPTFTASMKRAAACIKACGSSWDLLEELLKKPAESRMEDPRIAQPISTAVQISLVDTLKDLGVFPSAVIGHSSGEIAAAYCAEAISFEDAMTVAYHRGRLTGDLRKENKGKAGAMIAVGASATTVKQSIDQMGAAVSSRIAIACFNSPESVTVSGDEDVINSLKQRLDERDIWNRILRTGGAAYHSPQMLQVAEKYHEALKDLSGGVPVSNISMVSSVTGEDHADKPITRDYWVHNLVSPVRFTDALKKTCVGESGTRKVDLLLELGSHFQLEGPIKQTLRTFTGQPAKIHYAGSLKRGENAQRRLLEMLRSLYLERFPVAFWKANAGFVETAPELLTDLPPYPFDHSKTYWHESRVSKAYKHRTFLPHELLGSLVHDNNPQEPRWRCFLNLKDVPWLSGHIIQGQTIFPATAYLAMVFQAARQDTAMRNPQATINRFILRNVNMSQALVMENNKPDLEISLSLRPQAVSARKSSQLWQEFRIFSTSAEDIWTEHCRGLVQVVLKSESATQDDSIVPTRVTLPPHAHHIQAKQFYHRARDIGVNWSAPFDNLTDIKIASGSCIADSSFVPGAGASETDYTIHPGVMDAVLYHGMMGVLIFDENDKSPVVPTFIEKMIVAEQDRAKPVQEVTCHATRTDNALTFDIGIFEKQNEENMVLQAWGVVATKLPDVSIGEGRKRDLCHVPDWVTYMPKTTQKHIDDLCKKSLEERSIIPEIKALEALTVNYVKRALASTPADEVAEGYQRNWFKWMKTLADQEPDPVFLKAGEEDGSVSAEVARRLGPRLSEILRGTTHPLDILNEDNLLSGLYLEGGNARCIAQIAAYMGELGRLNPNMKIIEVGAGTGSATLPVLQALQAPNRVLASEYDFTDISPGFFPAARELLSDFENIMQYKTLNVEKTAEENGFEPNSYDVLIASNVLHATPCIDVVLENVRSLLRPGGKLILMEPTENLPHYGLVFGSLAGWWAGVDEGRTLSPMLSRSAWIQKLSKNGFVHNEAVFEDYPVADGGSISVFVSEVPVPAPSAAPLDVEIVSYSGDGVYSSFTEKLQKNLWDRSVEACVASPSVSEDKISIIMPDICERVAWNMDGPLFESIKARVANSKVIVFVMCTAKGKEQRXXXXXXXFCRSIRYEYVSVRLVSLELESGLDAGVEALSTILNSPTADMSLPIDEVELEYMDRDGQLYVSRVRSEPNLDSYVSRDLGRSVSEEAPFFNDRAMSAELGIPGVLDTLRWADNPEISGPVDPDCVRLQLSAASINFKDVLVASGQLEGITQMRNDCSGIVLEVGANMTSKFKPGDRVCSLYSQSFTNYPMVHGLCCHVIPQDMDFADAASIPLVWCTVYYCLITIARLQKGESILIHSAAGAVGQASIMLARHLGAEIFVTCGNDAKVELLNTEFNIPKDHIFSSRTTAFRDKIHAMTKGKGVDVVLNSLGGEMFRESCNTLAAHGRFVEIGRKDLMENALMPMEFLLNNITFTYVDFAHILATKTWLASQLLGDVMKLFASGAVQHVRQIKYSISEMAAAFRLIQAGKHTGKVVLTVDPEVKVQVVPSKPTSVQLNPEATYIVVGGLGGLGKRLVDWTTEKGARHICIFSRTAQPDSDTQSFLDKLKSMGVKVRVEKCDVSSEESLKKAVAMIQKTMPPIRGLFQAAMVLHDVLLEDMTVEQWCKVTAPKVQGTWNLHKLLPDDMDFFIMLSSVVSMVGTVGASNYASSCAFQDGIARYRRRLGLPAYAINIGAIVEAGYVSENPDVAVNLRKNGLGSVAISEFLSHLADVIQYKTEYTQSSLGILPNGTERGLGEARWSNDKRLAQIFGSESQAGSKAVGSGADNVGFVLQAATTFHEAQDIVCKAIVKQLATILAIDASDIIPARSLDSYGLDSLVGVELRNWIGAYLQVNLPLLVMWNTSSINELAEIVTKGSRLVKVKSEETEEEKKDVEEAKEE

SEQ ID NO: 23650 - protein, 2493 aa, Cochliobolus heterostrophus
MDQQPDPIAICGMALRLPGALKTPAQFWTFLTEKKDARAPIPFARFDAEAFYSASGKSGYFNSKNGYYLDDSAEVGALDTSLFRMSQQESERMDPQAKILLELARECFESAGETDWRGKDIGTYVGSFGNDWLEMAAKDRLDKNMYKVSGYSDFLLSNRLSYEYDLRGPSMTIRTACSASLMGLHEACLAIRNGDCSAALVGGSNLFWSPDTMADMSEQGVTSPNASCRSFDADADGYARAEAVNLIYIKPLSAAIKHGNPIRAIIRGSSLNADGKTPGPSMPSSSSQAALIRRAYQNAGIPESEIIRTAFVECHATGTATGDPIEATAVGNVFGNGGVYIGSVKPNVGHSEGASGITSIIKAVLALENRVIPPNIKFETPNPKIPFLEKDLKVPTDCLGWPKDKLERVSVNNFGIGGANAHFILDSAASYGVNSDIIADPEREESFLESLKWGKLFLITASTSESLEMQTRNLRDYALSNPTKAEHGSYTLACRREHFSHRAFSVIQELSVDSQAGVSIAGVSPLRLVMIFTGQGAQWPRMGIELLQSNTTFASSIKEMDQELRGLPTPPTWSIEEELAKGADSSNLNEAAISQPLCTAVQVALVDALANLAIKPHSVLGHSSGEIAAAYAANRISRRAAIVLAYYRGLVSQAATRSGAMAAIGLSWDEVTPFLQEGVVIACNNSPSNVTISGDEAVVRNVVQAIQTSNTEVFVRMLKVSTAYHSHHMLNAGNEYEEMVASFLEGEVPYNGASTNPGFFSTVTGLLLPDSERIDAQYFRRNLESPVLFLQALDSLLTGSKDSAHRNLCFLEVGPHSTLSGPLRQIFTQNSVAHPYASCLHREKNANATYLAALGTLWQHGLNFDLYRLTNPLGIAKVLPDMPTYPWYHGKSHIIQNRIAQAWRYPKFPHHELLGSLVLENNDDQPSFRNLLQLENAPWIRDHNIDGDVVFPGAAYVTMAGEACRRQCLPDQDHTFFGFSVKNMVIGAALILQENKPVEIVTSLRRWRITDHLESSGWEFMISSFSGTTWTTHCSGCVEAIYSSPPPPAVPETAFPRRTDAKKWYQAMWHLGARYGPCFQGLKNIECTPNKSSAKATICDKTPDGSESHYLIHPTTIDVFFQTMAAAACNGQGHATDRMSVPTFIKRMDIYESSGDLQVHTSAKVLAHGKFHGWGCAIGQDGALAISIDQIKLMPLDTALEIDLHAGASTTWSLEPSFTTMSSILKNATALAKQTPLMQEFALLHIRKALEQIQSIKPASDTMERYVNWMKRQSIPDTLRPMETVTSEVKTFSCPSTVDAIVKISENIIKLVLGEVSATELLMVDDMLLKIYQEAKVTDRGPYIKLLGHQKPNMRILEIGAGAGGTTHEFLSNLVNDSDGGKLWSSYTYTDISAGFFGAAKESFKEHTLEYKVLDITKDPVAQGFEGHDYDLIIATNVMHAVPNLQQALRNVHSLLRHDGTFYLEELCSDVQVTNFIMGLLPGWWVGEQDGRVDEPYVHPERWDGDLRAAGFTGVADCMLDAPRPHQGNAFMIAYPAIKDALPKPVTLLYDDASQQVVEDLKNELSQHGCFETVLQHWDSAESVVAKRNIICLLDINKPFFFDIEASRFDKFRHWMAQVAESKNGILWLTRSSQLSCEHPRWGQTPGAMRTIQKDMGIDLAICELDRLTSLSLKAVAQISERFSRRHTSSHKLELEYAIEDGNIYIPRLYPLNVDSELCKPDSSATTLPQTDNGELNLTLGTVGRLDTLQWTTCSYERPGENEVAIEIMATGLNFRDLLTAMDLIEAPRQVLGLEAAGMVRDVGSGVENLQPGDRVVVVGGTSLFRTAAVVPSTSCWKLPHSLSFEEAATMPCVFMTVIHGLLEFGQMHSGHTVLIHSACGGVGLAAIQLCHMAGATIYCTVSNEEKVQFLEDEFKIPRAHIFNSRNRSFVDDVMRATNGAGVDLVLNSLSGELLHASWECVAEFGKMIEIGKRDLLGNGRVSLHPFVLNRSFHGIDLAHLIERRPAECRRLLGRMMTLYEAGHIKPISPAKTFKVSEVEQCFRYMQQGRHIGKIILRVGDSADEATRSKDLITAHPKRNPTFNPQASYLLAGGLGGLGRIVANWMVENGARHLIFLSRNAGEKETDKAFFEELEYQGCKVMAVKGSVSVVKDVEKAIAAATAPVRGVMNICMQLQDMGFNQMTYEAWSTVNESKIKGTWNMHNVCMSREISLDFFLLFSSVSGLFGNFGQANYAAANTFLDTFVLYRHSLGLNASAIDIGMMYDHGYIAENPLLAERMQLLGAYGIRIPQLLDAITLVLSTPRSKPEKGTSRKCASLLGIGVRSGLPLSDPANRIMWKDDRRMAYYANLDSDSNAASGATSDVDKPTQAIRAFMKQVLAEPKILDQPDTSAFLARQIARKIALMLLRPLDDKEDSEVDILSPLQDAGLDSLVAIEMRRWWRTTFGFDITMLQMVGAENTMALGDRATEGLRIKYAEIEVQPVTSTPVVAVSA

SEQ ID NO: 23651 - protein, 344 aa, Sclerotinia sclerotiorum
ATTCTFSGSSGAASASKSKASCATIVLSALAVPSGTTLDLTGLTQGTKVIFEGITTFGYEEWSGPLVSVSGTDITVTQSGSAYLDGKGASYWDGEGSNGGKTKPKFFAAHNLISSTIENIYILNPPVQVFSIDNANGLTINNVTINASAGDTGSLGHNTDGFDIGDSTSVTITGANVYNQDDCVAINSGTGITFSGGVCSGGHGLSVGSVGGRDDNIVQTVNFENSEIKNSQNGVRIKTISGDTGTVSGVTYSGITLSGITDYGIIVNQAYNGNAGSPTNGVAISKFILDNVTGTVESGATNIYIECGSGSCTNWTWSGVSVTGGKTSTSCLNVPTSGGVSCSL

SEQ ID NO: 23652 - protein, 338 aa, Sclerotinia sclerotiorum
AGSCTFSGSSGAAAAIKSKASCATIVISAVAVPSGTTLDLTGLKSGTHVVFEGTTTFGYEEWSGPLVSVSGTDITVTGASGSVLDGNGAKYWDGKGTNGGKTKPKFFYAHSLKGKSSINNVKILNSPVQVFSINSASGLTLSGITIDNSAGNSLGHNTDAFDVGSSTDITISGANVQNQDDCLAINSGTGITFTGGTCSGGHGLSIGSVGGRSDNVVSDVIIESSTVKNSANGVRIKTVSGATGSVSGVTYKDITLSGITSYGVVIEQDYENGSPTGKPTSGVPITGVTLSNVHGTVSSSATNVYVLCAKCSGWTWDVNVTGGKTSTKCAGLPSGVKC

SEQ ID NO: 23653 - protein, 485 aa, Pseudomonas putida
MPDVRGALLIGGKARAASDGGTFERRHPVSGEVVSVVAAATLADADAAVEAAQAAFPAWAALGPGERRARLLKAADALDARRDEFLAMAGETGAKANWYGFNVMLAANILREAASMTTQIQGSVIPSDVPGSFAMALRQPCGVVLGIAPWNAPVILATRAIAMPLACGNTVVLKASEASPAVHGLIGQVLQAAGLGDGVVNVICNAPHDAPAVVERLIAHPAVRRVNFTGSTHVGRIVGQLAARHLKPAVLELGGKAPFLVLADADLEAAAVDAAAFGAYFNQGQICMSTERLIVDQAVADEFVAKLGEKVRRLRAADPSQPDAPLGSLIDAGAGERIQALVDDAVGKGATLVAGGERTGSVMQPVLLDHVNAGMRLYREESFGPVAVVLRASGDEALLALANDSEFGLSAAIFSRDTQRALALAQRLESGICHINGPTVHDEAQMPFGGVKASGYGSFGSTAAIDAFTQLRWVTVQHGARHYPI

SEQ ID NO: 23654 - protein, 482 aa, Pseudomonas fluorescens
MLDVPLLIGGQSRPARDGRTLERRNPVTGAVVSRVAAATLDDADAAVAAAQAAFPAWAALAPNERRSRLLKAAEQLQARSGEFIAAAGETGAMANWYGFNVRLAANMLREAASMTTQINGEVIPSDVPGSFAMALRQPCGVVLGIAPWNAPVILATRAIAMPLACGNTVVLKASELSPAVHRLIGQVLQDAGLGDGVVNVISNAPVDAAAIVERLIANPAVRRVNFTGSTHVGRIVGELAARHLKPALLELGGKAPLLVLDDADLDAAVAAAAFGAYFNQGQICMSTERLIVDAKVADAFVAKLAAKVATLRAGDPSAADSVLGSLVDVSAGTRIKALIDDALSKGARLVVGGQLDGSILQPTLLDGVTESMRLYREESFGPVAVLLRGSGDEELLRLANDSEFGLSAAIFSRDTGRALALAQRVESGICHINGPTVHDEAQMPFGGVKSSGYGSFGGKASIEHFTQLRWVTLQHGPRHYPI

SEQ ID NO: 23655 - protein, 482 aa, Escherichia coli
MSDVPLIAVVMAGGTGSRLWPLSREHYPKQFLQLSGENTLLQSTLLRLSPLSCETPLVITNEQHRFVVAEQLRQINQLSDNIILEPCGRNTAPAIALSAFTALKRNEQQDPILLVLAADHVINKTDVFCNAIKNSISIVEQGNILTFGIIPDYAETGYGYIEKGSIVKESQRGVGNTFYHVEQFVEKPNRSRAEEYISSGKYLWNSGMFMFKASVYLEELKKYRPDIYDICEKTVSSSYHDLDFIRLSKDVFQNCPSESIDFAVMEKTKRCIVYPVDIGWNDVGSWQSLWDVSDKTPTGDVCKGDILTYNTKNNYIHSESALVAAVGVEDIVIVQTKDAILVSKKSEVQDVKKIVQMLKMQERSEYLSHREEFRPWGKFDAIEQGDRYKVKKIVVKPGEGLSLRMHHHRSEHWIVLSGTAKVTLNNKTFLVTANESVYIPLGATYSLENPGVIPLNLIEVSSGDYLGEDDIVRQKERYKIDD

SEQ ID NO: 23656 - protein, 340 aa, Geobacillus sp. M10EXG
MKAAVVEQFKEPLKIKEVEKPSISYGEVLVRIKACGVCHTDLHAAHGDWPVKPKLPLIPGHEGVGIVEEVGPGVTHLKVGDRVGIPWLYSACGHCEYCLSGQEALCEHQQNAGYSVDGGYAEYCRAAPDYVVKIPDNLSFEEAAPIFCAGVTTYKALKVTGTKPGEWVAIYGIGGLGHVAVQYAKAMGLHVVAVDIGDEKLELAKELGADLVVNPAKENAAQFMKEKVGGVHAAVVTAVSKPAFQSAYNSIRRGGTCVLVGLPPEEMPIPIFDTVLNGIKIIGSIVGTRKDLQEALQFAAEGKVKTIIEVQPLEKINEVFDRMLKGEINGRVVLTLENNN

SEQ ID NO: 23657 - protein, 150 aa, Aspergillus fumigatus
  misc_feature (37)..(37): Xaa can be any naturally occurring amino acid
ACGLLTVVLSAANSNVYSGSRILIGLAQEGFAPRLFXRTSKKGVPYYSVAFTSAFGLLGFMNVSNAGSTVFNWFLNISGVAGFITWASLNACHIAFMRALKARNISRDLLPYKALWQPWYAYYGLFFNVLIILTQGFTAWIPTFSVTVVG

SEQ ID NO: 23658 - protein, 396 aa, Neurospora crassa
MKGALLTAAMLLGSAQAGVHTMKLKKVPLAEQLESVPIDVQVQHLGQKYTGLRTESHTQAMFKATDAQVSGNHPVPITNFMNAQYFSEITIGTPPQTFKVVLDTGSSNLWVPSSQCGSIACYLHNKYESSESSTYKKNGTSFKIEYGSGSLSGFVSQDRMTIGDITINDQLFAEATSEPGLAFAFGRFDGILGLGYDRIAVNGITPPFYKMVEQKLVDEPVFSFYLADQDGESEVVFGGVNKDRYTGKITTIPLRRKAYWEVDFDAIGYGKDFAELEGHGVILDTGTSLIALPSQLAEMLNAQIGAKKSWNGQFTIDCGKKSSLEDVTFTLAGYNFTLGPEDYILEASGSCLSTFMGMDMPAPVGPLAILGDAFLRKYYSIYDLGADTVGIATAKR

SEQ ID NO: 23659 - protein, 263 aa, Streptococcus suis
MQVAYLGPRGSFTHQVAQQVFPTADLQAFETITEVIKAYETGEVTYSVIPVENSIEGSVHETIDYLFHQAEIHAVAEIVQPIAQQLLATSADKAVEVIYSHPQAIAQGKKYIQEHFPQARIEITVSTAYAARFVAEHPEQPFAAIAPQAAAVEYGLEVIAQDIQEISENFTRFWILGDKAPSIALEQVAKKVSLALTLPDNLPGALYKAMSVFSWRGISLTKIESRPLKPALGEYFFILDLDNQCVELLTYSPKEFTSSRYNL

SEQ ID NO: 23660 - protein, 438 aa, Cryphonectria parasitica
MPISKIHARYVYDSRGNPTVEVDLVTETGLHRAIVPSGASTGQHEACELRDGDKSKWLGKGVLKAVENVNTVLGPELIKAGLDVKDQTAVDEFLIKLDGTANKTKLGANAILGVSLAVAKAGAAEKGVPLYAHVSDLAGTKKPYVLPVPFQNVLNGGSHAGGRLAFQEFMIVPSAAPSFSEGLRWGAETYHQLKSLAKKKYGQSAGNVGDEGGVAPDIQTAEEALELISEAIEKAGYTGKMKIAMDVASSEFYKEDVKKYDLDFKNPDSDPSNWLTYEQLAALYADLTKKYPIVSIEDPFAEDDWEAWSYFYKTQDIQLVADDLTVTNPIRIKKAIELKAANALLLKVNQIGTLTESIQAAKDSYADGWGVMVSHRSGETEDVTIADIVVGIRAGQIKTGAPARSERLAKLNQILRIEEELGSNAIYAGEDFRKSVTL

SEQ ID NO: 23661 - protein, 2633 aa, Gibberella moniliformis
  misc_feature (1840)..(1846): Xaa can be any naturally occurring amino acid
MARAVEKVVTKAVIRSVAISRLMRRAKIHEINHSRTILTTARVIHEVRPNRMKNKSIMSMLLSLIKTFALRAHFLKGEIAAFDAPFFSITPAEAGGMDPQQRGLLENTYRALENAGCPMNKVLGTNTGVFIGCFTREYEAIMFKETEIQQRYFATGTGTTMLANRLSYFYDLHGPSISLDTACSSSLNACHLACNSLRLGECDMALAAGYNLFYNPDTIIPLTALGFLSPDGRCYSFDERANRYSRGEGFGMVVLKRLSDAIRDGDCIRAIVRGSSSNQDGNSPGITQPTRQAQVDLINAAYRSAGLSKTQTRFFEAHGTGTPVGDPIEASAISGAFLEYCSEQEPMVVGAVKTNIGHLEGSAGIAGLIKAIMVLEKGIIPPNMGFQTPNPKIPVHDWHLKFLTKPEAWPTKGLRRASINAFGYGGSNAHIIIDDAYHYLLVNTSSINGTNGINGHSNGINGHINGHHSASSSSDDEYILVKRFKGHAPPSRLFFFSTFDEAGAARMAKAYKEFLAPTSKSIVAGSEEEQRFLSDLSYTLINHRTSFPWRFSIVADSIAALADKLEANLSPVRTTAEPKLGFVFTGQGAQWYAMGREFLSAYPTFSTSIFAADLYLRELGCPWSLVGELLSNQDKSRIDDPALSQPICTALQVALVDLLASWGNKPAAVVGHSSGEIGAAYATGAISQESAWRLAFYRGALSSRLAKSPDYTNGAMLSVAMSSPDAMAYLEEHVGSAAGRDIVVACINSPRNVTLSGSAAYIDKIKAAADHEGIFARKLKVDNGYHSPLMATIADEYRSAIGDLKAGTNISPVQGAPVFYSSLGGTVSSVSALQNPDHWVDNLVSPVQFSKAFSLMCSNTTSSAPVKKLGSSAKATVKPPKITYVLEIGPHAALRGPIRETMELTPEVSGIGYESVLCRGASAVDTALSAANWLWCRGYEVDMSDASIAKDSSLVVNAPGYPFNHSNIYWNESRISKGYRFCPAMRHELFGAPVPDWDPANAVWRNYMRLSENPWVKHHRITGATIYPVAGMLVMAIEASRQMADITRVVKGFRILDARFNVALRVPATQNGLETHFYMQPSRDYSDTVARTVRKFSLSSYEGGEWREHCHGLVVTEYEQPYTVNRLADVEKASKVETSFRQLYEHLSTVGLDFGATFQTLRDIRCSDIGEAVATVERQDLESLMPLGYLQDHLIHSTVLDGILQSIIVSLTKGGREIDQVMVPSEIGDLWVSADPSTSKFDAVRVSCSGKFLGIRQAEARIVGMDVDTGKAVCTVDNFVITTVARSEGASSSDAARRLCFNLDYKVDPVLLDQETADKTLQPDAKCGATPQQAQLIQEVEMMCFLYIKRFWDRIYDENRDAKSVPYHKKYIAWIKYQLEKYDAGLIPHAMPEWRERAADVLIISQMETKLLTEGSAEGKLVVNVGRELPDILAGKSDALELLFKDKLVENVYRSGVGAEIGYDRMVAYIDALAHKNPALRVLEVGAGTGGATRPILKCLTTQGNGEIGTPRFSHYAFTDISIGFFENAREMFKDSAARMSFRALNIEDDLEQQGFSGPAEQYDVICAANVIHATKNLEATLSNARKLLKPGGKLILYEMTNTGMIRTGFAFGLLPGWWLSVEDFRQFTPLAAPSDWSRSLKASGFSGIDLHIYDFPDHRHQMVSVLICTALGNGSEENAPATSYSSSPIKIITCGVGSTSATQKSLATVLEKQATSLSTSIDVVNLHDAVADLKDLQQTRGIFLGDIKSDFLEHVQDDDYEAFRKLISSTKTLLWVNQGGGPSPKNPGADMVTGFARCMRAENPGLNFVTLSVDDLDSLDKTSSIILQILSSGGGNENXXXXXXXLSSGGGNENTFFEKDGAVYIPRITEANTVNHLIAAKTKGESARSETWQDASKDRALTLQCAVPGLLDSLQFQDDELYEKPLGPYDVEVRVHATGLNLLDVMIALGKVIGEAFGQECAGVVTRVGTDVDRVSVGDRVCGLLRGTFKTFARGSQWQFAKIPSSIDYAVAAAVPVVYTTAYYGLHDLARLQAGESILIHWGAGGVGQAAIQLAKAVGAEVFVTVGSIEKRDFLHEHYGIPLHHVLSSRDLSFVHGIKRLTDGRGVDVILNSTAGQTLRASWDCIAPYGRFIEIGKVDIFANAGLPMGPFKKSVTFSFFDIGLISLERGRLFSRVLQDVVDLLAKGSITPPQPLHVYSYSDIQEAFRIMQSGSHMGKLVLKAQDDDLVMVEPSRKPTYHFDPEASYLLSGGLGGLGRSAARWMASRGARNLILLSRSGTTRPAAQELMEELTDAGVTAAAPQCDVSDRAVLERVLSDCAKAMPPIKGCIQGSMVLKDSIFSNMSQEDYYTAVRPKVVASRNLHELLPQNLDFFILLSSASGVVGNRGQSNYCVGNTYQDSLARHRVALGLPGVAVDLGMILSVGFAAENQESMANLRQEGFNAMREDEFLALLDMLCDPNGKYSTNVNQQTQASSFAQIAVGLEAPATLRIKGIPEPAWMTDPLFKHLYQIRGEGDHEGEGDGEGSATSCSTLLPAAASLADAANIVSAAIVQKLCKALSSSERDIDVSKPLHSYGVDSLVAVELRAWFMKEVGSDVAVFDIMSGQSLEELAELAAKRSSFANFDDEKETE

SEQ ID NO: 23662 - protein, 243 aa, Mycobacterium fortuitum
MNTQPNVFTDVFSEAKLGPVTLRNRIIKAATFEASTPNALVTEDLINYHRLPAAGGVGMTTVAYCAVSPGGRTDGWQIWMRPEAVPGLTKLTEAIHAEGAAISAQIGHAGPVANSRTNKAKALAPVRFFNPLSMRFAKKASIDDIRDVTEAHANAARLAIDSGFDAVEVHLGHNYLASSFLSPLINRRTDEFGGSLENRAKVARGVVRAVRDAVDKHGDRKIAVIAKLNMSDGIRGGIPIDES

SEQ ID NO: 23663 - protein, 505 aa, Solanum melongena
MDVPCPWYSLLIPLFVFIFLLIHHCFFTTSKKQNMLLLPSPRKLPIIGNLHQLGSLPHRSLHKLSQKYGPVMLLHFGSKPVIVASSVDAARDIMKTHDVVWASRPKSSIVDRLSYGSKDVGFSPFGEYWRRAKSITVLHLLSNTRVQSYRNVRAEETANMIGKIRQGCDSSVINLGEHLCSLTNNIISRVALGRTYDEKESGIEHIIEQFVELLGIFNVGDYIPRLEWVNKFTGLDAKVKKVAKELDMFLEIVIEEHIIRKKKEEYTSTGEAKDFVDVLLEIQNGNETDFPLQRDSLKAILLDSFAAGTDTTFATLDWTMAELLRQPRALKTLQDEVRGLAQGKSEITEDDLKNMQYLRAVIKESLRLHPTQESLLVPRESMEDVNLLGYYHIPARTQAIINAWAIGRDPLSWENPEEYQPERFLNSDADVKGLNFKLLPFGAGRRGCPGSSFAIAVIELALARLVHKFDFALPEGIKPEDLDMTETIGITTRRKLPLLVVATPC

SEQ ID NO: 23664 - protein, 157 aa, Musa acuminata
MAGESCNLDKDEAEIFKPSPSSSPSPSPPSPPSSSQPPPPSSVLLKPSEESGIQRPEIPESPPAPTITFAASSTPKLDEEPSNPGEESPAPVRFSNRCSACRKKVGLTGFRCRCGDLFCGRHRYSDAHECSFDYKAAGREEIAKANPVIKAAKIIKI

SEQ ID NO: 23665 - protein, 503 aa, Gossypium hirsutum
MAVQVPSRQLFIDGEWREPILKERLPTINPATEEIIGNIPAATAEDVELAVAAARRALSRNKGKDWATAPGAVRAKYLRAIAAKVTERKTELAKLEAIDCGKPLDEAVWDIEDVAGCFEYYADLAEGLDARQKAPVSLPMETFKSYVLKEPIGVVGLITPWNYPLLMATWKVAPSLAAGCAAILKPSELASITCLELAKVVKGSRLPPGVLNILAGLGPEAGAPLASHPDVDKIAFTGSSATGSKIMAAAAQMVKPVSLELGGKSPIIVFEDVDLDKAAEWTAFGCFWTNGQICSATSRLIVHENIAREFLDRLVKWTKNIKISDPFEEGCRLGPVVSGGQYEKVLKFISTAKSEGATILSGGVRPEHLKKGFFVEPTIITDVTTSMQIWREEVFGPVLCVKTFRTEEEALELANDTHYGLGAAVISNDLERCDRVSKNLQAGIVWVNCSQPCFCQAPWGGNKRSGFGRELGEWGLDNYLSVKQVTQYVSDEPWGWYRSPSKL

SEQ ID NO: 23666 - protein, 379 aa, Neurospora crassa
MAATAAESRLFQPLKLTPKITLGHRLAMAPLTRFRSDDEHVPIVPLMTTYYSQRASVPGTLLVTEATFISPAAGGYDNVPGIYNAAQIAAWKKITDAVHAKGSFIFCQLWSLGRAANPEVLAKEGGLKLKSSSAVPMEEGAPVPEEMTVAEIKERVAEYAAAAKNAVEAGFDGVEIHGANGYLIDQFLQDTCNQRTDEYGGSIENRSRFAHEVVKAVVEAVGAEKTGIRLSPYSTFQGMKMKKDLIPQFEDVIRKINGFGLAYLHLTQSRVAGNMDVQPEEDEENLAFAAKLWDGPLLIAGGLTPETAKHLVDREFPEKDVVATFGRHFISTPDLPFRIKEGIELNPYDRDTFYKAKSPDGYIDQPFSKEFEKVYGAQA

SEQ ID NO: 23667 - protein, 449 aa, Neurospora crassa
MSDTKQAVAFIGLGAMGFGMATHLIKQGYPVTGFDVWPPTLEKFTSAGGLTASTPASAVADKALCVCMVATAQQAQSVLIDGPDAAAPALPQGAVLLLCSTVPCDYVQSLAKQLSAIGRPDIHLIDCPVSGGAARAADGTLSIMAGVPSEKALGKSKPLLEELADPAKLYIVQGGIGAGSNMKMVHQVLAAVQILAASEAMGLATHLGLDLARTNEAVLKSDAWNWMFEHRTPRMLTGYQPIASATVIIVKDTSIITAEARRSGFPTLMTSVAEQVYFSAVGRGYGADDDSGLVRLYAEGKGKVGPVQGTAASGEEKLAMVIGLLKGILLCSAAEALAFADKVGLDLDQVFDLCINAAGGSQMLKKYGPSIIKAFREGTARQGWAAAESETSLKEIADGLSAAVEEAQRLKAPVFLGSQALNVVRVALQSSPDGVAAGAVVKVWNSTSG

SEQ ID NO: 23668 - protein, 300 aa, Neurospora crassa
MSSASPSRERRRLVGVSTKMYFSHARTTNFITSFLDLMQHHTSTKTEQSNDNRNNLAAALASKIDIFIIPDHLSLQSAINRTANHPSQSGPTDPKILFGAQNCHWEDSGPFTGEVSPAVLAEVGCSIVELNHAERRRHFAETDAITCLKAQAVIRNGMIPLICVGEGSPGQIPALSEVAIMKAAAEVVDQVELCLEGVDPTKEVWLAYEPVWAIGAKEPAGVEHVRGVVRTIRKSEVVRGREERGGVTRILYGGSAGPGLFGQLKEVDGVDGLFLGRFAHEEGQFWKTICEVAEVEWEGR

SEQ ID NO: 23669 - protein, 1108 aa, Neurospora crassa
MSSDETPQTIPIPGPPGLPLVGNSFDIDTEFPLGSMLNFADQYGEIFRLNFPGRNTVFVTSQALVHELCDEKRFQKTVNSALHEIRHGIHDGLFTARNDEPNWGIAHRILMPAFGPMAIQNMFPEMHEIASQLALKWARHGPNQSIKVTDDFTRLTLDTIALCSMDYRFNSYYHDDMHPFIDAMASFLVESGNRSRRPALPAFMYSKVDRKFYDDIRVLRETAEGVLKSRKEHPSERKDLLTAMLDGVDPKTGGKLSDDSIIDNLITFLIAGHETTSGLLSFAFVQLLKNPETYRKAQKEVDDVCGKGPIKLEHMNKLHYIAAVLRETLRLCPTIPVIGVESKEDTVIGGKYEVSKGQPFALLFAKSHVDPAVYGDTANDFDPERMLDENFERLNKEFPDCWKPFGNGMRACIGRPFAWQEALLVMAVCLQNFNFMPEDPNYTLQYKQTLTTKPKGFYMRAMLRDGMSALDLERRLKGELVAPKPTAQGPVSGQPKKSGEGKPISIYYGSNTGTCETFAQRLASDAEAHGFTATIIDSLDAANQNLPKDRPVVFITASYEGQPPDNAALFVGWLESLTGNELEGVQYAVFGCGHHDWAQTFHRIPKLVDNTVSERGGDRICSLGLADAGKGEMFTEFEQWEDEVFWPAMEEKYEVSRKEDDNEALLQSGLTVNFSKPRSSTLRQDVQEAVVVDAKTITAPGAPPKRHIEVQLSSDSGAYRSGDYLAVLPINPKETVNRVMRRFQLAWDTNITIEASRQTTILPTGVPMPVHDVLGAYVELSQPATKKNILALAEAADNAETKATLRQLAGPEYTEKITSRRVSILDLLEQFPSIPLPFSSFLSLLPPMRVRQYSISSSPLWNPSHVTLTYSLLESPSLSNPDKKHVGVATSYLASLEAGDKLNVSIRPSHKAFHLPVDADKTPLIMIAAGSGLAPFRGFVQERAAQIAAGRSLAPAMLFYGCRHPEQDDLYRDEFDKWESIGAVSVRRAFSRCPESQETKGCKYVGDRLWEDREEVTGLWDRGAKVYVCGSREVGESVKKVVVRIALERQKMIVEAREKGELDSLPEGIVEGLKLKGLTVEDVEVSEERALKWFEGIRNERYATDVFD

SEQ ID NO: 23670 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPAGNGQRACIGQQFALHEATLVLGMMLKHFDFEDHTNYELDIKETLTLKPEGFVVKAKSKKIPL

SEQ ID NO: 23671 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPWGNGQRACIGQQFALHEATLVLGMMLKHFDFEDHTNYELDIKETLTLKPEGFVVKAKSKKIPL

SEQ ID NO: 23672 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPYGNGQRACIGQQFALHEATLVLGMMLKHFDFEDHTNYELDIKETLTLKPEGFVVKAKSKKIPL

SEQ ID NO: 23673 - protein, 155 aa, Saccharomyces cerevisiae
GASIVSLLGIKVLNNPAKFTDPYEFEITFECLESLKHDLEWKLTYVGSSRSLDHDQELDSILVGPVPVGVNKFVFSADPPSAELIPASELVSVTVILLSCSYDGREFVRVGYYVNNEYDEEELRENPPAKVQVDHIVRNILAEKPRVTRFNIVWD

SEQ ID NO: 23674 - protein, 174 aa, Vibrio cholerae
  misc_feature (1)..(1): Xaa can be any naturally occurring amino acid
  misc_feature (4)..(4): Xaa can be any naturally occurring amino acid
  misc_feature (77)..(77): Xaa can be any naturally occurring amino acid
  misc_feature (105)..(105): Xaa can be any naturally occurring amino acid
  misc_feature (108)..(108): Xaa can be any naturally occurring amino acid
  misc_feature (136)..(136): Xaa can be any naturally occurring amino acid
  misc_feature (156)..(156): Xaa can be any naturally occurring amino acid
XSLXRDITPDLCDKYESQVTLLNLPLQNFGQRSAFWGEIVTVRCYHDNSKVRDVLSQNGKGKVLVVDGHGSCHKALXGDQLAILAIKNDWEGVIIYGAVRDVVAXSEXDLGIKALGTSPFKTEKRGAGQVNVTLTXQNQIVEPGDYLYADWNGILXSETALDVAEGGSHHHHHH

SEQ ID NO: 23675 - protein, 263 aa, Poa pratensis
MASSSSVLLVVALFAVFLGTAHGIAKVPPGPNITATYGDKWLDAKSTWYGKPTGAGPKDNGGACGYKDVDKAPFSGMTGCGNTPIFKSGRGCGSCFEIKCTKPESCSGEPVLVHITDDNEEPIAAYHFDLSGKAFGAMAKKGEEQKLRSAGELELKFRRVKCEYPEGTKVTFHVEKGSNPNYLALLVKYVTGDGDVVAVDIKEKGKDKWIELKESWGSIWRVDTPDKLTGPFTVRYTTEGGTKGEAEDVIPEGWKADTAYASK

SEQ ID NO: 23676 - protein, 175 aa, Secale cereale
  misc_feature (168)..(168): Xaa can be any naturally occurring amino acid
MAPAVMASSATTVAPFQGLKSTAGLPVGRRSGSAGLSSVSNGGRIRCMQVWPIEGIKKFETLSYLPPLSTEALLKQVDYLIRSKWVPCLEFSKVGFVFREHNNSPGYYDGRYWTMWKLPMFGCTDATQVLNEVEEVKKEYPDAYVRVIGFDNMRQVQCVSFIAFRPPXCEESGKA

SEQ ID NO: 23677 - protein, 175 aa, Secale cereale
MAPTVMASSATSVAPFQGLKSTAGLPVSRRSNGASLGSVSNGGRIRCMQVWPIEGIKKFETLSYLPPLTTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 23678 - protein, 312 aa, Clostridium beijerinckii
MNNNVFCIGELLIDMVCVDNKGLKNGEKFEKKAGGAPANVAASICKLEGNAYFLGQVGNDFFGKHLVELLKSLNINTDMTVERGSTTIALVGIDANGERNFDFLRGSDGEYSFDNIDLSKISNSDIIHFGSATGFLDGELKKTYFKLLEYAKSNNIYVSFDPNYRDALITQDKLELFVEDCVKFLRYSNFTKLSDEELYLITKEKDIESAVNKLHEIGVKVVTVTLGSKGTYLSVNGKNEIIPSIEIKQVDSTGAGDAFVGAVLRQVSDIDDKESISFDRWKEIVSFANKVGAITCTNYGAIASMPTLNELN

SEQ ID NO: 23679 - protein, 503 aa, Oryza sativa
MEGAGSDGNPLGGYRIGKTLGIGSFGKVKIAEHILTGHKVAIKILNRRKSMEMEEKVKREIKILRLFMHPHIIRLYEVIDTPADIYVVMEYVKSGELFDYDVEKGRLQEEEARRFFQQIISGVEYCHRNMVVRRDLKPENLLLDSKCNVKIADFGLSNVMRDGHFLKTSCGSPNYAAPEVISGKLYAGPEVDVWSCGVILYALLCGTLPFDDENIPNLFKNIKGGIYTLPSHLSPLGRDLIPRMLVVDPMKRITIREIREHQWFTVGLPRYLAVPPPDTAQQVKKLDDETQNDVINMGFDKNQLIESLHKRLQNEATVAYYLLLDNRLRTTSGYLGAEFHESMVSSLAQVTPAETPNSATDHRQHGHMESPGFGLRHHFAADRKWALGLQSRAHPREIITEVLKALQELNVCWKKIGHHNMKCRWSPSFPSHESMMHNNHGFGAASAMIETDDSEKSTHTVKFEIQLYKTRDEKYFLDLQRLSGPQLLFLDLCSAFLTQLRVL

SEQ ID NO: 23680 - protein, 386 aa, Candida albicans
MDIVLEICDYYLFDKVYADVFPKDGAVHEFLKPAIQSFSQIDFPSLPNLDSFDTNSTLISSNNFNISNVNPATIPSYLFSKIASYQDKSEIYGLAPKFFPATDFINTSFLARSNIFRETLSLFIITTIFGWLLYFIVAYLSYVFVFDKKIFNHPRYLKNQMSLEIKRATTAIPVMVLLTIPFFLLELNGYSFLYLDINECTGGYKAILWQIPKFILFTDCGIYFLHRWLHWPSVYKVLHKPHHKWIVCTPFASHAFHPVDGFFQSLPYHLYPLLFPLHKVLYLFLFTFVNFWTVMIHDGSYWSNDPVVNGTACHTVHHLYFNYNYGQFTTLWDRLGNSYRRPDDSLFVKDVKAEEEKKIWKEQTRKMEEIRGEVEGKVDDREYVEQ

SEQ ID NO: 23681 - protein, 400 aa, Saccharomyces pastorianus
MSFVKDFKPQALGDTNLFKPIKIGNNELLHRAVIPPLTRMRALHPGNIPNRDWAVEYYTQRAQRPGTMIITEGAFISPQAGGYDNAPGVWSEEQMVEWTKIFNAIHEKKSFVWVQLWVLGWAAFPDNLARDGLRYDSASDNVFMDAEQEAKAKKANNPQHSLTKDEIKQYIKEYVQAAKNSIAAGADGVEIHSANGYLLNQFLDPHSNTRTDEYGGSIENRARFTLEVVDALVEAIGHEKVGLRLSPYGVFNSMSGGAETGIVAQYAYVAGELEKRAKAGKRLAFVHLVEPRVTNPFLTEGEGEYEGGSNDFVYSIWKGPVIRAGNFALHPEVVREEVKDKRTLIGYGRFFISNPDLVDRLEKGLPLNKYDRDTFYQMSAHGYIDYPTYEEALKLGWDKK

SEQ ID NO: 23682 - protein, 401 aa, Apodachlya brachynema
  misc_feature (180)..(180): Xaa can be any naturally occurring amino acid
SGNPSVEVDLVTEDGLFRAAVPSGASTGEFEALELRDGGKDYMGKGVKTAVHNVNDIIAPALIGKDQNKQTELDTFMVETLDGTKNEWGWCKKKLGANSILAVSLALCKAGAAAEKVPLWQHIANLAGNPTPCLPVPSFNIINGGSHAGNKLAMQEFMILPVGATSFTESMQIGCEVYHXLKKVINKRYGLDATAVGDEGGFAPNIQVNGEALDLIQEAIALAGYTDKVKIGMDVAASEFYTGKEDARYNLDFKNENAQDSDKISADELIDVYQSFITKCKDKSPIVSIEDPFDQDDWESWMKLTAAVGEDIQIVGDDLTVTNPTRVQKAIDQKACNALLLKVNQIGSVTESIQAVTMSKRAGWAIMASHRSGETEDSFIADLAVGLSAGQIKTGAPCRER

SEQ ID NO: 23683 - protein, 388 aa, Apodachlya brachynema
  misc_feature (161)..(161): Xaa can be any naturally occurring amino acid
SGNPTVEVDLITQDGLFRASVPSGASTGIHEAVELRDGGSRFLGKGVLKAVNNVNDIIGPKLEGMDPRKQKDIDHLMIQLDGTDNKGRLGANAILGVSLAVAKAGAKSKGVPLFQHFADMIKNDKLILPVPAFNVINGGSHAGNKLAFQEFMIMPVGASSXSEAMVMGCEVYHHLKGVIKKKYGQDATNVGDEGGFAPNIQSNREGVELLMSAIEKAGYNGQVKIAMDVASSEFYTDAGHYDLNFKNKGSNEKPLTGEELGALYQQLSNEFPIISIEDPFDQDDWSHYKSFTNAIGEKVQVVGDDLLCTNPKRIATAVDTFACNALLLKVNQIGSVTESVQAVADAKKAGWGVMTSHRSGETEDSYIADLAVGLSTGQIKTGAPCRER

SEQ ID NO: 23684 - protein, 389 aa, Heterosigma akashiwo
SGNPTVEVDIFTDNGMFRASVPSGASTGIYEACELRDGGDRYMGKGVLQAVNNVDTLIKDALIGKDPTQQREIDQIMLDLDGTKNKTKLGANAILGVSLAVSKAGAAAKGVPLYQHYADLAGNTQLVLPVPSFNVINGGSHAGNKLAFQEFMVLPTGAATFSEAMQIGCEMYHTLKKVIKERYGQDATNVGDEGGFAPNIQSNREGVELLMEARSRCGHGDKIVFGMDVAASEFWTEDKEYDLDFKTKDNDGSQKITGAELAQMYKDLAAEFPIVSIEDPFDQDDWEAYTAMTADMGTDCQVVGDDLLVTNPERIQMASEKSACNAPLLKVNQIGSVTEAIDAVKMAKQNGWGVMTSHRSGETEDCYIADLAVGLCTGQIKTGAPCRER

SEQ ID NO: 23685 - protein, 374 aa, Isochrysis galbana
STGIYEALELRDGDKDKYMGKGVQKAVDNVNNIISPALEGMSPIDQKAIDDKMVRELDGSKNEWGWSKAKLGANAILAVSMAVCKAGAGAKGIPLYKHIANLSGNPVDKMYMPVPAFNIINGGSHAGNKLAMQEFMILPVGATSFKEAMQMGSEVYHNLKKVIAAKYGQDACNVGDEGGFAPNILDNKEGLDLVVTAIEKAGYTGKVKIGMDVAASEFWKGEEKVYDLDFKTENNDGSQKLSGEKLAELYESFVNDYPMISIEDPFDQDDFASYTATTAKLGEKCQIVGDDLLVTNPTRVLKAIDEKACNALLLKVNQIGSITEAIDAVTMAQKAGWGVMTSHRSGETEDSFIADLAVGLKTGQIKTGAPCRER

SEQ ID NO: 23686 - protein, 124 aa, Pavlova lutheri
ASTGIYEALEMRDGDKSMYMGKGVSKAVHNVNTIIGPALVGMDPVQQKEIDDKMVKTLDGSKNDWGWSKSKLGANAILGVSMAVCKAGAASKGIPLYKHIAELAGNPTDKMYMPVPSFNVINGG

SEQ ID NO: 23687 - protein, 387 aa, Phaeodactylum tricornutum
SGNPTVEVEVTTADGVFRASVPSGASTGAYEAVELRDGGDRYMGKGVLQAVQNVNDILGPAVMGMDPVGQGSVDDVMLELDGTPNKANLGANAILGVSLAVAKAGAAAKKVPLYRHFADLAGNNLDTYTMPVPCFNVINGGSHAGNKLAFQEYFVIPTGAKSFAEAMQIGCEVYHTLGKIIKAKFGGDATLIGDEGGFAPPCDNREGCELIMEAISKAGYDGKCKIGLDVAASEFKVKGEDEYDLDFKYDGDIVSGEELGNLYQSLAADFPIVTIEDPFDEDDWENWSKFTTKNGATFQVVGDDLTVTNIEKIERAIDEKACTCLLLKVNQIGSISESIAAVTKAKKAGWGVMTSHRSGETEDTYIADLAVGLCTGQIKTGAPCRER

SEQ ID NO: 23688 - protein, 401 aa, Phytophthora palmivora
SGNPTVEVDLVTELGEYRAAVPSGASTGEFEALEMRDGGKAYMGKGVLNAVKNVNEIIAPALVGKDVTQQAELDRFMVETLDGTQNEWGWCKKKLGANAILGVSLALCRGGAAAKKQPLWQYIADLAGNPTPCLPVPSFNIINGGSHAGNKLAMQEFMILPVGATSFTEAMQIGSEVYHNLKKVIKGRYGLDATAVGDEGGFAPNIQSNGEAIDLIEEAIKAAGYTNQVRLGMDVAASEFYTGAADARYNLDFKNENAPDSEKIPADKLQEVYEGFIAKCAGSSKIVSIEDPFDQDDWESWIKFTGKVGKDVQIVGDDLTVTNPTRVKKAIEQKACNALLLKVNQIGSITESIEAVTMAKKAGWAIMASHRSGETEDTFIADLAVGLSAGQIKTGAPCRER

SEQ ID NO: 23689 - protein, 437 aa, Prymnesium parvum
SGNPTVEVDLITAKGQTYRAAVPSGASTGIYEALEMRDGDKSMYMGKGVSKAVHNVNTIIGPALVGMDPVQQKEIDDKMVKTLDGSKNDWGWSKSKLGANAILGVSMAVCKAGAASKGIPLYKHIAELAGNPTDKMYMPVPSFNVINGGSHAGNKLAMQEFMILPVGATDFTEAMRMGSEVYHNLKSVIKAKYGQDACNVGDEGGFAPNILENKEGLDLLVTSIEKAGYTGKVKIGMDVAASEFWLADKKMYDLDFKTENNDGSQCKSGDDLMKIYEEFVKDYPMVSIEDPFDQDDFASYKAMTELLGERCQIVGDDLLVTNPTRVQKAIDEKVRPNNACCPDAVLSMCTSVQRNFCAGCPLVHDAVALQACNALLLKVNQIGSVSESIEAVNMAKAAGWGVMTSHRSGETEDSFIADLAVGLKTGQIKTGAPCRER

SEQ ID NO: 23690 - protein, 388 aa, Thraustotheca clavata
SGNPTVEVDLTTEHGLFRASVPSGASTGIHEACELRDGGKRYLGKGVTQAVNNVKNIIGPKIEGMDPTQQKDIDFLMRELDGTENKGNLGANAILGVSLAVAKAGARSKGVPLFQHFADLIKNDKLVLPVPAFNVINGGSHAGNALAFQEFMILPTGAGSFSEAMAMGCEVYHHLKGVIKKKYGQDATNVGDEGGFAPNIQSNREGVELLMLAIEKAGYSGKIEIGMDVASSEFYTDDGRYDLNFKNKSSTDAPLTGAQLGQLYKDLAKEFPIVSIEDPFDQDDWENYQAFTAAVGKDVQVVGDDLLCTNPKRIAKAVELSACNALLLKVNQIGTLTESVQAVSDAKKAGWGVMTSHRSGETEDSYIADLAVGLSTGQIKTGAPCRER

SEQ ID NO: 23691 - protein, 434 aa, Heterocapsa triquetra
MAISKIHARQVFDSRGNPTVEVELTTEKGVFRSIVPSGASTGENEACELRDGGKEFHGKGVRDAVENVKTIIAPALIGKDVCDQEGIDKIMLELDGTENKSKLGANAILGVSMAVCRAGAAAKGVPLYQHINSLAGSPKMVMPVPCFNVINGGVHAGNYLAFQEFFLIPVGAATFEEAMQMGSETYHTLKGIIKTKYGLDSTAVGDEGGFAPAVQDPEESLKLLMEAIGAAGYDGKIVIGSDPASSEFWKGEENVYDLDFKNPNPKKENKRSREEMVATYVRYCETYPIALLEDPFAEEDFEGHAMLTQKVGSKVEIVGDDLYCTNSKRVAMGLEKKATNAMLLKVNQIGSVTESIAAWKLCVDNKWGVFVSHRSGETEDTFIADLTVGLGTGHLKTGAPCRSERLAKYNQLLRIEEESGLKFCGKAFRTPWDA

SEQ ID NO: 23692 - protein, 1511 aa, Trichophyton rubrum
MDDRYEHEHDDYESGAMYETVRTWSPQSRPELVRIASVFSRIDSHPDVAPTTEDGGQLNRRDTLAGVKIGDPVLDPTKPEFDFYKWARMFTHVMEKEGIKRNRTGVMFRNLTVLGSGSAVQYQDTFLSPFAAPFRPGELCGKGRNPEKVILHDFNGAIREGELLMVLGRPGSGCSTFLKAICGELHGLQKKKESIIHYNGVSQHTFKKELRGEAVYSAEDEHHFPHLTVGQTLEFAAAARTPSKRVLGLSRKDFSTHLARVMMSVFGLSHTYNTKVGDDYVRGVSGGERKRVSIAEIALSGAPICCWDNSTRGLDSATALEFTKALKIGSQVGGITQCLAIYQASQAIYDIFDKVIVLYEGRQIFFGPTRIAKQYFEEMGWYCPPRQTTADFLTSVTNPKERIAKEGYENRVPRTAVEFERYWKQSQNNKLLLANMDRFEAEYPPEEGHLEKLRETHGQAQAKHTASKSPYRISVPMQVKLCTVRAYQRLWGDKSSTIATNISQIMMALIIGSLFFDTPQTTDGFFAKGSVIFFAILLNGLMSITEINGLDAQRPIVVKHVNFAFYHAYSEALAGIVADIPIKFLLALVFNIIIYFLGGLERSAAKFFIFFLFTFITILTMSAIFRTLAAATKTIPQALALAGVMILALVIYTGFTLQPSYMHPWFKWILYINPIAYAYEALLVNEVHGNRYRCATPIPPYGSGKNFACAVAGAVPGEMSVSGDAWVESSYDYSYAHIWRNLGILLGFLAFFYFVYLMVSELNLSSASSAEFLVFRRGHLPKNFQGSKDEEAAAGGVMHPNDPARLPPTNTNGAAGETAPGGSTVAVIPPQKDIFTWRNVTYDITIKGEPRRLLDNISGWVRPGTLTALMGVSGAGKTTLLDALAQRTTMGVITGDMLVNGRPLDSSFQRKTGYVQQQDLHLETTTVREALRFSADLRQPKSVSRKEKYEYVEDVIKMLSMEDFSEAVVGNPGEGLNVEQRKLLTIGVELAAKPQLLLFLDEPTSGLDSQSSWSIVTFLRKLADNGQAVLSTIHQPSGILFEQFDRLLFLAKGGRTVYFGDIGKNSETLLNYFETHGAEPCGPSENPAEYMLNIVGAGPSGKSNIDWPVVWKESEESRHVQQELDRIQSETSKRNEGHGQSAEKEPGEFAMPFTSQLYCVTTRVFQQYWRTPSYIWGKLLLGLASALFIGFSFFLQNSSMAGLQNSLFSIFMLTTIFSSLVQQIMPRFVTQRDLFEVRERPSRAYSWKVFLLANIIVEIPYQILLGIIAWASLFYPTFGAHLSSERQGILLLYCVQFFIFASTFAQMIIAGLPDAETAGGIATTMFGLMVTFNGVLQKPNALPGFWRFMWRVSPITYTVGGLAATSLHSREVKCAQNELAIFDPPSGATCAQYLQKLVEAGAPGKLYNPMSTSQCQYCPLSSGDQFLGGSEIHWSDRWRNFGIGWAYIVFNIFATVALYYLIRVRKSSGRPNRIISVITYHLSQFGTYCRAFITGRKEKCPRKREQIGKIY

SEQ ID NO: 23693 - protein, 437 aa, Shigella dysenteriae
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASNVLTGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLP

SEQ ID NO: 23694 - protein, 455 aa, Kluyveromyces lactis
MMMKWTHHRPNTGVSMSQPKIFRKKRQESRYHGGSQSRYQPNRPNNHHNTAGNVNVNRSLGKRNPRGKFNRPSNGPETSGSRFEGHGSIPRGPRAMGSSAESAGDSHSRNIFGKKPLALISFQDVKSSFQPLAQVGEGTYGKVYKAENVHTGKLIALKRLRLEQERDGFPITSIREIKLLQQLNHPNISLIHEIIVSDKNTISMGFQYMENDLSGMLMDKSIQFSDSNIKHLMKQLFVGLQYLHQQQIVHRDIKGSNLLIDNRGNLKITDFGLAKKLTDVSSPASNTNRVITHWYRPPELLLGATDYKYEVDCWGCGCLLVELFAGAAIFPGSNEVDQFQRILSIMGSPTLEQWPKMLDMPWWFMLVPQISKTYKNVFFDEFSKVPQDALDLASKLLRYDQDTRFTTTEALQHHYFTNEPKPQPLLLGPEFKGSHEYEVKKIRRKERERQKETTV

SEQ ID NO: 23695 - protein, 220 aa, Helicobacter pylori
SLSLDYSKNRLNDTTLKLLFELANDCSLKEKIEAMFKGEKINTTEKRAVLHTALRSLNDTEILLDNMEVLKSVRSVLKRMRAFSDSVRSGKRLGYTNQVITDIVNIGIGGSDLGALMVCTALKRYAHPRLKMHFVSNVDGTQILDVLEKLSPASTLFIVASKTFSTQETLTNALTARKWFVERSGDEKHIAKHFVAVSTNKEAVQQFGIDEHNMFEFWDF

SEQ ID NO: 23696 - protein, 359 aa, Fragaria x ananassa
MAIEQEHRKKASGWAARDSSGVLSPFNFYRRETGEKDVTFKVLYCGICHSDLHMVKNEWGFSTYPLVPGHEIVGEVTEVGSKVQKFKVGDRVGVGCIVGSCRSCENCTDHLENYCPKQILTYGAKYYDGSTTYGGYSDIMVADEHFIVRIPDNLPLDGAAPLLCAGITTYSPLRYFGLDKPGMHVGVVGLGGLGHVAVKFAKAMGVKVTVISTSPKKEEEALKHLGADSFLVSRDQDQMQAAIGTMDGIIDTVSAQHPLLPLIGLLNSHGKLVMVGAPEKPLELPVFPLLMGRKMVAGSGIGGMKETQEMIDFAARHNITADIEVIPIDYLNTAMERLVKADVRYRFVIDIGNTLKVRS

SEQ ID NO: 23697 - protein, 198 aa, Arabidopsis thaliana
MSASRFIKCVTVGDGAVGKTCMLISYTSNTFPTDYVPTVFDNFSANVVVDGNTVNLGLWDTAGQEDYNRLRPLSYRGADVFILAFSLYCKASYENVAKKWIPELRHYAPGVPIILVGTKLDLRDDKQFFIDHPGAVPITTNQGEELKKLIGSPIYIECSSKTQQNVKAVFDAAIKVVLQPPKQKKKKKTKAQKACSIL

SEQ ID NO: 23698 - protein, 190 aa, Glomerella cingulata
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVARSGSRGTSPLPGVLLIVAPVTERGSSVREKLSKQKMSPVRKEDGERMAKDLGAVKYVECSALTQFKLKDVFDEAIVAALEPPAPKKKSHKCLVL

SEQ ID NO: 23699 - protein, 475 aa, Xylomelum pyriforme
  misc_feature (1)..(6): Xaa can be any naturally occurring amino acid
  misc_feature (238)..(238): Xaa can be any naturally occurring amino acid
XXXXXXTKASVGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGXYLNATAGTCEEMIKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 23700 - protein, 466 aa, Myrsine africana
GTGFKAGVKDYKLTYYTPEYVTKDTDILAAFRVTPQPGVPAEEAGAAVAAESSTGTWTTVWTDGLTSLDRYKGRCYHIEPVAGEETQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKRLRMSGGDHIHAGTVVGKLEGEREITLGFVDLLRDDYIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 23701 - protein, 466 aa, Trientalis europaea
  misc_feature (42)..(42): Xaa can be any naturally occurring amino acid
GVGFKAGVKDYKLTYYTPEYATKDTDILAAFRVTPQPGVPPXEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKRLRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 23702 - protein, 466 aa, Cyclamen hederifolium
GTGFKAGVKDYKLTYYTPEYATKDTDILAAFRVTPQPGVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKRLRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLACKGNEIIREASKWSPELAAACEVWKEIKFEFEAMDTL

SEQ ID NO: 23703 - protein, 466 aa, Dodecatheon meadia
GVGFKAGVKDYKLTYYTPEYDPADTDILAAFRVTPQPGVPPEEAGAAVAAESSTGTWTTVWTDGLTNLDRYKGRCYNIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTWEEMLKRAVFARELGVPIVMHDYLTGGFTANTSLAHYCRDNGLLLHIHRAMHAVIDRQKNHGIHFRVLAKRLRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVAKRVALEACVQARNEGRDLAREGNEIIREACKWSPELAAACEVWKEIKFEFEAMDTL

SEQ ID NO: 23704 - protein, 466 aa, Samolus valerandi
GVGFKAGVKDYKLTYYTPEYETKDTDILAAFRVTPQPGVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGIHFRVLAKRLRMSGGDHIHSGTVVGKLEGERDITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELSAACEVWKEIKFEFEAMDTL

SEQ ID NO: 23705 - protein, 466 aa, Coris monspeliensis
GTGFKAGVKDYKLTYYTPEYATKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNQIIREACKWSPELAAACEIWKEIKFEFAAMDTL

SEQ ID NO: 23706 - protein, 466 aa, Soldanella montana
GVGFKAGVKDYKLTYYTPEYDPLDTDILAAFRVTPQPGVPPEEAGAAVAAESSTGTWTTVWTDGLTNLDRYKGRCYHIEPVAGEENQYIAYVAYPLDLFEEGSVTNLFTSIVGNVFGFKALRALRLEDLRISTAYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAVFARELGVPIIMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIRGACKWRPELAAACEVWKEVKFEFEAMGTL

SEQ ID NO: 23707 - protein, 229 aa, Bacillus amyloliquefaciens
MSSLFQTYGRWDIDIKKAKGTYVEDQNGKTYLDFIQGIAVSNLGHCHEAVTEAVKKQLDSVWHVSNLFQNSLQEQAAQKLAAHSAGDLVFFCNSGAEANEGAIKLARKATGKTKIITFLQSFHGRTYAGMAATGQDKIKTGFGPMLGGFHYLPYNDPSAFKALGEEGDIAAVMLETVQGEGGVNPASAEFLSAVQSFCKEKQALLIIDEIQTGIGRTGTRFAYQHFGLS

SEQ ID NO: 23708 - protein, 393 aa, Bordetella parapertussis
MSSALANIYARLPVSFTHGRGVWLWDTGERRYLDALAGIGVSCLGHGHPGLVAAISEQAARLIHTSNIYEVPQQAALARRLAELSGMSEVLFSNSGSEANEAAIKLARYYGYKQGNTHAHIITMDSSWHGRTLATLAATGSDKARQGFGPMPSGFIQVPYNDLPAIRAAGEAEPRVTAVLLEVLQGEGGIRPSDMAFLRGVRQLCTERGWLLMIDEVQSGIGRTGKWFAHQWADIRPDVMTLAKGLAGGVPIGAMLAAGPAAGVFAPGSHGTTFGGGPLACAAGLAVIDAIEQEGLLANAHEVGAHLHAALASELAGVPGIIEVRGHGLMLGIELDRPCGILATRAMEAGLLINVTRERVVRLLPPLILSGEEADQIVRILVPLIKQFLAQQQ

SEQ ID NO: 23709 - protein, 474 aa, Corynebacterium efficiens
MERRTKIVCTLGPAVASADGILRLVQDGMDVARLNFSHGDHPDHEQNYKWVREATDKTGRAVGILADLQGPKIRLGRFKEGSTVWETGETVRITVDDVEGTHDRVSTTYKNLAKDARPGDRLLVDDGKVGLVCVSVEGNDVICEVTEGGPVSNNKGVSLPGMDISVPALSEKDIKDLRFALKLGVDFIALSFVRSPADVELVHAIMDEEGRRVPVIAKLEKPEAVAALESIVLAFDAIMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRLARLHSHLPLLVFTPDPSVRSQLALTWGAQTFLCPKVDDTDGMMREVDRALLAMDEYQKDDMMVVVAGSPPGVTGNTNMIHVHLLGEDTRIPK

SEQ ID NO: 23710 - protein, 469 aa, Cornus nuttallii
TKASVGFKAGVKEYKLTYYTPTYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 23711 - protein, 445 aa, Micromonospora echinospora
MNYRELIERARRTTAAEEYDISGRYPSVIAHAEGAWMTDLSGNRYVDLTGADAAVILGYRHPAVNEAITRQIRDYGTTFASTLSVPRVELAERMCERYECAEKVVFHKTGTEGTAMAVRLARAATGRELVLSSGYHGWHEWQMAGEEFGYQQSTGVVGFGYNEKALAKMLEAFGEQVAGVIVSPEVLYFDLDHYRRMSALCARYDVPFMLDEVYTGFRAGPKGVHGLGVPADVVVLGKGLANGHSLAAVMGRRDIIDAYDVSGIQGTYTREVPPMAAALAVFEVLDTPGVYEHAEAMGRRLADGMREILTGEGIPNWVGGPALMFDVVLPNDDLGWEIYKTAHDFGVYFEDSGTQLVTAAFDEAAVDHALTAFRKATRQVVADRPDIAPTSGGELTEERKLDFAEEAFGGLLRDDERTNALIDETIEKVVNRDRSIKPVLFPAQN

SEQ ID NO: 23712 - protein, 369 aa, Magnaporthe grisea
MFDIFAKLLSSIASFLFPLFASYKALKTTDPAQLTPWLMYWVVLACALLVESWTEWFLCWIPFYAYIRLLFLLYLILPQTQGARVLYQDYIHPYLQENEDHIDDFIASAHDRAKAMGVMYLRQLIEYVKVNVLGMAPSRVEEQQQPPQAQGYGGQQSSVTQNLLARFALPSARWNGAGGDSNGNSGAANDFYGMLAGAVGAAMSSAGGARDNQQGPGVSRSVIPSHVNEADKASFIATQRERLTTLLAALDREAAGVQSGASSASTPVPNSSSQGFFRVRDVVEGLADTAAGLTKSRSETDFENIDAMSGTEEVGGDEDGSVRRRVQGAGGSWMPWGWGGAQSPAAGDAANPDRSNVGHSSGVNTNAGQ

SEQ ID NO: 23713 - protein, 477 aa, Thermoproteus tenax
MILWPMPDVVVVNPATEEVLAVLPSASREEVRRAIDEAEDAFYRWSELPLRERAKLLRRAADLIEADDTLINTLVAESGKPIRDARAELRRAIEIFRASAEEAKYILEGKIPRVDAYDYPLANENRIAMEVREPMGVVAGALSYNNPASTFAHKIAPVIAAGNTVIAKPSSHTPLTALKMAQILQKAGVPQGVVQVVVGSGEEIFNEFVDNPKVVGISFTGSTAVGLQVAAKAAGRGKKFMIAPGGSDPAIVFADADLEAAASIIARARFENAGQNCNATKRVFVERKVYDKFLDILRRKIAAIKVGDPMDESTEMGPVISDKMVKAMEGIVADAVEKGGKLLYGGRRMQRKGYFFEPTLVAFDGRPPEAKAFREEVFGPVLPVAPFEDEREAVELANWTQYGLQSAVFTSDYKRAFRVARAIKAGAVMINDSTRVRFDALPYGGVKMSGLSAGWREGVRSTMLLFTEIKYYVLNIA

SEQ ID NO: 23714 - protein, 363 aa, Thermoproteus tenax
MEAAILEKYNSELVIEEVDVEPPKSGEVALRVKAAGVCHSDLYVLEGATPVPPPLVPGHEAVAEVIEVGPDVQGLSRGDLVVTSFIWPCGRCRNCARGHENLCERFSEVRLKGVLLDGTTRLRRRKSGEPLRIFLGGLWAQEAVVPASAVAKLPPRLANRPELAMLGCAFLTAYGAVVNSGSVQPGDTVAVIGTGGVGLAIVQVARAVGARVIAVGRNPEKLKLAAEMGAEVVNARDGDAVAEVRKLTDGRGADVVVEAVGSEQTVEQAIDMASTGGRVVLVGLMGLGKKAPLHVARVVRGGISVIGSYGARPRVDLPKVIGMVERGLLRPELMARDFYKLEQINEAVEALRSGRSIRPIVLP

SEQ ID NO: 23715 - protein, 325 aa, Thermoproteus tenax
MAEGRCSQGKEPAEAMISLVALGEPLIQLNAVTPGPLRYVAYFEKHVAGSEANFCIAATMAGARCSLIARVGDDEFGRNIVEYLRGRGVDVSHVKVDPGAPTGIYFVQRHFPVPGRSRLIYYRKGSAGSRVGPDDVDSSLISSADAVHSTGITLALSDSANRAVHKAFGEAKRRTFDTNIRPALWPDLAAARRAILDVLNYGVDVLVTDPDDTQILLGVRDPEEAYRKYRELGVQTLVYKLGAEGAYVFWNGGSYFRDALKVAVEDPTGAGDAVAGYFVALYLSGVDPRRALDLAVAASALVVGVRGDNEALPSPREAEELLKAL

SEQ ID NO: 23716 - protein, 412 aa, Thermoproteus tenax
MDTTIEELLARRILTGRGDQTIEVEVYTADGFGKAAAPAGASKGKHEVAFLPEGGIDAALSAFERLVSPELAGVDAAEQYAVDGKLEEVDGTGRFERIGGAVAIAVSMAAARAAANTLGIPLFRHLGGAPARTLPLPLGNAIGGGKHSRGLGPDLQEFLVIPLNPPDIATAVLANLEVHKRALKYIVKADPHFTGGKNDEGAWTPRISAETALKILKESAAEVSKEIGVEIGLGVDAAASSLWNGSKYVYQNEGKERGPREQLEYMARLLDEFGLVYLEDPFHEDDFQSFAELTSRFKDRLIVGDDLYVTNAARIERGGREGATTAALIKPDQTGTLTRAHEAVKTARRYGMRIVVSHRSGDTEYDTLAHIAVAFGAEVIKTGIVGGERTAKLNELIRIGDYLGKWGRISSL

SEQ ID NO: 23717 - protein, 482 aa, Thermoproteus tenax
MLGKYGVFPPTDPEFEDPPKLDKYDVIVVGGGGGGYHGAFQLSAGGYRVLMVDDKGNLGGNCLYEGCIPSKSVFYMVYLAERLRRLAKRSAGAAEVKAIWEEAVDHKDEVQYLRYLQHIREIKEHGNVDFVKGVARVLDGRRVEVTAVDGSWRKTVEGSRLLLATGSVAVRLPIPGAELAIGSEELFGYRTKRRTLPREVVVIGGGYIGVEVASAMASAGAKVTVVEMLPRIMSGWDSSIVSMIEGALKGRGVEILTNSRVTAIREESGQKVVEFQRPDGSKGTVAGEEVVMAVGRKPYVEGLEALGIVEKGRVVADSSMSTKAPGVYAAGDVLGKYMLYHAAVKESTVAAWNIMMGRPVYEVNFNAIPLTLFTEPEAAMVGISEDEARARGIPYVAVQYPLEDDSYAQIVGVREGWVKLIVERESQRIIGGSVYGEAASMIINEIALAVAVNARVRDLALLAHAHPTIFESIDRAAVRFSL

SEQ ID NO: 23718 - protein, 466 aa, Thermoproteus tenax
MTFDLVVLGGGSAGFAAAIKAAQLGASVAMINDGPLGGTCVNVGCVPSKYLVRAGELMKAARAPYFRGIRGWAEVDGKALMAHMRSVVEELRRRKYADLIDYYDIKLMEGRGMLVGPGAVKVGGETVVGRKIVVATGARAVWPQIKGLEEARRRGLAFSNEEFFSLEDLPNSVVFIGGGAISVELGQALSRLGMETYVIYRSRLLKYEEALVSDFIEEALREDGVKLIRGEATAVEVKNNGVEVRAGGVSVEAEAVFVATGRRPNVEDLGGLLKLTPEGAVEVNRRMETSVPGIYAAGDVTGGLPGGRYLENVAARQGVVAAVNALGGSAEFDAMWAPRVVFSDPPVASVGLREEDMIRSGVGCACRLVTIDNAAAAWTSGRARGFIKINTYPERLRLKGGRIAGALVVSPHAEELINIFALAVRKGLTVDDIADWIPAFPSFSEALRLAALAFTTDPTKLSCCGG

SEQ ID NO: 23719 - protein, 318 aa, Dendrobium crumenatum
MELLEGSRRSDAMAVLRDACENWGFFELLNHGISHEPNEQSETVNKEHYREHYRRFREQRFKEFAAKTLDSGENVDGDNLDWESTFFLRHLPTSNISQVPDLDEDCGSTMKEFALGLEKLAERLLDLLCENLGLEKGYLKRVFCGGSDGLPTFGTKVSNYPPCPKPELIKGLRAHTDAGGIILLFQDDTVSGLQLLKDEEWIDVPPMRHSIVVNIGDQLEVITNGKYKSVMHRVVAQTNGNRMSIASFYNPGSDAVIFPAPELVEKEAAEKKKETYPKFVFEDYMKLYVRQKFEAKEPRFEAMKTMDAVISSQPIPTA

SEQ ID NO: 23720 - protein, 483 aa, Pseudomonas stutzeri
MNTKLFINNVWVNSSDQQTFERKHPVSGEVMTECANSTVMDALKAAQAAQEAFQTWKTVGPSERRRLLLRVAEVMESKTPEFIEVMAKEVGASALWAGFNVQMSANVFREAASLATQIQGETIPTDKSDTLSMTLRQPVGPILSIVPWNGTAVLAARAIAYPLVCGNAVVFKGSEFSPATHALITQRVQEAGLPAGVLNYLNSSPDRSPEIADALISAKEIRRINFTGSTRVGSIIAQKAAQHLKRCLLELGGKSPLIVLDDADIDAAVKAAVFGSFLVQGQICMSTERLVVDEKIADEFAAKFAEKAKRLSAGDPCVTGDCIIGPMVSPNSGERINGLFKDAIDKGATVACGGMAQGAVMPATILDHVKSNMRIYDEETFGPITVVIRCSGEAEAIRIASDSAYGLSSGVFGRDINRALRVGMSIEYGSVHINGSTVQSEAQAPYGGTKNTGYGRFDGRAVIDEFTELKWLTIEPFEQQYPF

SEQ ID NO: 23721 - protein, 486 aa, Pseudomonas stutzeri
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 23722 - protein, 379 aa, Lycopersicon esculentum
MASEAHAVVDAHSPPKTTTVWVTGGAGFIGSWLVMRLLERGYNVHATVRDPENQKKVKHLLELPKADTNLTLWKADLAVEGSFDEAIQGCQGVFHVATPMDFESKDPENEVIKPTVRGMLSIIESCAKANTVKRLVFTSSAGTLDVQEDQKLFYDETSWSDLDFIYAKKMTGWMYFVSKILAEKAAMEEARKNNIDFISIIPPLVVGPFITSTFPPSLITALSLITAHYGIIKQGQYVHLDDLCEAHIFLYEHPKAEGRFICSSHHAIIYDVAKMVRQKWPEYYVPTEFKGIDKDLALVSFSSKKLMDIKFQFKHTLEDMYKGAIETCRQKQLLPFSTRSTADNGKDKEAIPISTENYSSGKENAPVANCTGKFTNGEI

SEQ ID NO: 23723 - protein, 334 aa, Pisum sativum
MAAPENTLHSTDSPLKRQREDEVNGVSDTLSKEPQPNGLSSVIPGWFSEISPMWPGEAHSLKVEKILFQGKSDYQDVMVFQSATYGKVLILDGVIQLTERDECAYQEMITHLPLCSIPNPKKVLVIGGGDGGVLREVARHSSVEKIDICEIDKMVVDVSKEYFPDIAVGFADPRVTLNIGDGVAFLKAAPEGTYDAVIVDSSDPIGPAQELFEKPFFESVARALRPGGVVCTQAESIWLHMHIIEDIVVNCRQVFKGSVNYAWTTVPTYPSGMIGFMLCSTEGPSVDFKHPVNPIDENDSQQAARPLKFYNREIHSAAFCLPSFAKRAIASKEN

SEQ ID NO: 23724 - protein, 342 aa, Pisum sativum
MAAESTVELESSMKEHRDDDEKSNGFSVSAVSMDVEGGDKDPSGNGVSSVIPGWFSEISPMWPGEAHSLKIEKILFQGKSEYQKVMVFQSSTYGKVLVLDGVIQLTERDECAYQEMITHLPLCSIPNPKKVLVIGGGDGGVLREVARHSSIEKIDICEIDNMVVEVSKQFFPEVAVGFNDPRVTLRIGDGVAFLKAAPEGTYDAVIVDSSDPIGPAQELFEKPFFQSVARALRPGGVMCTQAESIWLHMDIIEDIVSNCRHIFKGSVNYAWTTVPTYPSGMIGFMLCSTEGPLVDFKHPVNPIDQKDCQKSVRPLKFYNSEIHTAAFCLPSFAKRKIGSKET

SEQ ID NO: 23725 - protein, 155 aa, Hordeum vulgare subsp. vulgare
MEHGHATNRVDEYGNPVAGHGVGTGMGTGAAAGGHFQPTREEHKAGGILQRSGSSSSSSSEDDGMGGRRKKGLKDKIKEKLPGGHGDQQQTGGTYGQHGHTGMTGTGEHGATATGGTYGQQGHTGMTGTGAHSTDGTGEKKGIMDKIKEKLPGQH

SEQ ID NO: 23726 - protein, 502 aa, Hordeum vulgare subsp. vulgare
MAHFQGQQHGHPATRVDEYGNPVTAGGHGGGVTGTDGLGHFQGQQHGRTTTRLDEYGNPVTAGHGVGAGSTGTEVHGPGHAGYGSTGTNDTGGHGRQVGYGATGTGTHDAGGYGGSGIAPRHGGAGTGVHDAGGLGHTTGHGATSTHGTGHTAGYGSTGTGMTGTHGTGHTAGYDATGTGITGTHGTGHTTGYGGTGTHGTGHTAGYDATGTGIAGTHGTGRTAGYGGTGTGITGTHGTGHTTGYGGGATGTGITGTHGTGHTAGLGGTGTGITGTHGTGHTTGYGGGVTGTGITGTHGTGHTTGLGGTGTGITGTHGTGHTAGLGGTGTGITGTHDVVGTHPHGGLGEHKTGGILHRSGSSSSSSSSSEDDGMGGRRKKGMKQKIKEKLPGGNKEQTTATGGYGPGYTGTTGTGGAHGATEGTHEKKGVMEKIKEKLPGGHKDNPPHTTATTGGYGAGTTGTGGYGAGTTGTGGTYGATEGTHEKKGMMEKIKEKLPGGHH

SEQ ID NO: 23727 - protein, 274 aa, Oryza sativa
MASPSSSSSLCSTFASPRAASLGRRLAFSSPRKAFRVRASSRVDKFSKNDIIVSPSILSANFSKLGEQVKAVEVAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPATPLTAIDYVLDVVDLVLIMSVNPGFGGQSFIESQVKKIAELRKYVAEKGVNPWIEVDGGVGPKNAYKVIEAGANAIVAGSAVFGAPDYAEAIKGIKTSKRPVAVPA

SEQ ID NO: 23728 - protein, 338 aa, Enterobacter cloacae
MNLNRFERYPLTFGPSPITPLKRLSEHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVERGGKPFPIPAGCSEHPYGGLGFVGFAKELRQQEKDLGFKFDYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPDGSKVLYAHLGGAPALNAYSFLFRNG

SEQ ID NO: 23729 - protein, 338 aa, Enterobacter cloacae
MNLNRFERYPLTFGPSPITPLKRLSQHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAKKLRQQEKELGFKFNYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPEGSKVLYAHLGGAPALNAYSFLFRDG

SEQ ID NO: 23730 - protein, 469 aa, Bellis perennis
KASVGFKAGVKDYKLTYYTPEYETKDTDILAAFRVTPQPGVPPEEAGAAVAAESSTGTWTTVWTDGLTSLDRYKGRCYGIEPVPGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEDMMKRAVFARELGVPIVMHDYLTGGFTANTTLSHYCRDNGLLLHIHRAMHAVIDRQKNHGMHFRVLAKALRMSGGDHIHSGTVVGKLEGEREITLGFVDLLRDDFIPKDRNRGIYFTQDWVSLPGVLPVASGGIHVWHMPALTEIFGDDSVLQFGGGTLGHPWGNAPGAVANRVALEACVQARNEGRDLATEGNDIIREATNWSPELAAACEVWKEIKFEFQAMDTLD

SEQ ID NO: 23731 - protein, 469 aa, Hypochaeris radicata
KASVGFKAGVKDYKLTYYTPEYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAIFARELGVPIVMHDYLTGGFTANTTLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLD

SEQ ID NO: 23732 - protein, 469 aa, Leucanthemum vulgare
KASVGFKAGVKDYKLTYYTPEYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLD

SEQ ID NO: 23733 - protein, 469 aa, Prunella vulgaris
KASVGFKAGVKEYKLTYYTPEYETKDTDILAAFRVTPQPGVPPEEAGAAVAAESSTGTWTTVWTDGLTSLDRYKGRCYHIEPVPGEKDQYICYVAYPLDLFEEGSVTNMFTSIVGNVFGFKALRALRLEDLRIPPAYIKTFQGPPHGIQVERDKLNKYGRPLLGCTIKPKLGLSAKNYGRAVYECLRGGLDFTKDDENVNSQPFMRWRDRFLFCTEALYKAQAETGEIKGHYLNATAGTCEEMIKRAVFARELGVPIVMHDYITGGFTANTSLAHYCRDNGLLLHIHRAMHAVIDRQKNHGMHFRVLAKALRLSGGDHIHSGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVKARNEGRDLAREGNAIIREACKWSPELAAACEVWKEIKFEFQAMDTLD

SEQ ID NO: 23734 - protein, 411 aa, Pseudomonas fluorescens
MIKSIVIIGAGLAGATATRYLRAQGYQGKIHLVGEELHVAYDRPSLSKDTLSGKVVEPPAILDPCWYASADIDLHLGVRVTGIDVVNHQVLFESGDILAYDRLLLATGARARRMAITGSELAGIHTLRDRADSQALRQALEPGQSLVIVGGGLIGCEVATTAINAGAHVTVLEAGDELLLRVLGRSTGAWCRNELERLGVRVELNAQAAHFEGEGHVHAVVCADGRRIAAGTVLVSIGAEPADELARAAGIACERGVVVDATGASSCPAVFAAGDVAAWPLRSGELRSLETYLNSHMQAETAAAAMLGKSIPALQVPTSWTEIAGHRIQMVGDIEGPGEVVLRGNVENGQPLVQFRVLDGRVEAATAINAPEDFPVATRLVADHIPVSATKLQDASSNLRDFMKAKAERCE

SEQ ID NO: 23735 - protein, 105 aa, Petunia x hybrida
VSDVVYEDIILDNVRNPIVIDQNYNSKNKNQPSRVKLVDIHFRNIRGTTPSILPVALNCSETLPCEGIELSNINLAPVGSIGPLSSAVCQNAKTILNGNINPPAC

SEQ ID NO: 23736 - protein, 193 aa, Brachymonas petroleovorans
RIEVRVRQGIPLPGIELKVLDSQGQPVPRDDEHAGEVYVRGPWVATEYYRDARSRDGFVDGWWKSGDIATVGPDGSIRLVDRAKDLIKSGGEWISSVDLENELMAHPAVAEAAVVAMPDARWQERPIAFVVTAPGAQPPSEEELRQWLARRFVKWWLPDRFVVTDALPKTGVGKLDKRRLRERAAELAAAGPA

SEQ ID NO: 23737 - protein, 484 aa, Brachymonas petroleovorans
MDAQRTLPDCSKLFLGGRWVEPAQGMYYDNENPAKRETICRVAQASAADVDAAVRGAQQALEPGSPWAQMTPAARARLLWRVAERIREQVEELAWLESLDTGKPYGEALHGDIPHAAGAFEYYAGWCSKLAGSVLPVSPRYLDYTRLEPVGVVGAIIPWNFPLQMAAMKVAPALAAGNAVLLKPAEQTPLTAFALARIFEELEFPPGVLSVLPGFGATGAALVAHPGIDKITFTGSTAVGKTIMRGAADTLKRVSLELGGKSPNIVFADADLKRAVRGATTGIYYNQGQMCTAGSRILVQDSLYDKFLEAFTAAIADLRPGDPLDPKTRMGALVSQEQFERVSHYVALGQEDGATLLAGGQGSAERGYFFPPTIFTDVKPEHRIAQEEIFGPVVSVMRFGSEEEALRLANGVSYGLAAGVWTADVGRAHRVAHGLRAGTVWVNTYNALWNEAPFGGYKQSGIGREGGREGIEPYTEVKNICLSL

SEQ ID NO: 23738 - protein, 483 aa, Nicotiana attenuata
MGFISNIENELLSKVATNNGHGENSAYFDGWKAYEIDPFHLTQNFDGVIQMGLAENQLCFDLIQEWVVNNPKASICTAEGSEDFKDIAIYQDYHGLPEFRSAVARFMEKVRGDRITFEAERIVMSGGATGAHELLAFCLADPAEAFLVPTPYYPGFDRDLRWRTGVQLFPVVCESSNNFKVTRTALETAYQKAQESNITVKGLLLNNPSNPLGTILDRETLKDTVRFINEKNIHLVCDEIYAATIFNKPDFISISEVILDEDVECDRDLIHIVYSLSKDLGFPGFRVGIIYSYNDVVTNCARKMSSFGLVSTQTQFLISNMLSDEKFVTKFIGESSERLAKRHDMFTKGLAQVGINTLKSNAGLFIWMDLRRLLKELTFESELELWRIIINEVKLNVSPGCSFHCSEPGWFRVCFANMDDETMRVALRRINNFVIQRKGIEGGVKKLQCRRSKLEISLSFRKLDDFINSPHSPMSSPLVQART

SEQ ID NO: 23739 - protein, 484 aa, Nicotiana attenuata
MVFISGNVQKQQLLSKIATNDGHGENSAYFDGWKAYENDPFHLTNNPNGVIQMGLAENQLCFDLIQEWVVNNPKASICTTEGAEDFRDIAIFQDYHGLPEFRQAVARFMEKVRGDKVTFDPNRIVMSGGATGAHETLAFCLANPGDAFLVPTPYYPGFDRDLRWRTGVQLFPVVCDSSNDFKVTKKALESAYEKAQESNINIKGLLINNPSNPLGTILDSDTLKDIVTFINSKNIHLICDEIYAATVFDQPKFISVSEIVEEHVGCNKDLIHIVYSLSKDLGFPGFRVGIVYSYNDTVVNIARKMSSFGLVSTQTQHLIASMLSDETFIEKFIAESSERLGKRHEMFTKGLAQVGISTLKSNAGLFFWMDLRRLLKELTFESELELWRIIINEVKLNVSPGCSFHCSEPGWFRVCFANMDDETMRIALRRIRNFVLQTKGLNSKSAVKKQCSRSKLQISLSFRRMDDFMNSPVHSPMNSPLVRT

SEQ ID NO: 23740 - protein, 198 aa, Lolium multiflorum
PFKVKSGSCGTVVRNAELKVVDPDTGASLGRNQPGEICVRGKQIMLGYLNDPESTKNTIDKDGWLHTGDIGLVDDDDEIFIVDRLKEIIKYKGFQVAPAELEALLLTNLEVKDAAVVGVKDDLCGEVPVAFIKRIEGSEITENEIKQFVSKEVVFYKRINKVYFTDSIPKNPSGKILRKDLRARLAAGIPTEVAAPRS

SEQ ID NO: 23741 - protein, 433 aa, Pneumocystis carinii f. sp. ratti
MGIFKIHARSFYDSRGNPTVEVEVTTETGVHRANVPSGASTGIHEALELRDNGSSWSGKGVTLAVSNVNDIIAPSLLSAGIDIKDQRSIDKFLIDLDGTSNKSRLGANAILGVSIAICKAAAAEKGVPLYRHFADIADIKEPFILPLPCFNVLNGGSHAGGRLAFQEFMILPTSAVTFHEAMQQGSEVYSALKKLSRKRYGHSAGNAGDEGGVAPDIQTADEALDLIVTAIEEAGYTGKIKIALDVAASEFYKNGKYDLDFKNPESDSSQHKTSKELADIYLDLSKKYPIVSIENPVDRDDWDAWIYVSRRATFQMVGDDLTVTNVSRINEAADKKACNCLLLKINQIGTISESIDAFKTAFDAGWGVMVSHRSGETEDTVIADLVVGLGTGQIKTGAPCRSERVAKYNQLLRIEEELNHSVYASMNYIKNIK

SEQ ID NO: 23742 - protein, 414 aa, Yersinia pestis
MEQPSPVTRQSFDEWIVPTYAPADFIVVRGEGSTLWDQQGKSYIDFAGGIAVNALGHGHPAVRAALIEQADKVWHLGNGYTNEPVLRLAKQLIDATFAEKVFFCNSGAEANEAALKLARKYALDNFANKAGQQGEKNQIVAFRNAFHGRTLFTVSAGGQPKYSQDFAPLPGGIHHGIFNDLASAEHLITDQTCAVIVEPIQGEGGVLPADKEFLHGLRALCDRHNALLIFDEIQTGVGRTGELYAYMHYGVSPDVLTSAKALGGGFPIGAMLTTTKYASALSVGSHGTTFGGNPLACAVAGTVLSLINQPTLLAGVKARHQWFIDELAEINARHNVFAEIRGRGLLIGCVLNAQYAGKSKEIVQAAAQYGLIALIAGPDVVRFAPSLIISPKEIKEGLARLAMGIEQVCQKVTS

SEQ ID NO: 23743 - protein, 507 aa, Yersinia pestis
SGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 23744 - protein, 300 aa, Schizosaccharomyces pombe
MDYLLNYADQYALDSIYNAVYPLARDNIVRQSISLFFLTWFGGMFLYLTFASLSYQFVFDKSLMDHPKFLKNQVFMEVLTALQNLPGMALLTVPWFLAELHGYSYLYDNISDYGLKYFLCSLPLFVMFSDFGIYWAHRFLHHRYVYPRLHKLHHKWIICTPYASHAFKSADGFLQSLPYHLFPFFFPLHKLTYLALFTFVNFWSIMIHDGKYISNNPIINGAAHHNGHHIYFNYNYGQFTTLFDRLGNSFRAPDEAWFDKDLRQNEDVLRVELMEYEAIRNEVEGDDDREYIANSAKKNH

SEQ ID NO: 23745 - protein, 395 aa, Schizosaccharomyces pombe
MTIVNEGAENVGYFTPAQKIPAGAAIGVPQTKLFTPLKIRGVEFHNRMFVSPMCTYSADQEGHLTDFHLVHLGAMGMRGPGLVMVEATAVSPEGRISPNDSGLWMESQMKPLRRIVEFAHSQNQKIGIQLAHAGRKASTTAPYRGYTVATEAQGGWENDVYGPNEDRWDENHAQPHKLTEKQYDELVDKFVVAAKRAVEIGFDVIEIHGAHGYLISSTVSPATNDRNDKYGGTFEKRILFPMEVVHSVRKAIPDSMPLFYRVTATDWLPKGQGWEIEDTVALAARLRDGGVDLIDVSSGGNHKDQRIEVKDCYQVPFAEKIKDQVNGILLGAVGMIRDGLTANEILESGKADVTFVAREFLRNPSLVLDSANQLGENVAWPVQYDYAVKGHRKLR

SEQ ID NO: 23746 - protein, 258 aa, Oryza sativa
KREIKILRLFIHPHIIRLYEVIYTPTDIYVVMEYCKFGELFDYIVEKGRLQEDEARRIFQQIISGVEYCHRNMVVHRDLKPENLLLDSKYNVKLADFGLSNVMHDGHFLKTSCGSPNYAAPEVISGKLYAGPEVDVWSCGVILYALLCGTLPFDDENIPNLFKKIKGGIYTLPSHLSALARDLIPRMLVVDPMKRITIREIREHQWFQIRLPRYLAVPPPDTAQQAKMVLCVTFLTSCSLMYQTLYTNIIFLRYTYRV

SEQ ID NO: 23747 - protein, 435 aa, Schizosaccharomyces pombe
MVSEISDLSLAKEKSEAQFIARNPKSNDFHCKACDSLPGGNTRTVLHGAPFPIFIEAGYGSKLRDVDGHEYTDFLNELTAGIYGHSNPVIKKALMQGFDEIGISLGGTTTCELNYAEALKSRFLSIEKIRFCNSGTEANITAIIAARKFTGKRAVIAMHGGYHGGPLSFAHGISPYNMDSQDFILCEYNNSTQFKELVNSSQDIAAVIVEAMQGAGGAIPADKEFMQTIQLECEKNDIVFILDEVMTSRLSPGGLQQIYCLKPDLTTLGKYLGGGLPFGAFGGRADIMSCFDPRLPGSLSHSGTFNNDTLTLTAGYVGLTELYTPEAVKRLNALGDGLRKDIESYCHNTKMSITGLGSIMNIHFTESGRVNSYNDTAGEVIELKDLLWMDLLKEGFWIARRGMITLSLVLTESELEAFKLTIKAWIHRRMSLIRI

SEQ ID NO: 23748 - protein, 348 aa, Ipomoea purpurea
MVGGNHTPASPAPTVCVTGAAGFVGSWLVMKLLQRGYIVHATVRDPGNTQKVKHLLELPKAEGKLKVWKGVLEEEGSFDEAIAGCEGVFHVAAAVNFASKDPENEVIKPAVKGILSIINSCAKAKTVKKLVFTSSTAAVHIKETQQLVYDESSWSDLDFIYANKMGGWMYFASKTLAEKEAWKAAKEKQIEFISIIPPLVIGPFLIPTFPLSLVTALSPIMGNGLHHNIIKQGKFVHLDDLCEAQIFLYQHPEAGGRFICSSHHATIHDVAKMIRHNWPEYYVPSEFKGIEKELPIVSFSSKKLQEMGFQFKYTLEDMYKGAIETLRKKGLLPYSTKEPAGIEQEPKS

SEQ ID NO: 23749 - protein, 386 aa, Ipomoea purpurea
MVDGNHPLPAPKVCVTGAAGFIGSWLVKTLLQRGYHVHATVRDPGNTKKVKHLVELPKADTNLTVWKGVMEEEGSFDEAIAGCEGVFHVATPMDFDSKDPENEVIKPTINGVLNIINSCVKAKTVKRLVFTSSAGTLNVQPQQKPVYDETCWSDLDFIYAKKMTGWMYFASKILAEKEAWKATKEKQIDFISIIPPLVVGPFITPTFPPSLITALSLITGNEAHYSIIKQGQYVHLDDLCEAHIFLYEHPKAEGRFICSSHHTTIHGLADMITHNWPEYYIPSQFKGIEKELPVVYFSSKKLQDMGFQFKYSLEDMYRGSIETLRKKGLLPYSTKETAAIEEEQETVPLKVEEPTAIEQKQETVPLKLEEEPIAIEQKQEVVPLKA

SEQ ID NO: 23750 - protein, 356 aa, Ipomoea purpurea
MSGGGGHAPTLPAPKVCVTGAAGYVGSWLVMKLLQRGYVVHATVRDPGNTKKVKHLLELPKAAEGKLRLWKGVLEEEGSFDDAIAGCEGVFHVAATPVDFVSDDPQNEIIRPAVKGILSIINSCAKAKTVKRLVFTSSAVTLIVQGNPKPVYDESSWSDLDLIYAKKMPGWMYFASKTQAEKEAWKAAKEKQIDFISIIPPLVIGTSIVPTVPLSFTIALSPVTGNEAHYFVIKQGQYVHLDDLCEAQIFLFEHPKAEGRFICSSHDATIHDLAKMIRQNWPEYYVPSEFKGIEKDLQVVSLSSKKLLDMGFQFKYTLEDMYREVIETLRNKCVLPYSIKPPPNEQEWENGKTLEA

SEQ ID NO: 23751 - protein, 172 aa, Chlamydomonas reinhardtii
MPRTQRNDNFIDKTFTVVADILLKVLPTSQREKQAFSYYRNGMSAQAEGEYAEALQNYYEAMRLEVDAYDRSYILYNIGLIHTSNGEHGRALEYYYQALERNPSLSSALNNIAVIYHYRGEQAIENGQSEISQILFEKAADYWKEAIRLAPTNYIEALNWLKMTGRLTGLAT

SEQ ID NO: 23752 - protein, 475 aa, Chlamydomonas reinhardtii
MVPQTETKAGAGFKAGVKDYRLTYYTPDYVVRDTDILAAFRMTPQLGVPPEECGAAVAAESSTGTWTTVWTDGLTSLDRYKGRCYDIEPVPGEDNQYIAYVAYPIDLFEEGSVTNMFTSIVGNVFGFKALRALRLEDLRIPPAYVKTFVGPPHGIQVERDKLNKYGRGLLGCTIKPKLGLSAKNYGRAVYECLRGGLDFTKDDENVNSQPFMRWRDRFLFVAEAIYKAQAETGEVKGHYLNATAGTCEEMMKRAVCAKELGVPIIMHDYLTGGFTANTSLAIYCRDNGLLLHIHRAMHAVIDRQRNHGIHFRVLAKALRMSGGDHLHSGTVVGKLEGEREVTLGFVDLMRDDYVEKDRSRGIYFTQDWCSMPGVMPVASGGIHVWHMPALVEIFGDDACLQFGGGTLGHPWGNAPGAAANRVALEACTQARNEGRDLAREGGDVIRSACKWSPELAAACEVWKEIKFEFDTIDKL

SEQ ID NO: 23753 - protein, 436 aa, Haloferax mediterranei
MGLVKMTRWRTLVLATAAFNLSFLIWFSFAPFTGQIAAEFGLSLTDLGILASAHLVGPPGRILTGWLSDRFGASTVFGIVLAYVGIFSMASAFATSYEVFFVERVVVASAGITFVVGIQHVSQWFPEEELGTAEGIYAGIGNAGAAGGALILPRAFGNWSGPLFSTGWRAAFFYTGVVAILMAIVYVVFGQDAATKARAAATSESATLSTWVHTATRYGVVALALGYVMSFGLEISMNGWLPTYFREGFGSNLVIASTFAATFSLAAGLLRPIGGYVSDRLVRDQRDILPFFAGRYREQWTVLCMTFIVVSMTGLTFAGQTGNVLLTVAAGFLVGMSCAFTEGAIFAQVPAMFPNRSGAAAGIVGGIGTFGGIGFPLVYSFAAAEGMIHTGYVIVAALMIPILALNAFISRPHIASRAHVDGFFDGSRFESSQSDD

SEQ ID NO: 23754 - protein, 306 aa, Corynebacterium glutamicum ATCC 13032
MSKVYVSNEYGGPENQELITRNTPQPGPGELGVKVHAAGVNPLDWKVRSGVAGTPRELPAPLGEEASGIVTAVGDGVEGFAVGDPVLGLVAPGVGGYAEDTLLVAESTVLKPEEISFTDAAAIPVAGASAYAGTHQVELEPGQSLLINGAGGGVGLMAAQIGRVHKFQVVGVDHEDKRELIESTGAIFVATGDAVAEQVRALLPDGVDVVFDLVGGEALRVVAPLAKNPAHVISAADAATVGELGGQVLRRTPEMVGQITGVVQYGLVDPKVDTTYPLEQAGKALAHVEQGHARGKIVLELITSQD

SEQ ID NO: 23755 - protein, 439 aa, Corynebacterium glutamicum ATCC 13032
MNLTRNDRLDRLPVTSKHKKILGGSGIGWALDAMDVGLISFVMAALATHWGLSPTETSLLGSIGFVGMAIGASLGGLLADKLGRRQVFALSLLVYGVATGASALSVSLAMLMALRFVVGLGLGAELPVASTLISEFSPRKVRGRMVVILEAFWALGWIMAAIVGTFVVAGSDNGWRWALALGCVPAIYAVYVRLGLPESVRFLEKKGRHDEAEAIVVSFEEAAAAEGKAADATTAVVHDNAAEGSVSIWSAALRKRTVALWIVWFCINLSYYGAFIWIPSLLVADGFTLVKSFQFTLIITLAQLPGYAVAAWLIEKWGRRSTLATFLVGSAISAALYGLANVEWQILVAGCLLSFFNLGAWGALYAIGPELYPTNVRGTGTGAAAGFGRIASIIAPLIVPPVIAFGGPIALFALFATAFAIAAIAAFTLPEQKGKSLAD

SEQ ID NO: 23756 - protein, 337 aa, Corynebacterium glutamicum ATCC 13032
MSAQMDTPDPTMSAVAMLDSIPSDQPDFLIDVEVDRPTPGPHDLLVHIEAVSINPVDTKVRMRAGKQKHPKILGFDAAGEVVAVGSQVTLFNVGDKVFYAGSNQRPGSNAEYQVVDERLVGHAPQSLGAHDAAALPLVALTAWESLFDRLGVTQSTTGTLLVLGGSGGVPSALIQLARALTGLKVVATASRPESQEWVTKLGAHEVIDHSKDLSEQISDVDFVFSSWTTGREVELATLMKPQSHLVLIDDPVDPNLGAFKQKAIALHWEFMFTRAMFNTPDMGEQGKILNKIADMVDRGQFESVTATVLDGLNAANIMEGHRLVEQGKTSGKIVVRV

SEQ ID NO: 23757 - protein, 448 aa, Corynebacterium glutamicum ATCC 13032
MPESILGRMDTKLGAELGTEFDLIVVGFGKAGKTIAMKRSAAGDKVALIEQSPQMYGGTCINVGCIPTKKLLFETATGKDFPDAVVARDQLIGKLNAKNLAMATDKGVTVIDGKATFTASHEITVTSGSDTLVLYAPTIVINTGSTPVIPNVPGTDNPHVFDSTGIQHISPLPKHLAIIGGGPIGLEFATLFSGQGSKVTIIDRGELPLKNFDREVAELAKTDLEARGITFLNNAELTGFSGDLTIALKDHELLADAALLAIGRRPATDGLGLEQAGIKTGTRGEVLVDAHLRTNIDGIFAVGDVNGGPQFTYVSYDDHRIVLDQLAGTGKKSTAHRLIPTTTFIEPPLSTIGDNTEGENVVVKKALIADMPIVPRPEIINQPHGMVKFFVDKQSDALLGATLYCADSQELINTVALAMRHGVTASELGDGIYTHPATSEIFNQLLGS

SEQ ID NO: 23758 - protein, 280 aa, Corynebacterium glutamicum ATCC 13032
MSRYDDLFARLDTAGEGAFVPFIMLSDPSPEEAFQIISTAIEAGADALELGVPFSDPVADGPTVAESHLRALDGGATVDSALEQIKRVRAAYPEVPIGMLIYGNVPFTRGLDRFYQEFAEAGADSILLPDVPVREGAPFSAAAAAAGIDPIYIAPANASEKTLEGVSAASKGYIYAISRDGVTGTERESSTDGLSAVVDNIKKFDGAPILLGFGISSPQHVADAIAAGASGAITGSAITKIIASHCEGEHPNPSTIRDMDGLKKDLTEFISAMKAATKKV

SEQ ID NO: 23759 - protein, 361 aa, Corynebacterium glutamicum ATCC 13032
MTSLLTPIAIRGLEIPNRMWLAPMCQYQANNLDGVPLDWHLVHYGARAVGGFGLLIAESTGISPEGRISSRCTGLWNEAQVEAWERITNFVHAQGGLIGVQLNHAGRKASTYPALPNFPTGTQSVDEGGWETFGPSGVAQPGLADPTELTREGIEKVIQDFAAAAERAVRAGFDAVEVHGAHGYLLHQFLTPVANKRTDIYGGSFENRTRLFREVAQAIRAVIPGSMPLIARISATDWIDDEPSWDDDQTVSLVSDLKKLGVDAVDISTGGAVPATIPVEPSYQVKFARRVKQEVGIPTSAVGLITHVGQAQGHLDRGDADIISLGRAALRYPSWPLFAAHELGKTRDEIPYPPSYVRGAW

SEQ ID NO: 23760 - protein, 360 aa, Corynebacterium glutamicum ATCC 13032
MSKLFTPIQIRDITIPNRVWMSPMCTYSAATGSGLPTDFHQAHYAARAAGGVGLVMVEATGVNPVAPISPVDLGLWSHDQIEPFSRVTAAIRAGGAVPAVQLAHAGRKASTDAPWNGGGYVGPETNGWETVGPSPLAFPGLPAPRELTVSEIQEVVQQFAGAAVRADQAGFDVVEIHAAHGYLLHNFLSPISNKRTDSYGGSLENRARIVLEVIDAIRAVWPEEKPVFMRISTTDWVEENPQDDRESWTLSQSRQLALWASEHGVDLIDASSGGLDIVPIPHDRDYQTAKAADLHASTGVTVAAVGRIDDAQTAHNLVDSGDVNAVFLGRPLLKDPSWANQAALALGAEPRYVHQYDYVL

SEQ ID NO: 23761 - protein, 508 aa, Corynebacterium glutamicum ATCC 13032
MTDIKATSSTSATTAPTAGRPARRLGQISLVACLGGLLFGYDTGVANGAEGHMAQELGLNVLQLGVVISSLVFAAAFGALFAGRISDEIGRRKAIITLSVLFFLGSILVVFSPAGELGQFYGPGFATLVTGRIMLGLAVGGASTVVPVYLAELAPLEIRGSLTGRNELAIVTGQLLAFVINALIAVTLHGVIDGIWRIMFAVCALPAVALFLGMLRMPESPRWLVNQGRYDDARRVMETVRTPERAKAEMDEIIAVHSENNAALPGVKQSSGQASGQVSSKHTHMSIGEVLSNKWLVRLLIAGIGVAVAQQLTGINAIMYYGTRVLEESGMSAEMAVVANIAFGAVAVIGGLIALRNMDRLDRRTTFIIGLSLTTTFHLLIAAAGTLLPEGNSIRPFAIMILVVGFVLSMQTFLNVAVWVWLAEIFPVRMKGIGTGISVFCGWGINGVLALFFPALVSGVGITFSFLIFAVVGVIALAFVTKFVPETRGRSLEELDHAAFTGQIFKKA

SEQ ID NO: 23762 - protein, 338 aa, Acinetobacter calcoaceticus
MHPIVIIGSGMAGYTLDREFRKLNPEHELDMICADDAVNYAKPTLSNALSGNKAPEQIPLGDAEKMSTQLKLQILSETWVKAINPETHELKLEKNGQETIQPYSKLVLAVGANPTRLAIAGDGSDDIHVVNSLIDYRAFRENLAKRQDKRVVILGAGLIGCEFANDLQHTGHQVTVIDLSPRPLGRLLPAHIADAFQKIWRKRIHFVLSTTVEKVSKINDGQDYAVTLANGQTLVADIVLSAIGLQPNIDLAKHAGVHTSRGILTNSLLETNLEDTYAIGDCAEVNGTLLPYEMPIMQQARALAKTLSGETTHVHYPAMPVAVKTPAAPLTVASCTCG

SEQ ID NO: 23763 - protein, 505 aa, Streptomyces thioluteus
MLVPLTTADFLDRAEATAAARTALVDEPHQPAAALPTSTYGETLRRVRAWQAGLDALGIDEGERVAVVSPNSARLLELLYAVTASGRICVPVNYRLTPEEISYILRQCDASVVFVDPDVEAVLGSVDVPKRFVLGEQTETEVMRFDVAPRPWSRPDENAVATLNYTSGTSARPKGVALTHRSIWLNAMTFGVHARIWEGDVYLHTLPTFHCNGWGVPFLLAGLGAKQVLIRRIDGAEILRRVQEHGVTLAFGAPAVWDAVLQAARDWPGEIPGRGRVRVVCAGAPVSAQLVSRIENELGWEFLQVYGLTETTLLTFNRRLPDAPGDGGLTRAGAPALGVRLRTGERGEVLARSNMVLDSYWRDEQANEAALEDGWFRTGDVGAFDDEGHLALFDRVKDVIVTGGESVSSVEVEDCLQGHPSIAEVAVIGVPDERWGETVKAVVVPADGARVTEEEVITYCKQQLARYKAPTSVDFRDALPRTSNGKIQKGRLREPYWAGHDRRIH

SEQ ID NO: 23764 - protein, 322 aa, Dendrobium hybrid cultivar
MEKLNNYMAVLRDACENWGFFSHFQATLSHELMDKVEHISERYIKKFREQKFKDICSHNSGNFCNTQVNDIDWESTFYLRHRPTSNISKSPEDLDDQYRKLMKEFAAQIERLSEQLLDLLCENLGLEKAYLKNAFYGANGCNPTFGTKVSNYPPCPKPELIKGLRAHTDAGGIILLFQDDTVSGLQLLKDEEWIDVPPMRHSVVVNLGDQLEVITNGKYKSVMHRVIAQTDGNRMSIASFYNPGSDAVIYPAPTLVEKEKETYPKFVFEDYMKLYVRQKFEAKEPRFEAMKTMDAVISSQPIPTAPLPLEAIRGGGYPGDLL

SEQ ID NO: 23765 - protein, 490 aa, Corynebacterium glutamicum ATCC 13032
MTINVSELLAKVPTGLLIGDSWVEASDGGTFDVENPATGETIATLASATSEDALAALDAACAVQAEWARMPARERSNILRRGFELVAERAEEFATLMTLEMGKPLAEARGEVTYGNEFLRWFSEEAVRLYGRYGTTPEGNLRMLTALKPVGPCLLITPWNFPLAMATRKVAPAIAAGCVMVLKPARLTPLTSQYFAQTMLDAGLPAGVLNVVSGASASAISNPIMEDDRLRKVSFTGSTPVGQQLLKKAADKVLRTSMELGGNAPFIVFEDADLDLAIEGAMGAKMRNIGEACTAANRFLVHESVADEFGRRFAARLEEQVLGNGLDEGVTVGPLVEEKARDSVASLVDAAVAEGATVLTGGKAGTGAGYFYEPTVLTGVSTDAAILNEEIFGPVAPIVTFQTEEEALRLANSTEYGLASYVFTQDTSRIFRVSDGLEFGLVGVNSGVISNAAAPFGGVKQSGMGREGGLEGIEEYTSVQYIGIRDPYAG

SEQ ID NO: 23766 - protein, 304 aa, Corynebacterium glutamicum ATCC 13032
MKIFVGFGDYPLTTKALKEAGAEIVDSLEKAEGFVFTQTPGTEFPLLPDGVRWVQFPNAGLNAYFTAGQIDDKRRWSNASGVYGQQVAEAAMALLLGLIHMHPTMVRADSWAPSTQIDQQTRWLDGATVAIVGAGGIGKHLAAMLKPFGAKSLAVSRTGTPTQDFDATEPISNLHQVLADADHVVLCVPLTADTYHLIGKAELKAMQSTAILINVARGEVVDTEALVDALDAQEISGAGLDVTDPEPLPDDHPLWGRSNVIITPHVANTLTSMDRMLAPVVAENYRRFLAGEKMLTEVDIHKGY

SEQ ID NO: 23767 - protein, 1152 aa, Corynebacterium glutamicum ATCC 13032
MTSMNLPIELATLSDQAVDKVRSWLEYSKKESVPNADAKRLAAVLQDPNGLEFTVGFVDRVVRTEDREAAAHALYELGKIAPSTMSFLDRAQIQAGSLVGRALPQVVVPAARARIRQMVGHMIVDARDKQFAKAVAEIQSDGHRLNINLLGEAVLGRKEAAKHLDDTVRLLRRPDVEYVSIKVSSVASQISMWGFEDTVNYVVEQLTPLYIEAARAPKGTKFINLDMEEYRDLRLTMEVFKRLLSNPELHELEAGIVLQAYLPDALGAIQDLAQFGRERVNTGGAGVKVRLVKGANLPMEHVHAQITGWPVATEPSKQATDANYKRVLYWTMRKENMEGLRLGVAGHNLFDIAFAHLLSVERGVADRVEFEMLQGMASDQARAVSVDVGELLLYVPAVRPQEFDVAISYLVRRLEENAASENFMSAIFDLDADNPSFKREESRFRASISDLATLIDVPAPGPNHTQDRSKETLLDAPLVPFINEPDTNPALIQNQQWATKAVATAAEPGWLEKQTKPEVLEEGDVDKLINDVRDAAEAWAARPARERAEILYKTAEILRVRRGHLISVTAAEVGKAVEQTDPEISEAIDFARYYAHLALELDDVDNAEFTPDRVVVVTPPWNFPIAIPAGSTFAALAAGAGVIHKPSKPSQHCSAAVVEALWEAGVPREVLHCIYPANRDVGCALISHEHVDRVILTGSSETAAMFSSWRPELTINGETSGKNAIVVTPSADRDLAVADLVKSAFGHAGQKCSAASLGILVGSVYESERFRKQLVDAASSLIVDWPTNPSATVGPLTELPSDKLHHALTTLEEGESWLLKPRQLDDTGRLWSPGIKEGVKPGTFFHLTEVFGPVLGLMKATDLNEAIEFQNGNDFGLTGGLQSLDADEVRTWLDHVDVGNAYVNRGITGAIVQRQSFGGWKKSSVGLGSKAGGPNYVMLMGTWADAPSHHAPRETNPLISKLDLPGEELEWLEKANASDETAWNTEFGSPRDPSGLDVEANIFRYRPAEVVLRLDDSATPRETARALLAARRAGVTPRVLQTPGVSEQVREVLSAAGVSAETVDDSVFISNVLRGEYDENSSVRVRYLGKVSDTVRERLSVRPEVVLLDDAVTASGRVELRYWLKEQAISMTLHRFGNPVAAFHELAEELKR

SEQ ID NO: 23768 - protein, 308 aa, Corynebacterium glutamicum ATCC 13032
MPKASRIVVMLLHPDAQFYIDTLPTLSAEEQVSFGKDAPVSEADATHVATDQDIAGVPVRVYTPLSGAGDLPCLVYFHGGGWSGGTLNMIDATVHSLVVGLPIIAISVDYRLAPAHPFPAAIDDAFAVVSAVLDGVSGLSIDTSRVAIGGDSAGGNIAAVTAQQLRERAVGSTPVLAHQVLIFPVTDVSTTSTPSYLTFGKDCYLTKDAMERYIEQYADGHDRTDPRLSPLLASDLSDLPPTTIVYGECDVLAHEVRAYGQALLEAGNSVTMTEFKGQIHAFINLGGISSDARAARRLIRAELEAALC

SEQ ID NO: 23769 - protein, 339 aa, Corynebacterium glutamicum ATCC 13032
MTCDREGRHIPSKMSEGLHRHMTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYRPMFWESPEEATKQAEWALQHSTVAVGNKEECEIAVGETEPERAGRALLERGVELAIVKQGPKGVMAMTKDETVEVPPFFVDVINGLGAGDAFGGALCHGLLSEWPLEKVLRFANTAGALVASRLECSTAMPTTDEVEASLNQKV

SEQ ID NO: 23770 - protein, 491 aa, Corynebacterium glutamicum ATCC 13032
MASTFIQADSPEKSKKLPPLTEGPYRKRLFYVALVATFGGLLFGYDTGVINGALNPMTRELGLTAFTEGVVTSSLLFGAAAGAMFFGRISDNWGRRKTIISLAVAFFVGTMICVFAPSFAVMVVGRVLLGLAVGGASTVVPVYLAELAPFEIRGSLAGRNELMIVVGQLAAFVINAIIGNVFGHHDGVWRYMLAIAAIPAIALFFGMLRVPESPRWLVERGRIDEARAVLETIRPLERAHAEVADVEHLAREEHAVSEKSMGLREILSSKWLVRILLVGIGLGVAQQLTGINSIMYYGQVVLIEAGFSENAALIANVAPGVIAVVGAFIALWMMDRINRRTTLITGYSLTTISHVLIGIASVAFPVGDPLRPYVILTLVVVFVGSMQTFLNVATWVMLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 23771 - protein, 506 aa, Corynebacterium glutamicum ATCC 13032
MADPQGFIKYSRREPAHRPVPLRLMDHSEVYEKAPAGQIEEQAARCMDCGVPFCHEGCPLGNIIPEWNDLVRQGRWKEAYDRLHATNNFPEFTGRLCPAPCEGACVLGINDDSVTIKNVELEIVEKAFREGWVQPVIPSMSTGLSVAVVGSGPAGLAAAQQLTRAGHSVTVFERDDRLGGLMRYGVPEYKMENRWIDRRIEQMEAEGTTFQVGTSPRAAELALFDAILLATGTPVARELSVPGHDLNGIHAAMDYLTAQNRINEGDGEVSPINAKGKKVVIIGGGDTGTDCFGTALRQGAESVTQFDIRPRAPFQRADSTPWPMYPNLFRTATAHEEGEYIITGDESADEIAALGLAERAAGSTLGERKFAVNTVEFHGNNGHVTGLTGNQIRVVNGKREPIEGTEFPFEADLVLVALGFTGAEQGGLAHELGVGFDDRGRILRDSEYRSPTNSRVYIAGDNGRGQSLIVWAIAEGRACAAAIDADLMGETALPVAVAPQDVPLAV

SEQ ID NO: 23772 - protein, 318 aa, Corynebacterium glutamicum ATCC 13032
MQAIVQTEEKVTASLELQEVPVPTLKPGEVLVEVKAAGVNRADLLQTQGNYPVPAGASEILGLECAGVIVDAGDTGQTVGQEVACLLTGGGYAQYVAVPEGQLMPIPEGYSFVEAASIVEVACTVWSNIGMLAGLQKEDTFLIHGGAGGIGTFAIQMGKALGVTVAVTAGSTEKLKTCKNLGADILINYKEEDFAEVLKNKADVILDIIGAKYLSQNVKAMAKDAHMVVIGMQGGVKGELNLGHLLAKRGTISATALRGRDEADKARIVSSTVENIWPLLQSKEITPHIDHTLPLAEAAAALQKIQDGTITGKLVLAV

SEQ ID NO: 23773 - protein, 339 aa, Corynebacterium glutamicum ATCC 13032
MPKYIAMQVSESGAPLAANLVQPAPLKSREVRVEIAASGVCHADIGTAAASGKHTVFPVTPGHEIAGTIAEIGENVSRWTVGDRVAIGWFGGNCGDCAFCRAGDPVHCRERKIPGVSYAGGWAQNIVVPAEALAAIPDGMDFYEAAPMGCAGVTTFNALRNLKLDPGAAVAVFGIGGLVRLAIQFAAKMGYRTITIARGLEREELARQLGANHYIDSNDLHPGQALFELGGADLILSTASTTEPLSELSTGLSIGGQLTIIGVDGGDITVSAAQLMMNRQIITGHLTGSANDTEQTMKFAHLHGVKPLIERMPLDQANEAIARISAGKPRFRIVLEPNS

SEQ ID NO: 23774 - protein, 510 aa, Corynebacterium glutamicum ATCC 13032
MNLGIGSYPRRRATVRPESTAIEFEGTSITYGEFSKRVNRLGHALLDLGVAHQDRVAYVGFNHPALLEVFFSTNLIGATPVLVNPRLSANEIDYIIQDSGASIVFYGIDLIEHATYLQELHPEIIMVAVEGDEGPGLRRKALIEAASDADIDLEVSDDDIALLMYTSGTTGRPKGAMLSHRNLFFNYFNALLSQEIEQGAVLLSTAPLFHIAGLNMTTIPVMMKGGKVIIHREFRAEHVLDEIERSKVSESFMVPAMIDMLSNHPSFAERDLSSLRAIMVGGSPLSERALRIWQGRDVKIVQGFGMTETAPGACILEATDTSTHLGTAGRAHFFTDIKLVDPKTGEEVPTGEAGEVLIRGPHVMTGYWNRPEDTASALQNGWYHSGDIAIKDEDGYYTIKDRIKDMYISGGENIYPAEVEQALQELEAVLDAAVIGVPDERWGETGIAFVSIRESYLTNPPTGPELRELLGSVLARYKLPREIHIIEELPRNATGKIQKNILRDFTIPVS

SEQ ID NO: 23775 - protein, 398 aa, Corynebacterium glutamicum ATCC 13032
MRDPIQGAVIPSDLFGFAEVLTEAERAVLLETRRVLEEEVKPYINEAWDKAVFPDEIVQPLQDLQLLDPPALREAGESVRDIFTGFRNFELARCDINVGTYYNASAGLFRTACMVGGSPEQAQRLDAQIKSGEVKGVFALTEPDHGSDIAGGLATTATKDADTGEWIINGEKRWIGGASTADLIATFARDTADNQVKCFLVAPQAEGVSMEIIDRKASLRIMQNAHITYNNVRVSGDARLHNINSFKDVSECLRRMRSDVAWMAVGAQAGAYEAAVKYVRSREQFGRPIAGFQLIQEKLALMLGNLTASLGMMVKLTDQQQAGIFKEENSALAKMFTSLKLRETASWAREICGGNGIILDNDVARFHADAEAVYSYEGTHEINALIVGRAITGVSAFI

SEQ ID NO: 23776 - protein, 368 aa, Corynebacterium glutamicum ATCC 13032
MSTVVPGIVALSKGAPVEKVNVVVPDPGANDVIVKIQACGVCHTDLAYRDGDISDEFPYLLGHEAAGIVEEVGESVTHVEVGDFVILNWRAVCGECRACKKGEPKYCFNTHNASKKMTLEDGTELSPALGIGAFLEKTLVHEGQCTKVNPEEDPAAAGLLGCGIMAGLGAAVNTGDIKRGESVAVFGLGGVGMAAIAGAKIAGASKIIAVDIDEKKLEWAKEFGATHTINSSGLGGEGDASEVVAKVRELTDGFGTDVSIDAVGIMPTWQQAFYSRDHAGRMVMVGVPNLTSRVDVPAIDFYGRGGSVRPAWYGDCLPERDFPTYVDLHLQGRFPLDKFVSERIGLDDVEEAFNTMKAGDVLRSVVEI

SEQ ID NO: 23777 - protein, 353 aa, Corynebacterium glutamicum ATCC 13032
MSISVKALQKSGPEAPFEVKIIERRDPRADDVVIDIKAAGICHSDIHTIRNEWGEAHFPLTVGHEIAGVVSAVGSDVTKWKVGDRVGVGCLVNSCGECEQCVAGFENNCLRGNVGTYNSNDVDGTITQGGYAEKVVVNERFLCSIPEELNFDVAAPLLCAGITTYSPIARWNVKEGDKVAVMGLGGLGHMGVQIAAAKGAEVTVLSRSLRKAELAKELGAARTLATSDEDFFTEHAGEFDFILNTISASIPVDKYLSLLKPHGVMAVVGLPPEKQPLSFGALIGGGKVLTGSNIGGIPETQEMLDFCAKHGLGAMIETVGVNDVDAAYDRVVAGDVQFRVVIDTASFAEVEAV

SEQ ID NO: 23778 - protein, 469 aa, Corynebacterium glutamicum ATCC 13032
MTEHYDVVVLGAGPGGYVSAIRAAQLGKKVAVIEKQYWGGVCLNVGCIPSKSLIKNAEVAHTFTHEKKTFGINGEVTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASFPFSANGKAVGLAETDGFAKIVADAEFGELLGAHLVGANASELINELVLAQNWDLTTEEISRSVHIHPTLSEAVKEAAHGISGHMINF

SEQ ID NO: 23779 - protein, 248 aa, Corynebacterium glutamicum ATCC 13032
MTNGKLILLRHGQSEWNASNQFTGWVDVNLTEQGEAEAKRGGELLVEAGVLPGVVYTSLLRRAIRTANIALNAADRHWIPVIRDWRLNERHYGALQGLDKAATKEKYGDDQFMEWRRSYDTPPPELADDAEYSQANDPRYADLDVVPRTECLKDVVVRFVPYFEEEILPRAKKGETVLIAAHGNSLRALVKHLDGISDADIAELNIPTGIPLVYEIAEDGSVVNPGGTYLDPEAAAAGAAAVANQGNK

SEQ ID NO: 23780 - protein, 350 aa, Corynebacterium glutamicum ATCC 13032
MSSIKLRDLSVSFRDGTFGLQDINLKIEPEEFVVLIGPSGSGKTTMLRTIAGFVEPSSGSVLIGGEDMTHVPPERRRMGMVFQQHAVWPHMSVAKNVGYPLARSGQKGASISKRVERTLALVGLEGFGSRRPASLSGGQRQRVALARAIIADPTVLLLDEALSALDEPLRDALRRELVSLTRREGLTTVHVTHDRAEAISIADRIVVLGNGRIQQVATPTELLSAPATADVARFIVDATVLNGIVRNGRVMCPDLDTSWDLDAVQAIDDIFDGDLVDIAIPPHSVDIGPAHHPDYIFAEITSVLFQVTSYSVTAKTQSGHSFRMSITCSLPEIGETIGLSIDNPMVYRAD

SEQ ID NO: 23781 - protein, 453 aa, Corynebacterium glutamicum ATCC 13032
MSNRHLQLIAIGGAIGTGLFMGSGKTISVAGPSVILVYAIIGFMLFFVMRAMGELLLANLNYKSLRDAVSDILGPGAGFVTGWTYWFCWIATGMADIVAITGYTQYWWPEIPLWLPGVLTIALLFALNLAAVRLFGEMEFWFAIIKIVAIVSLIVVGLFMVVTAFESPNGTTAQFNNLIEHGGFFPNGITGFLAGFQIAIFAFVGIELAGTAAAETENPTKTLPRAINSIPIRIVVFYVLALAVIMMVTPWDQVRADNSPFVQMFALAGIPAAAGIINFVVITSAASSANSGIFSTSRMLYGLSLEGAAPKRWSRLSKNLVPARGLTFSVICLIPAVGLLYAGGTVIEAFTLITTVSSVLFMVVWSYILVAYIVYRRNSPELHKKSIFKMPGGVVMAVVVLVFFAAMLVVLSLEPDTRAALIATPVWFIILGIGWLSIGGAKGAKHRSQITSH

SEQ ID NO: 23782 - protein, 453 aa, Corynebacterium glutamicum ATCC 13032
MSLTFPVINPSDGSTITELENHDSTQWMSALSDAVAAGPSWAAKTPRERSVVLTAIFEALTERAQELAEIIHLEAGKSVAEALGEVAYGAEYFRWFAEEAVRLPGRYGQSPSGIGHIAVTRAPVGPVLAITPWNFPIAMATRKIAPALAAGCPVLVKPASETPLTMVKVGEIIASVFDTFNIPQGLVSIITTTRDAELSAELMADPRLAKVTFTGSTNVGRILVRQSADRLLRTSMELGGNAAFVIDEAADLDEAVSGAIAAKLRNAGQVCIAANRFLVHESRAAEFTSKLATAMQNTPIGPVISARQRDRIAALVDEAITDGARLIIGGEVPDGSGFFYPATILADVPAQSRIVHEEIFGPVATIATFTDLAEGVAQANSTEFGLAAYGFSNNVKATQYMAEHLEAGMVGINRGAISDPAAPFGGIGQSGFGREGGTEGIEEYLSVRYLALP

SEQ ID NO: 23783 - protein, 497 aa, Corynebacterium glutamicum ATCC 13032
MNAATRRASLQLPYTHVDDFYINGSWVKAEGTQRNPVVDPAVGQEWGSVPEATASELDSAVGAARTALKSWSALTGAERTGYLLKIATEIESRSEALALTNTRENGSPISETRGAASNAAGIFRYFATLAPWLDGEDIRPFPAGSAESIVDKDPIGVCALIAPWNFPINLVVIKLAPALLAGCTVIIKPASPTPLSIRFIIEAIEAAGVPAGVVNLLTGSGRFGDALVRHPGVDKVAFTGSTPVGKKIAAACGELLRPVTLELGGKSSAIILPDADMSVLSTRLIRSCMRNTGQTCYISTRIIAPSSRYAEVVQTVASTIAAGRQGDPYDEETVFGPVASASQYSTVMSYIDSAREEGARVVAGGTRSISLSEGLESGEFIQPTVFADVTPDMRISREEIFGPVISILKYDDTNGVSEAIALANNTKFGLGGLVFGADEEQALEVARQVDSGSVGINFFGSNHSAPFGGRHESGMGVEYGIEGLSAYLTYKSIHRTI

SEQ ID NO: 23784 - protein, 422 aa, Corynebacterium glutamicum ATCC 13032
MNTSAETGILIIGANQSGVQLAISLRATGFTESITLLGEEDHRPYQRPALSKEFLQDKIDKERLIFRSNEYWEENNIRLVKGVRIERIEKNDDGSGVAYGAGQEFAFRRLALAVGARPRHLDLPGATLEGVTYLRNADDALALKAMIGSVTDAVVVGGGFIGLEAACSLHDLGKNVTVLEYGPRLIGRAVGEETAAFFLEQHRSRGVNIVLDARMKQFVGKDGKLSGIELEDGTVIPAQLVIVGIGVIPNTELAAVLGLDINNGIVVDKHAVASDGTTIAIGDVANIPNPIPGSPADERIRLESVNNAIEHAKIAAYSLVGQPEAYAGIPWFWSNQGDLKLQIAGLTLGYDSTVIRQDPEKKKFSVLYYRGDNIIAADCVNAPLDFMAVRSALSRNQNIPADLAADISQPLKKLAVDLEVTR

SEQ ID NO: 23785 - protein, 181 aa, Corynebacterium glutamicum ATCC 13032
MRLVLLGPPGAGKGTQAAILSEKLGIPHISTGDLFRANIGEGTPLGIEAKQYIDAGKLVPTDVTARMVASRLAESDAAEGFLLDGFPRTVEQADILANLLSEAGQTLDGVVNYQVSEDVVVERMLSRGRADDNEETIRTRLGVYRDETAPLIDHYGDKIINIEAEGEVEEINARTLKALGK

SEQ ID NO: 23786 - protein, 506 aa, Corynebacterium glutamicum ATCC 13032
MTTQSRVSTGGDNPNKVALVGLTFDDVLLLPDASDVVPSEVDTSTQLTRNIRLNTPILSAAMDTVTEARMAIGMARHGGIGVLHRNLSIQEQAENVELVKRSESGMVTDPVTCTPDMSIQEVDDLCARFRISGLPVVDEAGKLVGICTNRDMRFESDMNRRVAEVMTPMPLVVAEEGVTKEQALALLSANKVEKLPIIAKDGKLVGLITVKDFVKTEQHPNASKDASGRLLVAAGIGTGEESFQRAGALADAGVDILVVDSAHAHSRGVLDMVSRVKKSFPKVDIVGGNLATREAAQAMIEAGADAIKVGIGPGSICTTRVVAGVGAPQITAIMEAAVPAHKAGVPIIADGGMQFSGDIAKALAAGANSVMLGSMLAGTAEAPGETITINGKQYKRYRGMGSMGAMQGRGLSGEKRSYSKDRYFQSDVKSEDKLVPEGIEGRVPFRGPIGDIIHQQVGGLRAAMGYTGSSTIEELHNARFVQITSAGLKESHPHHIQQTVEAPNYH

SEQ ID NO: 23787 - protein, 469 aa, Corynebacterium glutamicum ATCC 13032
MAKRIVIIGGGPAGYEAALAGAKYGAEVTVIEDVGVGGSAVTMDCVPSKSFIAGTGIKTDLRRADDMGLNRGLGKAHLEIDALNIRVKDLAKAQSEDILGQLQRSDVRMINGVGRFDDYNTKQTTHYIKVTHSDGSEETVECDLVLVATGATPRILKGAEPDGERILTWRQVYDIEELPTHLIVVGSGVTGAEFVSAFAELGVKVTMVASRDRILPHDDADAADVLETVLAERGVSLEKHARVESVTRTEDGGVCVRTADGREIYGSHALMTVGSIPNTADLGLENIGVELAPSGHIKVDRVSRTNIPGVYAAGDCTDLFPLASVAAMQGRIAMYHALGEGVSPIRLKTVATAVFTRPEIAAVGITHAQVDSGEVSARVIVLPLATNPRAKMRSLRHGFVKLFCRRNSGLIIGGVVVAPTASELILPIAVAVTNRLTVADLADTFAVYPSLSGSITEAARQLVQHDDLG

SEQ ID NO: 23788 - protein, 486 aa, Corynebacterium glutamicum ATCC 13032
MTSGKSTSTRGALDRYFKISERGSSIGTEIRAGVVTFFAMAYIIILNPLILGTTPDVEGNTLGIAQVAAATALAAGVMTIAFGLIARYPFGIAAGLGINTMVAVTLVSGEGLTWPEAMGLVVLDGVVIVILAVSGFRVAVFRAIPASMKAAISVGIGLFIAMIGLVDAGFVRRIPDAAGTTVPVTLGIDGSIASWPTFVFVVGVLLCGILVVRRVRGGLFIGILGTTILAIIAEAIFDSGASFENGEANAEGWSLAVPGLPDSFGGIPDLSIVGAVDLIGAFSRIGVVAATLLIFTLVLANFFDAMGTMTALGKQGNLVDDEGNLPDIKKALVVEGAGAIVGGAFSASSNTVFADSSAGVADGARTGLANVVTGSLFLAAMFLTPLYEIVPIEAAAPVLVVVGAMMMGQVTEIDFSKFYIAFPAFLTIVIMPFTYSIANGIGVGFIMYAIMAAAAGKAKQVHWLMWLVAGLFVVFFAIDPIMEAVG

SEQ ID NO: 23789 - protein, 168 aa, Corynebacterium glutamicum ATCC 13032
MGMTQSAPEFIATADLVDIIGDNAQSCDTQFQNLGGATEFHGIITTVKCFQDNALLKSILSEDNPGGVLVIDGDASVHTALVGDIIAGLGKDHGWSGVIVNGAIRDSAVIGTMTFGCKALGTNPRKSTKTGSGERDVVVSIGGIDFIPGHYVYADSDGIIVTEAPIKQ

SEQ ID NO: 23790 - protein, 425 aa, Corynebacterium glutamicum ATCC 13032
MAEIMHVFAREILDSRGNPTVEAEVFLDDGSHGVAGVPSGASTGVHEAHELRDGGDRYLGKGVLKAVENVNEEIGDELAGLEADDQRLIDEAMIKLDGTANKSRLGANAILGVSMAVAKAAADSAGLPLFRYIGGPNAHVLPVPMMNIINGGAHADSGVDVQEFMIAPIGAETFSEALRNGAEVYHALKSVIKEKGLSTGLGDEGGFAPSVGSTREALDLIVEAIEKAGFTPGKDIALALDVASSEFFKDGTYHFEGGQHSAAEMANVYAELVDAYPIVSIEDPLQEDDWEGYTNLTATIGDKVQIVGDDFFVTNPERLKEGIAKKAANSILVKVNQIGTLTETFDAVDMAHRAGYTSMMSHRSGETEDTTIADLAVALNCGQIKTGAPARSDRVAKYNQLLRIEQLLGDAGVYAGRSAFPRFQG

SEQ ID NO: 23791 - protein, 431 aa, Corynebacterium glutamicum ATCC 13032
MSTTTPTRATKSVGTVLALLWFAIVLDGFDLVVLGATIPSMLEDPAWDLTAGQATQISTIGLVGMTIGALTIGFLTDRLGRRRVMLFSVAVFSVFTLLLAFTTNVQLFSLWRFLAGVGLGGALPTAIAMVTEFRPGTKAGSASTTLMTGYHVGAVATAFLGLFLIDGFGWHSMFIAGAVPGLILLPLLYFFLPESPQYLKISGKLDEAQAVAASYGLSLDDDLDREHEEELGESSSLSSLFKPSFRRNTLAIWGTSFMGLLLVYGLNTWLPQIMRQADYDMGNSLGFLMVLNIGAVIGLYIAGRIADKNSPRKTALVWFVFSAFSLALLAVRMPLIGLYGIVLLTGIFVFSSQVLIYAFVGENHPAKMRATAMGFSAGIGRLGAISGPLLGGLLVSANLAYPWGFFAFAGVGLLGALIFSASKTLRHRENA

SEQ ID NO: 23792 - protein, 470 aa, Corynebacterium glutamicum ATCC 13032
MEMVMKNKRVAIIGAGPSGIAQLRAFESAEKQGHEIPELVCFEKQDTWGGQWNYSWRTGTDSYGEPVHSSMYRNLWSNGPKEVLEFAEYSFDEHFGKPISSYPPREVLWDYIAGRAKKSNVEKYIKFAHVVRWVSFDEATKLFTVTVENLRTGETSSDTYDNVIVGAGHFSFPNVPHFDGVETFPGQIMHAHEFRGAEAVADKDILLIGASYSAEDIGTQAYKMGARSVTFSYRSNPMGYEWPEEMTELPLVERFDGSEVHFVNGEKRKVDIVVFCTGYLHHYPFMPSELTLSSPNNLYPDTLYRGVVSEANNQLFWLGAQDQWLTFNMFDAQAWYVRDVILGRVALPSKEAQRNHMDKWLSRFEGLKSENDQIDFQCDYVEDLIDQTDYPSFDLKEVANILKGWVKSKEEDILNYRDYTYTSVMTGTTSVEHHTPWMIELDDSLERYLSEPQEDEARQVYRGKKVRDKA

SEQ ID NO: 23793 - protein, 468 aa, Corynebacterium glutamicum ATCC 13032
MNASPAPTRSFKGLRARHIHFIALGSAIGTGLFYGSAGAIQAAGPSVLLVYLLGGAVVYFMLRALGEMAVHHPVRGSFAVYTRAHLGGWAGYITGWMFAFEMLIVCLADLTAIGIYMNFWFPGTPQWTWVVATLLIVGGANLASVRWFGELEFIFTIIKVTAVVAMIVGGAAILAFGLGANAEVAGVSNLWEHGGFFPNGVEGMIAAFILVLFAFGGTEIIGVAGSEAEDPEKSIPKAVNTVPVRILLFYVGAILVILALNPWPSITGEESPFVQIFDTLGVNWAAGLLNAVVITAALSAINADLFGAGRVLTGLAKENLAPKAMGKIAKNGVPVMTTTIMIIVLIVGVILNAVLPERVFEIVASLATFATVYVWLMILLAQVGSRRNMPADEVKSLKFPVPFYPFGQYFAILFIAFTFGIMVWYDNYHLPLAVGVGFLVLMTILYYATGRPKAIAPIDYEELDPRRD

SEQ ID NO: 23794 - protein, 335 aa, Corynebacterium glutamicum ATCC 13032
MSTQVELKTPKSEDRAAYIAALGFPVLVIIGGIIGFTASDVVLNISSWVNPLLGIIMFSMGLTLKPVDFALVAKRPLPVLIGVIAQFVIMPLIALLVVWVLQLPAEIAAGVILVGCAPGGTSSNVVSYLSRGDVALSVTMTSISTLLAPIFTPLLTLWLAGQYMPLNAADMAVSIVQVVLIPVVGGLVVRLIFPTLIGKVLPLLPWISVIAISLIVAIVVAGSRDKILEAGLLVLAAVIIHNTLGYSLGYLAAKFTGQPAAARRTTAIEVGMQNSGLAAGLASQYMSPMSALPGAIFSVWHNLSGALLAALCRASDKRAAEKVASEKAASEKAAS

SEQ ID NO: 23795 - protein, 254 aa, Corynebacterium glutamicum ATCC 13032
MSQLMIDAQQVCKNYGRLEVLKGIDLQVPKGTVTCLIGPSGSGKSTMLRCVNHLEKVNAGRLYVDGDLIGYRERDGVLYEISEKDAAKQRSDIGMVFQNFNLFPHRTVIENIIEAPIHVKKQPESKARARAMELLEQVGLAHKADAYPVQLSGGQQQRVAIARAVAMEPKLMLFDEPTSALDPELVGEVLRVMKQLADDGMTMLVVTHEMGFAHEVADQVVFMADGVVVEAGTPEQVLDNPKEQRTKDFLSSLL

SEQ ID NO: 23796 - protein, 391 aa, Corynebacterium glutamicum ATCC 13032
MSTLETWPQVIINTYGTPPVELVSGKGATVTDDQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLKAVRELCDEYGILMITDEVQTGVGRTGDFFAHQHDGVVPDVVTMAKGLGGGLPIGACLATGRAAELMTPGKHGTTFGGNPVACAAAKAVLSVVDDAFCAEVARKGELFKELLAKVDGVVDVRGRGLMLGVVLERDVAKQAVLDGFKHGVILNAPADNIIRLTPPLVITDEEIADAVKAIAETIA

SEQ ID NO: 23797 - protein, 492 aa, Corynebacterium glutamicum ATCC 13032
MPSSTINNMTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDRSEVEA

SEQ ID NO: 23798 - protein, 247 aa, Corynebacterium glutamicum ATCC 13032
MSTVTAVQVNGLKVSISSGFSRKKTKTILHDLDFTVETGKITGLLGPSGSGKTTLMRAIVGVQNFDGTLEVFDQPAGAASLRGKIGYVTQNASVYHDLSVIENLKYFGALAKGTSTPRTPEKILEVLDIADLAQRQVSTLSGGQRGRVSLGCALIASPELLVMDEPTVGLDPITRQALWEEFTTIAKAGAGVVISSHVLEEAARCDNLILLRDGRIIWRGTPTRLLEDTGKSSYEDAFLAAIDGVRS

SEQ ID NO: 23799 - protein, 259 aa, Corynebacterium glutamicum ATCC 13032
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 23800 - protein, 405 aa, Corynebacterium glutamicum ATCC 13032
MAVKTLKDLLDEGVDGRHVIVRSDFNVPLNDDREITDKGRIIASLPTLKALSEGGAKVIVMAHLGRPKGEVNEKYSLAPVAEALSDELGQYVALAADVVGEDAHERANGLTEGDILLLENVRFDPRETSKDEAERTAFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKATCTDLLARFGDKIVLPVDLVAASEFNKDAEKQIVDLDSIPEGWMSLDIGPESVKNFGEVLSTAKTIFWNGPMGVFEFAAFSEGTRGIAQAIIDATAGNDAFSVVGGGDSAASVRVLGLNEDGFSHISTGGGASLEYLEGKELPGVAILAQ

SEQ ID NO: 23801 - protein, 219 aa, Corynebacterium glutamicum ATCC 13032
MAQRTPLIAPSILAADFSRLGEQVLAVPDADWIHVDIMDGHFVPNLSFGADITAAVNRVTDKELDVHLMIENPEKWVDNYIDAGADCIVFHVEATEGHVELAKYIRSKGVRAGFSLRPGTPIEDYLDDLEHFDEVIVMSVEPGFGGQSFMPEQLEKVRTLRKVIDERGLNTVIEIDGGISAKTIKQAADAGVDAFVAGSAVYGAEDPNKAIQELRALAQ

SEQ ID NO: 23802 - protein, 242 aa, Corynebacterium glutamicum ATCC 13032
MIKMTGVQKYFGDFHALTDIDLEIPRGQVVVVLGPSGSGKSTLCRTINRLETIEEGTIEIDGKVLPEEGKGLANLRADVGMVFQSFNLFPHLTIKDNVTLAPIKVRKMKKSEAEKLAMSLLERVGIANQADKYPAQLSGGQQQRVAIARALAMNPKIMLFDEPTSALDPEMVNEVLDVMASLAKEGMTMVCVTHEMGFARKAADRVLFMADGLIVEDTEPDSFFTNPKSDRAKDFLGKILAH

SEQ ID NO: 23803 - protein, 1004 aa, Corynebacterium glutamicum ATCC 13032
MPGKLRVHELAKQLGITSKELLATLKDKGEFVKTASSTIEPPVVKRMQEHYGSSGSDKSDTAAKPAAAKPAAPKPAASAARKPGAPAKPAAPAAKPAPAAPSAASAAKPGAAPKPGVQAKPAAAAKPGAPAKPAAPAAPSAAKSGSAPKPAAAAKPAFSGPTPGDAAKKAEPAAKPGAEAPRPGGMPRPMGKPAPKPGARAPRVANNPFSTGGGERPAPRPGGGPRPGGGPRPGGGPRPQGQGRPGGQRDGQRDGQRDGQGNRGGQRQGAGAGGPRPQGGPRPQGGSRPQGGSAQGAQGAPSQERQGGGRRPSPAMMPPTPGQMPAKAPGKGGRGGQAGGGAGGGFNRGGGTGGGAGRGGRRGGTAGAFGRPGGAPRRGRKSKRQKRNEYESMQAPNVIGGVRLPDGKGATIRLARGASLADFADKIGADAAALVQALFNLGEMVTATASVSDETLQLLGEEMNYKVQVVSPEDEDRELLESFDLQFGEDEGGEADLAKRPPVVTVMGHVDHGKTRLLDTIRKANVGSDEAGGITQGIGAYQVKVNVEDTERTITFLDTPGHEAFTAMRARGAKSTDIAVLVVAADDGVMPQTVEAINHAKAADVPIVVAVNKIDKPEASPEKIRGQLTEYGLIPEEYGGDTIFVDISAKQGLNIDELLASVCLTADAELDLVANPEMDAQGVAIEAHLDRGRGPVATVIVQRGTLRVGDSIVAGDTYGRVRRMVDEYGRDVEEAGPSRPVQVQGLNGVPGAGDNLLVVEDDRIARQIANQRNARKRNALAARSRKRVSLEDLDSVLKEHSTLNLILKGDNAGSVEALEEALLKIEMDDEVQLNIIDRGVGAVTQTNVTLAAASDAVIIAFNVRAEGKATEEANAEGVDVRYYTIIYRAIEEVEAALKGMLKPIYEERVIGHAEIRAIFKASSVGLIAGCMVEDGKVRRNATVRIIRDGNVIAENAKIVSLRREKDDATEVSAGYECGMVLSYPDISVDDKIEVYEMVEVPREA

SEQ ID NO: 23804 - protein, 465 aa, Corynebacterium glutamicum ATCC 13032
MSEQPASIKHYDLIIIGTGSGNSIPGPEFDDKSIAIVEKGAFGGTCLNVGCIPTKMYVYAADIAQEIQESARLGIDATVNSVDWPSIVSRVFDKRIDLIAQGGEAYRRGPETPNIDVYDMHASFVDSKTISTGIAGQEQLISGTDIVIATGSRPYIPEAIAESGARYYTNEDIMRLAQQPESLVIVGGGFIALEFAHVFEALGTKVTILNRSDVLLREADADISAKILELSKKRFDVRLSTAVTAVHNKADGGVKISTDTGDDIEADILLVATGRTPNGNQMNLDAAGIEMNGRSIKVDEFGRTSVEGVWALGDVSSPYKLKHVANAEMRAIKHNLANPNDLQKMPHDFVPSAVFTNPQISQVGMTEQEAREAGLDITVKIQNYSDVAYGWAMEDKDGFVKLIADKDTGKLVGAHIIGAQASTLIQQLITVMAFGIDAREAATKQYWIHPALPEVIENALLGLEF

SEQ ID NO: 23805 - protein, 477 aa, Corynebacterium glutamicum ATCC 13032
MGVDRRTKIVCTLGPAVASADGILRLVEDGMDVARLNFSHGDHPDHEQNYKWVREAAEKTGRAVGILADLQGPKIRLGRFTDGATVWENGETIRITVDDVEGTHDRVSTTYKNLAKDAKPGDRLLVDDGKVGLVCVSVEGNDVICEVVEGGPVSNNKGVSLPGMDISVPALSEKDIRDLRFALKLGVDFIALSFVRSPADAELVHKIMDEEGRRVPVIAKLEKPEAVTSLEPIVLAFDAVMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRVARLHSHLPLLVFTPNEAVRSELALTWGATTFLCPPVSDTDDMMREVDRALLAMPEYNKGDMMVVVAGSPPGVTGNTNMIHVHLLGDDTRIAKL

SEQ ID NO: 23806 - protein, 118 aa, Corynebacterium glutamicum ATCC 13032
MSDNPQEYELDWDVEKRLKLNDAGLVPAIVQADGTNEVLMMAWMDTHALAYTLATRRGTYFSRSRNEYWIKGLTSGNVQEVTGLALDCDGDTVLLTVKQTGGACHTGAHTCFDNDVLL

SEQ ID NO: 23807 - protein, 317 aa, Corynebacterium glutamicum ATCC 13032
MNRDSFQSIDELIGKTPLVRLGRFNANTSINLWAKMESYNPGGSAKDRTAHAMVLASDLRPGDTVVESSSGNLGIALSREAVLGGWTFHCVVDSRANRNTIAHMKALGTIVHEITEPDYETGDWLVARRKRVAQLRAQMSEAICLDQYSNTAAFQAHEQGTMTEIVEQLGGAPDYLLVAVSTTGTIGGCLGYVAAHGLSTQVIAVDAVGSVLFDGNAGPRHLPGFGAGMVPELSKHLSPHRVFRIDDRTSVEAARKMAQTEAILPGASGGAVLAAMEILRPDIPAGSNVVVILHDDGNKYLDTIYNDEWVEENLCSR

SEQ ID NO: 23808 - protein, 477 aa, Corynebacterium glutamicum ATCC 13032
MAFETPEEIVKFIKDENVEFVDVRFTDLPGTEQHFSIPAASFDADTIEEGLAFDGSSIRGFTTIDESDMNLLPDLGTATLDPFRKAKTLNVKFFVHDPFTREAFSRDPRNVARKAEQYLASTGIADTCNFGAEAEFYLFDSVRYSTEMNSGFYEVDTEEGWWNRGKETNLDGTPNLGAKNRVKGGYFPVAPYDQTVDVRDDMVRNLAASGFALERFHHEVGGGQQEINYRFNTMLHAADDIQTFKYIIKNTARLHGKAATFMPKPLAGDNGSGMHAHQSLWKDGKPLFHDESGYAGLSDIARYYIGGILHHAGAVLAFTNATLNSYHRLVPGFEAPINLVYSQRNRSAAVRIPITGSNPKAKRIEFRAPDPSGNPYLGFAAMMMAGLDGIKNRIEPHAPVDKDLYELPPEEAASIPQAPTSLEASLKALQEDTDFLTESDVFTEDLIEAYIQYKYDNEISPVRLRPTPQEFELYFDC

SEQ ID NO: 23809 - protein, 446 aa, Corynebacterium glutamicum ATCC 13032
MNSEQEFVLSAIEERDIKFVRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 23810 - protein, 324 aa, Corynebacterium glutamicum ATCC 13032
MSKTEEGRSAAIIIYAFPTFILLGAIIAFIFPEPFIPLTNYINIFLTIIMFTMGLTLTVPDFQMVLKRPLPILIGVVAQFVIMPFLAIVVAKMFNLNPALAVGLLMLGSVPGGTSSNVIAFLARGDVALSVTMTSVSTIVSPIMTPFLMLMLAGTETAVDGGGMAWTLVQTVLLPVIIGLVLRVFLNKWIDKILPILPYLSILGIGGVVFGAVAANAERLVSVGLIVFVAVIVHNVLGYVVGYLTGRVFKFPEAANRTMAIEIGTQSAGLASGMAGRFFTPEAALPGAVAALVHNITGAVYVGLVRNRPLTKASRKKESVAVSS

SEQ ID NO: 23811 - protein, 250 aa, Corynebacterium glutamicum ATCC 13032
MSHMINKSISSTAEAVADIPDGASIAVGGFGLVGIPTALILALREQGAGDLTIISNNLGTDGFGLGLLLLDKKISKSIGSYLGSNKEYARQYLEGELTVEFTPQGTLAERLRAGGAGIPAFYTTAGVGTQVAEGGLPQRYNTDGTVAVVSQPKETREFNGQLYVMEEGIRADYALVHAHKADRFGNLVFRKTAQNFNPDAAMSGKITIAQVEHFVDELHPDEIDLPGIYVNRVVHVGPQETGIENRTVSN

SEQ ID NO: 23812 - protein, 446 aa, Corynebacterium glutamicum ATCC 13032
MASQISGGWQSAKHRTTVYMVLVVVGISILFDGYDLVIYGAVLSTLLEDPTQIGALSPAVAGTLGSYAMIGVMIGALSAGAVGDRLGRRKVMLTAIVWFSVGMALTAFASSIALFGFLRFLTGLGVGMIVATGGAIIAEFAPANRRNLFNAIVYSGVPAGGVLASILALLFEDVIGWRGLFLIGGSPLLFLLPLAYFFLPESPRWLTSRGRAADAKALCARYGLPTEEFVVEKQQETKGTGFAGIFSSKYLMGTILIGAMSFIGLLSTYGLNTWLPKIMESNGATSHDSLYSLLFLNGGAVFGGLIASWFADRIGAKTVITSTFALAAICLGVLPNISSWPMMYTAIAFAGVGVLGTQVLTYGLTSNFFGTECRAAGVAWCAGFGRLGGIVGPAIGGLIIGAGFGPSSAFLIFAAAAAIGAVCTLLIPRSPAEVEVKVAQEPLARV

SEQ ID NO: 23813 - protein, 413 aa, Corynebacterium glutamicum ATCC 13032
MLTMPIPEYLHEILDDVRDTTSGELADYIPELKSADPNPLAVALCTVNGHIYSAGDDDIEFTMQSISKPFAYALALQECGFDEVSASVALEPSGEAFNELSLDGENRPMNPMINAGAIAINQLINGSDSTVEDRVEKIRHYFSELAGRELTIDRVLAESELAGADRNLSIAHMLRNYGVIEDEAHDAVLSYTLQCAIKVTTRDLAVMTATLAAGGTHPITGKKLLDARVCRLTLSVMASAGMYDEAGQWLSTVGIPAKSGVAGGLIGILPGQLGIATFSPRLNPKGNSVRGVKIFKQLSDDMGLHLMSTEQVSGHAVRSITRDGDTTFIQMQGAMNFSASESFLHAIVEHNFEGTEVVLDLTRVLSFHPVAIRMIKEGLKRIRDAGFEVFILDPDDVLPDFMFSDGTICKERV

SEQ ID NO: 23814 - protein, 446 aa, Corynebacterium glutamicum ATCC 13032
MNTNPSEFSSNRSTALLTDKYELTMLQAALADGSAERPSTFEVFSRRLPNERRYGVVAGTARVLKAIRDFVFTEEQLADLDFLDDRTLEYLRNYRFTGQVDGYREGEIYFPQSPLLTVRGTFAECVILETVILSIMNADSAVASAAARMVTAADGRPIIEMGSRRTHEYSAVTASRAAYLAGFSTTSNLEAAYRYGIPASGTSAHAWTLLHINDDGTPNEAAAFKAQVESLGVDTTLLVDTYDITQGVATAIEVAGPDLGGVRIDSGDLGVLARKVRKQLDDLNAHNTKIVVSSDLDEFAIAGLRGEPVDVFGVGTSVVTGSGAPTAGLVYKIVEVAGHPVAKRSRNKESYGGGKKAVRTHRKSGTAIEEIVYPFNAEAPDTGKLDTLSLTIPLMRDGEIVPGLPTLEDSRAYLAKQLVSLPWEGLALSRDEPVLHTRFVGFPPAA

SEQ ID NO: 23815 - protein, 311 aa, Corynebacterium glutamicum ATCC 13032
MGNVYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 23816 - protein, 159 aa, Corynebacterium glutamicum ATCC 13032
MTSIHDISVTLNDGTETTMADWAGHLLLIVNVASKCGLTPQYEGLQKLYEEYQDRGFFVIGVPCNQFNGQEPGTDAEVCAFAQNQYDVTFPLLSKTEVNGEGAHPLYKVLKEATDGSEIEWNFEKFLVDAEGNTIKRFAPRTEPSAAEVVEAIEENLPI

SEQ ID NO: 23817 - protein, 423 aa, Corynebacterium glutamicum ATCC 13032
MENPSLRELDHRNIWHPYAAPGVRNRLVTKTDGVFLTLEDGSTVIDAMSSWWSAIHGHGHPRLKAAAQKQIDTMSHVMFGGLTHEPAIKLTHKLLNLTGNSFDHVFYSDSGSVSVEVAIKMALQASKGQGHPERTKLLTWRSGYHGDTFTAMSVCDPENGMHSLWKGTLPEQIFAPAPPVRGSSPQAISEYLRSMELLIDETVSAIIIEPIVQGAGGMRFHDVALIEGVATLCKKHDRFLIVDEIATGFGRTGELFATLSNGLQPDIMCVGKALTGGFMSFAATLCTDKVAQLISTPNGGGALMHGPTFMANPLACAVSHASLEIIETGMWQKQVKRIEAELIAGLSPLQHLPGVADVRVLGAIGVIEMEQNVNVEEATQAALDHGVWIRPFGRLLYVMPPYITTSEQCAQICTALHAAVKGK

SEQ ID NO: 23818 - protein, 464 aa, Corynebacterium glutamicum ATCC 13032
MAKKVRSVHECSECGYSSPKWLGRCPECGSWGSMEERTVGESGGAARAAVSGAAPAGLTPTSPAVPIGKIVASQATSISTGIGELDRVLGNGIVPGSVVLMAGEPGVGKSTLLLEVASRWASMKEGDGTRTALYVTAEESAGQVRLRAERTAAVKDTLYLAAESNLDVVFGHVNQVKPSLLIVDSVQTMHAAGVEGVAGGVAQSRAVTAALTTLAKTSGIPILLVGHVTKDGNVAGPRVLEHLVDVVLNFEGDRHSSLRMLRGIKNRFGATDEVGCFEQQSDGIKEVPDPSGLFLSHRGSTPDGTAVTVAMDGVRPLLAEVQSLLVDAPSKNPRRVVTGLDANRVPMVLAVLSARAGRQTQGKDAYVATVGGMKVGEPATDLAVALATASALAKKPLPDKTVVLGEVGLAGEIRRVPNVDRRLAEAERLGYEKAVIPGGSGIKQTSLRVIEASTLAEALAAVSL

SEQ ID NO: 23819 - protein, 496 aa, Corynebacterium glutamicum ATCC 13032
MVKYPQSTLGDLVTATFAGIDATKHLIGGQWVEGNSDRISTNINPYDDSVIAESKQASIADVDAAYEAAKKAQAEWAATPAAERSAIIYRAAELLEEHREEIVEWLIKESGSTRSKANLEITLAGNITKESASFPGRVHGRISPSNTPGKENRVYRVAKGVVGVISPWNFPLNLSIRSVAPALAVGNAVVIKPASDTPVTGGVIPARIFEEAGVPAGVISTVAGAGSEIGDHFVTHAVPKLISFTGSTPVGRRVGELAINGGPMKTVALELGGNAPFVVLADADIDAAAQAAAVGAFLHQGQICMSINRVIVDAAVHDEFLEKFVEAVKNIPTGDPSAEGTLVGPVINDSQLSGLKEKIELAKKEGATVQVEGPIEGRLVHPHVFSDVTSDMEIAREEIFGPLISVLKADDEAHAAELANASDFGLSAAVWSKDIDRAAQFALQIDSGMVHINDLTVNDEPHVMFGGSKNSGLGRFNGDWAIEEFTTDRWIGIKRS

SEQ ID NO: 23820 - protein, 477 aa, Corynebacterium glutamicum ATCC 13032
MRFLNNSNPPYELTYSDVFMVPSRSDVGSRMSVDLRTNDGTGTTIPLVVANMTAVAGRRMAETIARRGGMAILPQDVPADIAAETIANVKKADLVFDTPITVKPHHTVGYARNLIHKRAHGAAIVLEGDQPVGIVTDKDLEGADNFTQVGTLMSTSLLTLPEDISPEDAFGILHEHSRKLAPVVAADGSLRGILTRTGALRATMYKPAIDANGRLRVGAAIGINGDIEGRTKTLLDAGADVLVVDTAHGHQSTMISALKRIRALDVNVPIVAGNVVTADGVRDLVEAGANIIKVGVGPGAMCTTRMQTGVGRPQFSAVLECAAEARKLGAHVWADGGVRDPRDVALALAAGASNVMVGSWFSGTYESPGDLRFESDGRMYKESFGMASRRAVESRNQKVEAFEKARRAMFEEGISTARIYIDKRHGGVEDLVDQIISGVRSSFTYAGADSIETFFERATVGVQSTEGYAEGKPRASR

SEQ ID NO: 23821 - protein, 200 aa, Corynebacterium glutamicum ATCC 13032
MSNNVEMADHKDLNVPANPYGTDIESVLISEEKLKQRIAEMAKRVSEEFKDAEEDLILVCVLKGAFYFLADFSRMLDIPTQSEFMAVSSYGNSTSSSGVVRILKDLDKEIEGRDVLIVEDIIDSGLTLSWLMRNLKNRNPKSLNVITLLRKPERLTTNIDMFDIGFDIPNEFVVGYGLDFAERYRDLPYVGTLEPHVYSD

SEQ ID NO: 23822 - protein, 411 aa, Corynebacterium glutamicum ATCC 13032
MSTPQSIVIIGGGLAGAKTAEALRVNGYEGSITLIAAEDYLPYERPPLSKEYMAGKVGFDKAIVHPAEWYKENNVTLRQGVRATAIDAGSRQVTVDDGGNTETINYDKLVLATGSAVRKLPIPGADASNVHYLRTVEDSDAIKATFGEGKKLVLIGGGWIGLEVASAARGAGTDVTVLEGGKLPLLKVLGETVAQVFADLHVANGVDLRTEVKITDIVTEDGRAVGVRLDDGEVVPADAVVIGIGVTPVIDLAETAGLEIDNGVLVDAALRTSDPDIYAVGDIANHDHPVLGHRIRVEHWATALNQPAAAVKSLLGKDAEFTNLPYFFTDQFDLGCEYVGHATGSQEKVFIRGNLETREFVAFWVDTENRILAAMNVNVWDVPDQIKPLIASGKSVDTEKLVDPEVPYSEL

SEQ ID NO: 23823 - protein, 455 aa, Corynebacterium glutamicum ATCC 13032
MSRPLRVAVVGAGPAGIYASDLLMKSDTDVQIDLFERMPAPFGLIRYGVAPDHPRIKGIVKSLHNVMDKEQLRFLGNIEVGKDITVEELREFYDAIVFSTGATGDQDLRVPGSDLEGSWGAGEFVGFYDGNPNFERNWDLSAEKVAVVGVGNVALDVARILAKTGDELLVTEIPDNVYESLAKNQAKEVHVFGRRGPAQAKFTPLELKELDHSDTIEVIVNPEDIDYDAASEQARRDSKSQDLVCQTLESYAMRDPKGAPHKLFIHFFESPVEILGEDGKVVGLKTERTQLDGNGGVTGTGEFKTWDMQSVYRAVGYRSDAIEGVPFDDERAVVPNDGGHIIDPEVGSPITGLYATGWIKRGPIGLIGNTKSDAKETTEMLLADHAAGSLPAPAKPELESIIEFLDERKVAFTTWDGWHLLDAAERALGEPEGRERKKIVEWNDMVRHARPEYDI

SEQ ID NO: 23824 - protein, 506 aa, Corynebacterium glutamicum ATCC 13032
MTVYANPGTEGSIVNYEKRYENYIGGKWVPPVEGQYLENISPVTGEVFCEVARGTAADVELALDAAHAAADAWGKTSVAERALILHRIADRMEEHLEEIAVAETWENGKAVRETLAADIPLAIDHFRYFAGAIRAQEDRSSQIDHNTVAYHFNEPIGVVGQIIPWNFPILMATWKLAPALAAGNAIVMKPAEQTPASILYLINIIGDLIPEGVLNIVNGLGGEAGAALSGSNRIGKIAFTGSTEVGKLINRAASDKIIPVTLELGGKSPSIFFSDVLSQDDAFAEKAVEGFAMFALNQGEVCTCPSRALVHESIADEFLELGVKRVQNIKLGNPLDTETMMGAQASQEQMDKISSYLKIGPEEGAQTLTGGKVNKVDGMENGYYIEPTVFRGTNDMRIFREEIFGPVLSVATFSDFDEAIRIANDTNYGLGAGVWSRDQNTIYRAGRAIQAGRVWVNQYHNYPAHSAFGGYKESGIGRENHLMMLNHYQQTKNLLVSYDPNPTGLF

SEQ ID NO: 23825 - protein, 345 aa, Corynebacterium glutamicum ATCC 13032
MTTAAPQEFTAAVVEKFGHDVTVKDIDLPKPGPHQALVKVLTSGICHTDLHALEGDWPVKPEPPFVPGHEGVGEVVELGPGEHDVKVGDIVGNAWLWSACGTCEYCITGRETQCNEAEYGGYTQNGSFGQYMLVDTRYAARIPDGVDYLEAAPILCAGVTVYKALKVSETRPGQFMVISGVGGLGHIAVQYAAAMGMRVIAVDIADDKLELARKHGAEFTVNARNEDSGEAVQKYTNGGAHGVLVTAVHEAAFGQALDMARRAGTIVFNGLPPGEFPASVFNIVFKGLTIRGSLVGTRQDLAEALDFFARGLIKPTVSECSLDEVNGVLDRMRNGKIDGRVAIRF

SEQ ID NO: 23826 - protein, 457 aa, Corynebacterium glutamicum ATCC 13032
MTTPLRVAVIGAGPAGIYASDLLIRNEEREVFVDLFEQMPAPFGLIRYGVAPDHPRIKGIVKSLHNVLDKPRLRLLGNIEIGKDITVEELRDYYDAVVFSTGAVADRDLNIPGIEAEGSFGAGEFVGFYDGNPRFERSWDLSAQSVAVIGVGNVGLDVARILAKTGDELKVTEISDNVYDSLKENKATEVHVFGRRGPAQVKFTPQELKELDHSPTINVVVDPEDIDYDGASEEARRASKSQDLVCQILEQYAIREPKDAPHTLQIHLFENPVEVLQKDGKVVGLRTERTSLDGNGGVNGTGEFKDWPVQAVYRAVGYKSDPIDGVPFDENKHVIPNDGGHVLTAPGAEPVPGLYATGWIKRGPIGLIGNTKSDAKETTDILIKDAVAGVLEAPKHQGEEAIIELLDSRNIPFTTWEGWYKLDAAERALGEAEGRERKKIVDWEEMVRQAREAPAIV

SEQ ID NO: 23827 - protein, 436 aa, Saccharopolyspora spinosa
MASPNPLRALDEVWRDTYYRRTARSRKANEAAEKFVAKGQRARFNSGMPYPVYIERGAGSHFTDLDGNDFLDCNAGWNAAFLGRGNPTVSATVQEAMAKLGAPGGAMHPSLIRDEFAELLCERVPGAERVIFAPSGSEANTYALRLARSFTGKQKVIRMAGGFHGQHDALLGAQSSKAGTASTAQDNVITVPFNDLDAARSALAEHAGSVAALITEPMMTIPGAVHQRDQFLAGLRAATRQHHVVFVLDEVITGCRFAVGGASEFYDFAAPDLTVMGKMLGGGLPTAAVVGRADIIEQPISASNTHAQNPVTLAAAVAAMRVTEADGYARVAKMGDRLRRELRAVTDELTTPVQVTGDGPCVGIHFVDEEVVDFATAERADHSLWQLLCLGIASHGLGLSSRTFGPTLAWTESDLDVAVKGFSSTLEAISTACASN

SEQ ID NO: 23828 - protein, 403 aa, Saccharopolyspora spinosa
MITKVSNHSEDAASLTERARNVLPGGITRSTVYVPPHPPYAATGSGALVQDVSGHVLVDCNNNYTSLIHGHSSRQEIVEAAVSATRSGTAFGLPTRHEVDFAEYLAARTGVEKWRFCNSGTEAVLMMLRAARAFTQRDTIIRFAGSYHGTGDEVVDPKAAGVPKWVEESVLVVPQGDLDALKDALREHGNRVAAVLIDLMPNRAGLNPATREFVQELRALTRRYGVLLAIDEVISFRLSWGGFHQHYGVEPDLISTGKIIGGGFPVGAVGGKAGFLREFDPARAGAVMWGGTFSANPVTMVAGLTALRLFDQDAISALNAKGESMRGDLEAAGVRVNGFGSLLRIMTSDTKALWWSLYERGVLAGSNGLLALSTAMNDKHLSHVIEAVAEGARNVGDTGTPEQ

SEQ ID NO: 23829 - protein, 476 aa, Saccharopolyspora spinosa
MPAQAAVIDGKLVEGPETLDVLDPSTGTLLDRTLRGTGEHVDAAVAAARAASREWAHTPYSERSAILRRIGELIRRDRGEFALLESQDTGKPLAQACADTDVAARYFEYYANTMEAFFGHSLPPNGDFVAYTRHVPFGVTGHIIPWNYPLQIGCRTIAPAIAVGNCAVVKPAEEAPLSVLKVARTALEAGLPAGVLNVVPGLGAQAGAALAGHAGIDHLSFTGSVPVGAAVAHAAAENVIPVVLELGGKSPNIVFPDADLDAAIPVIVKSMLQNAGQTCSAGSRLLVHEEVRDEVLARIDEALRGVRIGPGPQDLDLGPLISAKQRDRVTQMVQRAADSGARQLGGPGQVELPEGGFYFPPTVFTDVDPAQEIAQEEVFGPVLAAMSFGTVDEAIQLANGTQYGLIAAAWTRNLDVAHVMAEEIRAGQVYLNTYGGGGGVEYTFGGFGKSGYGREKGFEALKGFCQTKTIVTKVTR

SEQ ID NO: 23830 - protein, 401 aa, Saccharopolyspora spinosa
MGHLCETDGLTDVQQEILKTVRSFVEQEILPVANELEHHDEYPAKIVDGLKELGLFGLMIPEEYGGLGESLLIYALCVEEIARGWMSVSGIINTHFIVAYLLLQHGTEEQRRKYLPRMATGEVRAAFSMSEPGCGSDVSAIRTKAVKDDDGDGDYTINGQKMWLTNGGSANLVAVLVRTDEGSDSVYQNMTTFLVDKEAGFGETAQGLTVPGKIEKMGYKGVDTTELVFDGHRISAGQILGGVPGRGFYQMMDGVEVGRVNVAARGCGVALRAFELGVVYAQQRETFGKAIAGHQAVLFRLAEMATKVEAAHQMMVRAARKKDSGQRNDLESGMAKYLASEYCAQVVEDSFRIHGGYGFSKEYEIERLYREAPMLLIGEGTADIQRMIIGRRVLEDYKLNV

SEQ ID NO: 23831 - protein, 475 aa, Dixonia thamnioides
MSPQTETKAGVGFKAGVKDYRLTYYTPDYQTTETDILAAFRMTPQPGVPAEEAGAAVAAESSTGTWTTVWTDGLTSLDRYKGRCYDLEAVPGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQCARELGMPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVIPVASGGIHVWHMPALTEIFGDDSVLQFGGGTLGHPWGNAPGAVANRVAVEACVQARNEGRDLAREGNEIIREAAKWSPELAAACEVWKEIKFEFDTIDTL

SEQ ID NO: 23832 - protein, 475 aa, Dixonia cf. thamnioides Murata et al. 23291
MSPQTETKAGVGFKAGVKDYRLTYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQCARELGMPIVMHDYLTGGFTANTSLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVIPVASGGIHVWHMPALTEIFGDDSVLQFGGGTLGHPWGNAPGAVANRVAVEACVQARNEGRDLAREGNEIIREATKWSPELAAACEVWKEIKFEFETIDTI

SEQ ID NO: 23833 - protein, 475 aa, Dixonia thamnioides
MSPQTETKAGVGFKAGVKDYRLTYYTPDYQTSETDILAAFRMTPQPGVPAEEAGAAVAAESSTGTWTTVWTDGLTSLDRYKGRCYDLEAVPGEDNQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQCARELGMPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVIPVASGGIHVWHMPALTEIFGDDSVLQFGGGTLGHPWGNAPGAVANRVAVEACVQARNEGRDLAREGNEIIREAAKWSPELAAACEVWKEIKFEFETIDTI

SEQ ID NO: 23834 - protein, 174 aa, Populus nigra
MPRDREPLSVGRVIGDVLDPFTRSISLRVNYNSREVNNGCELKPSHVVNQPRVDIGGEDLRTFYTLVMVDPDAPSPSNPNLREYLHWLVTDIPATTGANFGQEVVCYESPRPTAGIHRFVFVLFRQLGRQTVYAPGWRQNFNTRDFAELYNLGSPVAAVYFNCQRESGSGGRRP

SEQ ID NO: 23835 - protein, 174 aa, Populus nigra
MPRDREPLSVGRVIGDVLDPFTRSISLRVNYNSREVNNGCELKPSHVVNQPRVDIGGEDLRTFYTLVMVDPDAPSPSNPNLREYLHWLVTDIPATTGANFGQEVMCYESPRPTAGIHRFVFVLFRQLGRQTVYAPGWRQNFNTRDFAELYNLGSPVAAVYFNCQRESGSGGRRP

SEQ ID NO: 23836 - protein, 174 aa, Malus x domestica
MPRDRDPLVVGRVVGDVLDPFTRSVSLRVTYGTKEVNNGCELKPSEVVQQPRADIGGDDLRTFYTLVMVDPDAPSPSDPNLKEYLHWLVTDIPATTAASFGQEIVCYESPRPTVGIHRFVLVVFRQLGRQTVYAPGWRQNFNTRDFAELYNLGLPVSVVYFNCQREGGSGGRRR

SEQ ID NO: 23837 - protein, 338 aa, Citrus sinensis
MGSIAETVCVTGASGFIGSWLIMRLLERGYAVRATVRDPDNKKKVKHLLELPKASTHLTLWKADLAEEGNFDEAIRGCTGVFHLATPMDFESKDPENEVIRPTINGMVSIMRACKNAKTVRRLVFTSSAGTLDVEEHRKPVYDETSWSDLDFVRSVKMTGWMYFVSKTLAEQAAWKFAEENNIDFISIIPSLVVGPFLTSSMPPSLITALSPITRNEAHYPIIKQGQFVHLDDLCSAHIFLFEHPNAKGRYICSSHPATILELAKFLREKYPEFNVPTEFEDVDENMKNMLFSSKKLTDLGFKFKYSLDDMFTGAVDTCRAKGLLPLLCENHVSEVSI

SEQ ID NO: 23838 - protein, 110 aa, uncultured prokaryote
WTMVAGGGASVVYADTIADFAGIDDLANYGEYSGGPTTGETKFYAETLLDLMTREKDAQGREKILIIGGAIANFTDVAKTFTGIIQAFENYAYKMKEIGVKIYVRRGGPN

SEQ ID NO: 23839 - protein, 110 aa, uncultured prokaryote
WTMVAGGGASVVYADTIADMAGIDDLANYGEYSGGPTTGETKFYAETLLDLMTREPDPQGRGKVMIIGGAIANFTDVAKTFTGIIQAFEVYADKMKAVDLKIYVRRGGPN

SEQ ID NO: 23840 - protein, 110 aa, uncultured prokaryote
WTMVAGGGASVVYADTIADMAGIEDLANYGEYSGGPTTGETKFYAETLFDLMTREKDAEGRGKVLIIGGAIANFTDVAKTFTGIIQAFEEYQEKLKEVGVKIYVRRGGPN

SEQ ID NO: 23841 - protein, 109 aa, uncultured prokaryote
WTMVAGGGASVVYSDTVADLGAVKELANYGEYSGNPTRAETREYVKTVFDLMTRSRHPQGDKILIIGGAIANFTDVAKTFEGIIDAMKEYADKLKEVGVKIYVRRGGPT

SEQ ID NO: 23842 - protein, 111 aa, uncultured prokaryote
WTMVAGGGASVVYADTIADFAGIEDLANYGEYSGGPTTGETRFYAETILDLMTREKDPKGRDKILIIGGAIANFTDVAKTFTGIIQAFEEYADKMKEVGVRVYVRRGGPNY

SEQ ID NO: 23843 - protein, 110 aa, uncultured prokaryote
WTMVAGGGASVVYSDTVADLGYVKELANYGEYSGNPSRAETREYVKTVFDLMARSKHPKGHKILIIGGAIANFTDVAKTFDGIIDAMKEYADKLREIGIRIYVRRGGPNY

SEQ ID NO: 23844 - protein, 110 aa, uncultured prokaryote
WTMVAGGGASVVYADTVADLGAVKELANYGEYSGNPSRTETREYVKTVFDLMTRERHPQGDKILIIGGAIANFTDVAKTFDGIIDAMNEYADKLKEVGVKTYVRRGGPNY

SEQ ID NO: 23845 - protein, 109 aa, uncultured prokaryote
WTMVAGGGASVVYADTIADLAGVEDLANYGEYSGGPTTAETQFYAETIFDLMTRYEDPRGKVLIIGGAIANFTDVAKTFTGIINAFEKYADKLKAHNTKIYVRRGGPNY

SEQ ID NO: 23846 - protein, 110 aa, uncultured prokaryote
WTMVAGGGASVVYADTVADLGQVKELANYGEYSGNPSRAETREYVKTVFDLMTRSKHPAGHKILIIGGAIANFTDVAKTFDGIIDAMKEYADKLKEIGIRIYVRRGGPNY

SEQ ID NO: 23847 - protein, 110 aa, uncultured prokaryote
WTMVAGGGASVVYSDTVADLGYVKELANYGEYSGNPSRAETREYVKTVFDLMTRSKHPKGHKILIIGGAIANFTDVAKTFDGIIDAMREYADKLREIGIRIYVRRGGPNY

SEQ ID NO: 23848 - protein, 110 aa, uncultured prokaryote
WTMVAGGGASVVYADTIADFAGIDDLANYGEYSGGPTTGETKFYAETLLDLMTREKDAQGREKILIIGGAIANFTDVAKTFTGIIQAFENYADKMKEIGVKIYVRRGGPN

SEQ ID NO: 23849 - protein, 111 aa, uncultured prokaryote
WTMVAGGGASVVYADTIADFAGIDDLANYGEYSGGPTTGETKFYAETIFDLMTREPDPQGRGKVLIIGGAIANFTDVAKTFTGIIQAFENYQDKLKEVGTKIYVRRGGPNY

SEQ ID NO: 23850 - protein, 112 aa, uncultured prokaryote
WTMVAGGGASVVYADTIADMAGGVEDLANYGEYSGGPTTDETRFYTETVLDLMTREKDPRGRDKILIIGGAIANFTDVAKTFTGIIQAFEKYADKMKDVGTRIYVRRGGPNY

SEQ ID NO: 23851 - protein, 109 aa, uncultured prokaryote
WTMVAGGGASVVYADTIADLAGVKDLANYGEYSGGPTTAETQFYAETIFDLMTRHKDPRGKILIIGGAIANFTDVAKTFAGIINAFEKYADKLKEHKTKIYVRRGGPNY

SEQ ID NO: 23852 - protein, 111 aa, uncultured prokaryote
WTMVAGGGASVVYADTIADMAGIDDLANYGEYSGGPTTGETKFYAETLLDLMTREPDPQGRGKVMIIGGAIANFTDVAKTFTGIIQAFEVYANKMKEVDLKIYVRRGGPNY

SEQ ID NO: 23853 - protein, 109 aa, uncultured prokaryote
WTMVAGGGASVGYSDTVADLGAVKELANYGEYSGNPTRAETREYVKTVFDLMTRSRHPQGDKILIIGGAIANFTDVAKTFEGIIDAMKEYADKLKEVGVKIYVRRGGPN

SEQ ID NO: 23854 - protein, 109 aa, uncultured prokaryote
WTMVAGGGASVVYADTIADFAGVKDLANYGEYSGGPTTAETQFYAETIFDLMTRHKDPRGKILIIGGAIANFTDVAKTFTGIIKAFEKYADKLKEHGTKIYVRRGGPNY

SEQ ID NO: 23855 - protein, 110 aa, uncultured prokaryote
  misc_feature (92)..(92): Xaa can be any naturally occurring amino acid
  misc_feature (96)..(96): Xaa can be any naturally occurring amino acid
  misc_feature (100)..(100): Xaa can be any naturally occurring amino acid
WTMVAGGGASVVYADTVADLGAVKELANYGEYSGNPSRTETREYVKTVFDLMTRERHPQGDKILIIGGAIANFTDVAKTFDGIIDAMNEYAXKLKXVGVXIYVRRGGPNY

SEQ ID NO: 23856 - protein, 110 aa, uncultured prokaryote
WTMVAGGGASVVYSDTVADLGAVKELANYGEYSGNPSRTETREYVKTVFDLMTRERHPQGDKILIIGGAIANFTDVAKTFDGIIDAMNEYADKLKEVGVKIYVRRGGPNY

SEQ ID NO: 23857 - protein, 109 aa, uncultured prokaryote
WTMVAGGGASVVYADTIADLAGVKDLANYGEYSGGPTTAETQFYAETIFDLMTRHKDPRGKILIIGGAIANFTDVAKTFTGIINAFEKYADKLKEHKTKIYVRRGGPNY

SEQ ID NO: 23858 - protein, 109 aa, uncultured prokaryote
WTMVAGGGASVVYSDTVADLGAVKELANYGEYSGNPTRAETREYVKTVFDLMTRSRHPQGDKILIIGGAIANFTDVAKTFEGIIDAMKEYADKLKEVGVKIYVRRGGPN

SEQ ID NO: 23859 - protein, 111 aa, uncultured prokaryote
WTMVAGGGASVVYADTIADLAGGVEDLANYGEYSGGPTTDETRFYTETVLDLMTREKDPQGRDKILIIGGAIANFTDVAKTFTGIIQAFEKYADKMKDVGTRIYVRRGGPN

SEQ ID NO: 23860 - protein, 111 aa, uncultured prokaryote
WTMVAGGGASVVYADTIADLAGGVAELANYGEYSGGPTTDETRFYTETVLDLMTREKDPQGRDKILIIGGAIANFTDVAKTFTGIIQAFEKYADKMKDVGVRIYVRRGGPN

SEQ ID NO: 23861 - protein, 110 aa, uncultured prokaryote
WTMVAGGGASVVYADTVADLGAVKELANYGEYSGNPSRTETREYVKTVFDLMTRERHPQGDKILIIGGAIANFTDVAKTFDGIIDAMNEYADKLKEVGVKIYVRRGGPNY

SEQ ID NO: 23862 - protein, 108 aa, uncultured prokaryote
WTMVAGGGASVVYADTIADFAGVKDLANYGEYSGGPTTAETEFYAETIFDLMTRHKDPRGKILIIGGAIANFTDVAKTFTGIINALEKYADKLKEHGTKIYVRRGGPN

SEQ ID NO: 23863 - protein, 109 aa, uncultured prokaryote
WTMVAGGGASVVYADTIADLAGVKDLANYGEYSGGPTTAETQFYAETIFDLMTRHEDPRGKILIIGGAIANFTDVAKTFTGIINALEKYADKLKEHKTKIYVRRGGPNY

SEQ ID NO: 23864 - protein, 112 aa, uncultured prokaryote
WTMVAGGGASVVYADTIADLAGGVEELANYGEYSGGPTTDETRFYTETVLDLMTREKDPKGRDKILIIGGAIANFTDVAKTFTGIIQAFEKYADKMKDVGVRIYVRRGGPNY

SEQ ID NO: 23865 - protein, 109 aa, uncultured prokaryote
WTMVAGGGASVVYADTIADFAGVEDLANYGEYSGGPTTGETKFYAETIFDLMTRYDDPRGKVLIIGGAIANFTDVAKTFTGIIQAFEMYADKLKSHKTKIYVRRGGPNY

SEQ ID NO: 23866 - protein, 111 aa, uncultured prokaryote
WTMVAGGGASVVYADTVADLGRVKELANYGEYSGNPSRTETREYVKTVFDLMTREKHESGKPKILIIGGAIANFTDVAKTFDGIIDAMKEYADKLKDVGVRIYVRRGGPNY

SEQ ID NO: 23867 - protein, 112 aa, uncultured prokaryote
WTMVAGGGASVVYADTIADMAGGVEDLANYGEYSGGPTTDETRFYTETVLDLMTREKDPKGRDKILIIGGAIANFTDVAKTFTGIIQAFEKYADKMKDVGTRIYVRRGGPNY

SEQ ID NO: 23868 - protein, 112 aa, uncultured prokaryote
WTMVAGGGASVVYADTIADLAGGVEELANYGEYSGGPTTDETRFYTETVLDLMTREKDPKGRDRILIIGGAIANFTDVAKTFTGIIQAFEKYADKMKDVGVRIYVRRGGPNY

SEQ ID NO: 23869 - protein, 111 aa, uncultured prokaryote
WTMVAGGGASVVYADTIADLAGVEDLANYGEYSGGPTTDETRFYTETVLDLMTREKDPKGRDKILIIGGAIANFTDVAKTFTGIIQAFEKYADKMKDVGTRIYVRRGGPNY

SEQ ID NO: 23870 - protein, 111 aa, uncultured prokaryote
WTMVAGGGASVVYADAIADFAGIADLANYGEYCGGPTTGETKFYAETILDLMTREKDPQGREKILIIGGAIANFTDVAKTFTGIIQAFEEYADKMKDVGDKIYVRRGGPNY

SEQ ID NO: 23871 - protein, 111 aa, uncultured prokaryote
WTMVAGGGASVVYADTVADLGQVEELANYGEYSGNPSRTETREYVKTVFDLMTREKHESGKPKILIIGGAIANFTDVAKTFDGIMDAMKEYADKLKDVGIRIYVRRGGPNY

SEQ ID NO: 23872 - protein, 111 aa, uncultured prokaryote
WTMVAGGGASVVYADTIADMAGIEDLANYGEYSGGPTTGETKFYAETLLDLMTREPDAQGRGKVMIIGGAIANFTDVAKTFTGIIQAFENYADKMKAVDLKIYVRRGGPNY

SEQ ID NO: 23873 - protein, 108 aa, uncultured prokaryote
TMVAGGGASVVYADTIADLAGVKDLANYGEYSGGPTTAETEFYAETIFDLMTRHKDPRGKILIIGGAIANFTDVAKTFTGIINAFEKYADKLKEHKTKIYVRRGGPNY

SEQ ID NO: 23874 - protein, 109 aa, uncultured prokaryote
WTMVAGGGASVVYADTIADLAGVEDLANYGEYSGGPTTGETKFYAETIFDLVTRYEDPRGKVLIIGGAIANFTDVAKTFTGIIQALENYADKLKAHNTKIYVRRGGPNY

SEQ ID NO: 23875 - protein, 111 aa, uncultured prokaryote
WTMVAGGGASVVYADTVADLGQVEELANYGEYSGNPSRTETREYVKTVFDLMTREKHESGKPKILIIGGAIANFTDVAKTFDGIIDAMKEYADKLKDVGVKVYVRRGGPNY

SEQ ID NO: 23876 - protein, 112 aa, uncultured prokaryote
WTMVAGGGASVVYADTIADLAGGVEDLANYGEYSGGPTTDETRFYTETVLDLMTREKDPQGRDKILIIGGAIANFTDVAKTFTGIIQAFEKYADKMKDVGTRIYVRRGGPNY

SEQ ID NO: 23877 - protein, 110 aa, uncultured prokaryote
  misc_feature (20)..(20): Xaa can be any naturally occurring amino acid
  misc_feature (76)..(76): Xaa can be any naturally occurring amino acid
WTMVAGGGASVVYADTIADXAGIDDLANYGEYSGGPTTGETKFYAETLLDLMTREKDAQGREKILIIGGAIANFTXVAKTFTGIIQAFENYADKMKEIGVKIYVRRGGPN

SEQ ID NO: 23878 - protein, 110 aa, uncultured prokaryote
WTMVAGGGASVVYADTIADMAGIDDLANYGEYSGGPTTGETKFYAETLFDLMTREPDPQGRGKVLIIGGAIANFTDVAKTFTGIIQAFENYKDKLKAVDTKIYVRRGGPN

SEQ ID NO: 23879 - protein, 110 aa, uncultured prokaryote
  misc_feature (20)..(21): Xaa can be any naturally occurring amino acid
  misc_feature (76)..(76): Xaa can be any naturally occurring amino acid
WTMGAGGGASVVYADTIADXXGIDDLANYGEYSGGPTTGETKFYAETLLDLMTREKDAQGREKILIIGGAIANFTXVAKTFTGIIQAFENYADKMKEIGVKIYVRRGGPN

SEQ ID NO: 23880 - protein, 110 aa, uncultured prokaryote
WTMVAGGGASVVYADTIADMAGIDDLANYGEYSGGPTTGETKFYAETLLDLMTREPDPQGREKILIIGGAIANFTDVAKTFTGIIQAFENYADKMKAVDLKIYVRRGGPN

SEQ ID NO: 23881 - protein, 109 aa, uncultured prokaryote
WTMVAGGASVVYADTIADFAGIDDLANYGEYSGGPTTGETKFYAETLLDLMTREKDAQGREKILIIGGAIANFTDVAKTFTGIIQAFENYADKMKEIGVKIYVRRGGPN

SEQ ID NO: 23882 - protein, 108 aa, uncultured prokaryote
WTMVAGGGASVVYADIIADLAGVKDLANYGEYSGGPTTAETQFYAETIFDLMTRYKDDRGKILIIGGAIANFTDVAKTFTGIINAFEKYADKPQEHKTKIYVRRGGPN

SEQ ID NO: 23883 - protein, 110 aa, uncultured prokaryote
WTMVAGGGASVVYADTIADFAGIDDLANYGEYSGGPTTGETKFYAETIFDLMTREPDPQGRGKVLIIGGAIANFTDVAKTFTGIIQAFENYQDSLKEVGTKIYVRRGGPN

SEQ ID NO: 23884 - protein, 110 aa, uncultured prokaryote
  misc_feature (22)..(22): Xaa can be any naturally occurring amino acid
WTMVAGGGASVVYADTVADLGXVNELANYGEYSGNPSRTETREYVKTVFKLMTRNKDPQGRPKILIIGGAIANFTDVAKTFDGIIDAMKEYADKLREVGVKIYVRRGGPN

SEQ ID NO: 23885 - protein, 108 aa, uncultured prokaryote
  misc_feature (71)..(71): Xaa can be any naturally occurring amino acid
WTMVAGGGASVVYADTIADLAGVKDLANYGEYSGGPTTAETQFYAETIFDLMTRHKDPRGKILIIGGAIAXFTDVAKTFTGIINAFEKYADKLKEHKTKIYVRRGGPN

SEQ ID NO: 23886 - protein, 110 aa, uncultured prokaryote
  misc_feature (17)..(17): Xaa can be any naturally occurring amino acid
  misc_feature (20)..(20): Xaa can be any naturally occurring amino acid
WTMVAGGGASVVYADTXADXAGIDDLANYGEYSGGPTTGETKFYAETIFDLMTREPDPQGRGKVLIIGGAIANFTDVAKTFTGIIQAFENYQDKLKEVGTKTYVRRGGPN

SEQ ID NO: 23887 - protein, 342 aa, Lycopersicon esculentum
MADECAAFMKGTELPVKRPREEEAETEMEAANNSNNGCEKEESSPYISSVLPGWFSEISPLWPGEAHSLKVEKILFQGKSDYQNVLVFQSSTYGKVLVLDGVIQLTERDECAYQEMITHLPLCSIPNPKKVLVIGGGDGGVLREVSRHSSVEQIDICEIDKMVVEVAKQFFPDVAVGYEDPRVNLHIGDGVAFLKNVPAGTYDAVIVDSSDPIGPAQELFEKPFFESIAKALRPGGVVSTQAESIWLHMHIIEEIVANCRQIFKGSVNYAWTTVPTYPSGMIGFMLCSTEGPAVDFKNPINPIDDESPAKSIEPLKFYNSEIHQASFCLPSFAKRVIETKGK

SEQ ID NO: 23888 - protein, 217 aa, Linum usitatissimum
RIRARYPIIAAHLAPGSESRFDFQKYVNRSLEDDFKVVVGISPILWFFAVLFLLSNTHGWVAYLWLPFIPLIIILVVGTKLQVIITQLGLSIQDRGDVVKGAPVVQPGDDLFWFGRPRLVLFLIHFCLFQNAFQLAFFIWSVYEFGIKTCFHEKTEDIVRASGLVPNRDTSATQTTELSKGKLMMADTCLPTEDLVGMVVTAAHSGKRFFVDSIRYD

SEQ ID NO: 23889 - protein, 231 aa, Neocallimastix frontalis
MGCAQSKNSLRMVIMGPPGSGKGTQAPKVKDTYCICHLATGDMLRAAVKAGTPIGMEAKKIMDAGGLVSDEIVVNLIKENLDTKACRNGFILDGFPRTVAQAQKLDEMLEQRNQKLDTAIELTVDDSLLFKRITGRLVHPASGRSYHKIFNPPKVEGKDDITGEPLIQRSDDTEAALKKRLVAYHKQTVPVAEYYKKKGIWRGVDASQPPAAVWAQMQAIFSERKSQSSKL

SEQ ID NO: 23890 - protein, 232 aa, Neocallimastix frontalis
MGCAQSKNSLRMVVMGPPGSGKGTQAPKVKDTYCICHLATGDMLRAAVKAGTPIGMEAKKIMDAGGLVSDEIVVNLIKENLDTKACKNGFILDGFPRTVAQAQKLDEMLEQRNQKLDTAIELTVDDSLLFKRITGRLVHPASGRSYHKIFNPNQKVEGKDDITGEPLIQRSDDTEAALKKRLVAYHKQTVPVADYYKKKGIWRGVDASQPPAAVWAQMQAIFSEKNKTNSKL

SEQ ID NO: 23891 - protein, 231 aa, Piromyces sp. E2
MGCARSKNWLRMVIMGPPGSGKGTQAPKVKDTYCICHLATGDMLRAAVKAGTPIGLEAKKIMDAGGLVSDEIVVNLIKENLDTKACRNGFILDGFPRTVAQAEKLDEMLEQRNQKLDTAIELTVDDSLLFKRITGRLVHPASGRSYHKIFNSPKVEGKDDITGEPIIQRSDDTEAALKKRLAAYHKQTVPVADYYKKKGIWRGVDASQPPAAVWAQMQAIFSERKSPNSKL

SEQ ID NO: 23892 - protein, 385 aa, Solanum tuberosum
MGVCLFLIWGSNGVSKIQTFVLVDLFASVGQMGSMGFGVSSPNPSDSRDENGGFKLPYSDLCMKYLSFSEGFKIVGNGEEEGVVKEKKKKGGLKIKLKVSNPSLRRLISGAIAGAISRTAVAPLGTIRTHLMVGSSGHSSTEVFNSIMKTEGWTGLFRGNFVNVIRVAPSKAVELFVYDTVNKNLSSKPGEQSKIPIPASLVAGACAGVSSTLLTYPLELVKTRLTIQRGVYNGLLDAFVKILKEGGPAELYRGLTPSVIGVIPYAATNYFAYDSLRKAYRKIFKEEKIGNIETLLIGSAAGAISSTATFPLEVARKHMQVGAVSGRAVYKNVIHALVSILEQDGIHGLYKGLGPSCMKLVPAAGISFMCYEACKRILIEAENEE

SEQ ID NO: 23893 - protein, 478 aa, Streptomyces halstedii
MEDAFGTWTYQELLNHSQAFSAWLDGKGVARGERIVVQLPNIRQTVAVFYGACRRGVVFVPLNPGMKPFHLRSVIADADPRLVIAEDETAADRLRDVTDLPVYSIDSLWADVERLRDAGAGAEAVEVSPEDLAVLIYTSGSTAAPKAVACPHQQIVFAASSINAVLGYHAEDIVFCRMSVSWDFGLYKVLISTLTGAKLVLAGGEPDIALVKSLRESGATMMPIVPSLASMLTTLIRRDPEGAPTLRMFTNSAAALPQVTIDALRSAFPGAQVVRMYGQTECKRISIMPPHLEHERPDSVGLPLPGTTIEILDEDGTLLPPGEPGEITVTGPHVMAGYWRAPEITARAYRRDETTGAMRLHTGDYGHLDEDGFLYFGGRRDDMFKRKGTRMSTVEIEAAALDIPGVTAAVALPPTATRDLALCVASDLEPHDVLRSLAERLEPAKVPATCRIVNDFPLTLNGKSERKQLARLLDGSDK

SEQ ID NO: 23894 - protein, 509 aa, Vicia faba
MLQRSRTLPSKIYQGVIEERKDGRHYIELEPLPKMETETKPITIQSKCLDDDGRVKRTGTFWTASAHIITAVIGSGVLSLSWAIAQLGWAVGPVVMVLFAVVNLYTSTLLTQCYRSDDSVAGPRNYTYTDAVKSILGGKKFKICGVIQYVNLFGVAIGYTIAASVSMMAIKRSNCYHESHGNDPCHMSSNVYMIAFGIAEVILSQIPDFDQVWWLSIVAAIMSFTYSAVGLGLGVAKVAENGTFHGRLMGISIGTVTPAGTVTGTQKVWRSLQALGAMAFAYSFSIILIEIQDTIKSPPAEHKTMKKATMLSIMVTTVFYILCGSMGYAAFGDHVPGNLLTGFGFYNPYWLLDIANFAIVVHLVGAYQVFSQPFFAFVEKWSAHKWPKNKFVTEEYDIPIPCIGVYKLNLFRLIWRTIFVLLTTLIAMLLPFFNDVVGLLGAFGFWPLTVYFPIDMYISQKKIGRWTNRWLGLQMLSGCCLIISTLAAVGSIAGVVLDLKTYKPFKTSY

SEQ ID NO: 23895 - protein, 174 aa, Borrelia miyamotoi
MNYEISTLFTEEKIRNKIQKLAQKIRNYYKDKNNVVFISILKGSFMFFADITREIGLNVKIDFLHVSSYNNKTHSSSKVLIKKDIDVNIENSYVILFDDIIDTGLTYKKIIEHLKSKNPKEIKICTLFNKPSRRLTKLKIDYIGFEIANYFVVGYGIDFNEKHRTLKNVAKINK

SEQ ID NO: 23896 - protein, 420 aa, Streptomyces anulatus
MTITPPALSVFETLESEVRSYCRGWPAVFDRAQGARLTDEDGHSYLDFFAGAGSLNYGHNNPVLKRALIDYIERDGITHGLDMATTAKRAFLETFQNVILRPRDLPYKVMFPGPTGTNAVESALKLARKVKGRESVVSFTNAFHGMSLGSLAVTGNAFKRAGAGIPLVHGTPMPFDNYFDGTVPDFLWFERLLEDQGSGLNKPAAVIVETVQGEGGINVARAEWLRALQELCLRQVMLLIVDDIQMGCGRTGGFFSFEEAGIVPDIVTLSKSISGYGLPMSLCLFKPELDIWEPGEHNGTFRGNNPAFVTAAAVLDAYWADGQMEKQTLARGEQVEQTLLAICAEEPTAQFRGRGLVWGMEFEDKARASAVCARAFELGLLLETSGPQSEVVKLLPPLTITPEELDEGLRTLARCVRETA

SEQ ID NO: 23897 - protein, 334 aa, Agrobacterium tumefaciens
MEFMITVKSSPECHDLITSAINLEMMTFRVNFGRRTIQENLRLISQINEISNGKAKIFVDLPGNKARTGNIPGAELYLKKGERLTLSLTEPSAEIDLGTMTFGLSRPELFGNVKTGSSVSFRDGAAIAQITEATPEKITCVVTRPGVICTSCGVVPVEGYVEYKTLSDIDVIILGMIPEYVFGINVSFADSAIIIRQVKSICRFDHINIIAKIESKIAVDNLIGINEASDGLILARGDLGNFYDEQSVINIAHKIVELRPFQAGPIIFATNYFTEPAKGLALSTSEQATIQEAFKLGVNTILVNETSSSQHWRQVLIAASNFKLNSLESSGLEC

SEQ ID NO: 23898 - protein, 478 aa, Aspergillus oryzae
ATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 23899 - protein, 392 aa, Erwinia chrysanthemi
MNNTRVSSVGTKSLLAAIIATSMMTWSVNAATLQTTKATEAASTGWATQGGGTTGGAKAASAKIYAVKNISEFKAALNGTDTDPKIIQVTGAIDISGGKAYTSFDDQKARSQISVPSNTTIIGIGSNGKFTNGSLVIKGVSNVILRNLYIETPVDVAPHYEEGDGWNAEWDAAVIDNSTRVWVDHVTISDGSFTDDKYTTKDGEKYVQHDGALDIKKGSDYVTISSSRFELHDKTILIGHSDSNGSQDSGKLRVTFHNNVFDRVTERTPRVRFGSIHAYNNVYLGDVKNSVYPYLYSFGLGTSGSILSESNSFTLSNLKSIDGKNPECSIVKQFNSKVFSDNGSLVNGSSTTKLDTCGLTAYKPTLPYKYSAQTMTSSLASSINSNAGYGKL

SEQ ID NO: 23900 - protein, 271 aa, Nicotiana tabacum
MEDYLKQFVEETSFYNRLVLGTFMPESWWGPLPHMLQGWLRNYIGGVLLYFISGFLWCFYIYHLKRNVYIPKDAIPSNKAMLLQISVAMKAMPWYCALPSLSEYMIENGWTKCFARISDVGWLSYVIYAAIYLVIVEFGIYWMHMELHDIKPLYKYLHATHHIYNKQNTLSPFAGLAFHPLDGILQAVPHVVALLLVPMHFSTHIALIFLEALWTANIHDCIHGKVFPVMGAGYHTIHHRTYRHNYGHYTIWMDWMFGTLRDPVEEDAKKM

SEQ ID NO: 23901 - protein, 215 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 23902 - protein, 216 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGV

SEQ ID NO: 23903 - protein, 213 aa, Gossypium hirsutum
YWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 23904 - protein, 217 aa, Gossypium hirsutum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGV

SEQ ID NO: 23905 - protein, 218 aa, Gossypium hirsutum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVD

SEQ ID NO: 23906 - protein, 217 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVD

SEQ ID NO: 23907 - protein, 218 aa, Gossypium hirsutum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 23908 - protein, 491 aa, Mycobacterium avium subsp. paratuberculosis str. k10
MADPSGFLKYTHRELPKRRPVPLRLRDWREVYEEFDHGTLREQATRCMDCGIPFCHNGCPLGNLIPEWNDLVRTGRWRDAIERLHATNNFPDFTGRLCPAPCEPACVLGINQDPVTIKQIELEIIDNAFDEGWVQPLPPDKLTGKKVAVVGSGPAGLAAAQQLTRAGHSVTVFERSDKIGGLLRYGIPEFKMEKRVLDRRLDQMRAEGTEFRAGVNVGVDITADQLRADFDAVVLAGGATAWRDLPIPGRELDGIHQAMEFLPWGNRQASGDLDEADMDADGQPPITAKGKKVIIIGGGDTGADCLGTVHRQGATEVHQFEIMPRPPDTRAPSTPWPTYPLMYRVSSAHEEGGERVFSVNTEEFVGENGRVTALKAHEVTMEDGKFVKVEGSEFELEADLVLLAMGFVGPEKEGLLTDLGVKFTERGNVARGADFDTSIPGVFVAGDMGRGQSLIVWAIAEGRAAAAAADRFLMGATALPAPVKPTAVPLQ

SEQ ID NO: 23909 - protein, 160 aa, Mycobacterium avium subsp. paratuberculosis str. k10
MTVSFRPTADLVDDIGPDVRSCDLQFRQLGGRTEFAGPISTVRCFQDNALLKSVLSEPGGGGVLVVDGGGSLHTALVGDVIAELARANGWAGLIVNGAVRDSAALRGMDIGVKALGTNPRKSTKTGAGERDVDITLGGVTFTPGDIAYSDDDGIVVAVGD

SEQ ID NO: 23910 - protein, 315 aa, Mycobacterium avium subsp. paratuberculosis str. k10
MARIAYLGPEGTFTEAALRQITAAGLVPGQGADGVRPTPVDGTPAALDAVRDGAADYACVPIENSIDGSVTPTLDSLAIGSPLQVFAETTLDVAFSIVVKPGLSAADVRTLAAIGVAAAQVRQWVAANLAGAQLRPAYSNADAAQQVAEGRADAAVTSPLAAARWGLDTLADGVVDEPNARTRFVLVGPPAPPPARTGADRTSVVLRIDNAPGALLAALAEFGIRGIDLTRIESRPTRTGLGIYRFFADCVGHIDDEPVAEALKALHRRCADVRYLGSWPTGTPAGALPPSTEEAVRWLAAVRDGKPEPPGESRR

SEQ ID NO: 23911 - protein, 219 aa, Gossypium hirsutum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 23912 - protein, 323 aa, Mycobacterium avium subsp. paratuberculosis str. k10
MRAIVAESADQLSWQEVADVSAGPGEVVVKVAAAGVNRADVLQAAGKYPPPPGASETIGMEVSGVIAEVGDGVTEWSVGQEVCALLAGGGYAEYVAVPAGQLLPIPAGVDLVDAAGLPEVACTVWSNLVLIAGLRNGQRLLVHGGASGIGSHAIQVAQALGARVAVTAGSAEKLDFCRELGADITINYRDEDFVARLADETRGADVILDIMGAAYLDRNIDALATDGQLVIIGMQGGVKAELNIGKLLAKRARVIGTTLRGRPVSGPNSKTEIVQAVTASVWPMIADGRVRPIIGARLPIQQAGDAHRRLVASEVTGKIVLTV

SEQ ID NO: 23913 - protein, 213 aa, Gossypium hirsutum
GYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRSV

SEQ ID NO: 23914 - protein, 193 aa, Mycobacterium avium subsp. paratuberculosis str. k10
MAPKKALSKVFLEWPVLRQVRSTDKLGRGSAVTSKHTRALAPRTATADRVVQSVCPYCAVGCGQRVYVKDERVVAIEGDPDSPISRGRLCPKGSASEQLVNSPGRQLQVLYRAPRATEWQPLQLDTAIDMIADRFVESRRNSWQDIDKKGNLLRRTMGIAALGGATLDNEENYLIKKLFTAAGAIQIENQARI

SEQ ID NO: 23915 - protein, 203 aa, Mycobacterium avium subsp. paratuberculosis str. k10
MGVAQISSAITPAQPAELYPGDIKSVLLTAEQIQARIAELGREIGDNYRDAATETGQDLLLITVLKGAVIFVTDLARAIPLPTQFEFMAVSSYGSSTSSSGVVRILKDLDRDIQGRDVLIVEDVVDSGLTLSWLLRNLSTRHPRSLRVCTLLRKPDARGAHVDIAYVGFDIPNDFVVGYGLDYDERYRDLSYIGTLDPRVYQQ

SEQ ID NO: 23916 - protein, 474 aa, Mycobacterium avium subsp. paratuberculosis str. k10
MATARSQYRCSECRHVTAKWVGRCLECGTWGTVDEVPALSAVAGRRPRLTAASQAVPITSIKPDASRHRSTGVDELDRVLGGGVVPGSVTLLAGDPGVGKSTLLLEVAHRWAQSGRRALYISGEESAGQIRLRADRIGCGGDQVYLAAESDLHTVLEHIATVKPALVIVDSVQTMSTTEADGVAGGVTQVRAVTAALTAAAKANGVALILVGHVTKDGAIAGPRSLEHLVDVVLHFEGDRNGSLRMVRGIKNRFGAADEVGCFLLHDNGIAGVTDPSNLFLDQRSAPVPGTAITVTLDGKRPLIGEVQALLASPSGGSPRRAVSGIDHSRAAMITAVLEKHGKLPVAVNDIYLSTVGGMRLTDPSSDLAVAIALASALSELPLPTTAVMIGEVGLAGDLRRVSGMARRLSEAARQGFSIALIPDGDDPRREIVPSGMRALRAPTIGAALKHMVDIAEPRKGWTHRALGPQNDTL

SEQ ID NO: 23917 - protein, 375 aa, Mycobacterium avium subsp. paratuberculosis str. k10
MKTKGALIWEFNQPWSIEEIEIGDPQAHEVKIQMEAAGMCHSDHHLVTGGIPMAGFPVLGGHEGAGIVTEVGPGVEDIAPGDHVVLSFIPSCGSCPTCQAGMRNLCDLGAGLLGGEAVSDGTFRIQARGQNVYPMTLLGTFSPYMVVHRSSVVKIDPSIPFEVAALVGCGVTTGYGSAVRTADIRPGQDVAIVGVGGVGMAALQGAVNAGARYIFAIDPVEWKRDQALKFGATHVYPDIMAAMAGMAEVTYGLMAHKVVVTVGELQGADVDNYLNITQKGGTCVLTAIGSLLDTNVTLNLAMLTLMQKNLQGTIFGGGNPQYDIPQLLSMYKAGKLNLDDMITRQYRLEQINDGYQDMLDGKNIRGVIRYTDADR

SEQ ID NO: 23918 - protein, 489 aa, Mycobacterium avium subsp. paratuberculosis str. k10
MALLADGVSELFIDGKMSAGNAGTFPTVNPATEEVLGVAANADAADMDRAIDAARRTFDETDWSRNTELRVRCVRQLRDAMREHIEELRDITIAEVGAPRMLTSAAQLEGPVGDLSFAADTAESYEWNQDLGQASPMGIPTRRTIAREAVGVVGAITPWNFPHQINLAKLGPALAAGNTVVLKPAPDTPWCAAVLGQLIAEHTDFPPGVVNIVTSDDHGVGALLSKDPRVDMVSFTGSTATGRSVMSDAAATIKRVFLELGGKSAFVVLDDADLGGACSMSAFTAAMHAGQGCAITTRLLVPRDRYDEAVAAAAGTMGSIKPGDPNDPGTVCGPVISARQRDRVQSYLDLAIAEGGTFACGGGRPADKDVGFFIEPTVIAGLTNDARPAREEIFGPVLTVIAYDGEEDALRIANDSPYGLSGTVFSADPERAANFASRMRVGTVNVNGGVWYSADAPFGGYKQSGNGREMGLAGFEEYLEIKTIATAVQ

SEQ ID NO: 23919 - protein, 292 aa, Mycobacterium avium subsp. paratuberculosis str. k10
MTTNAAHTTEQLKLGYIGLGNMGAPMATRMTEWPGGVTVYDIRIEAMTPLAEAGATLADSVADVAAADLIHITVLDDAQVREVVGELAGHAKPGTVIAIHSTISDTTAVELARDLKARDIHIVDAPVSGGAAAAARGELATMVGAGREVYERIKPAFKHWAAVVIHAGEPGAGTRMKLARNMLTFTSYAAACEAMKLAEAAGLDLQALGRVVRHTDALTGGPGAIMVRDNMKDLEPDNFLYQPFLHTRGLGEKDLSLALALGEAVSVDLPLARLAYEGLAAGLGVPHTEKEA

SEQ ID NO: 23920 - protein, 302 aa, Mycobacterium avium subsp. paratuberculosis str. k10
MTRGLVIGESLIDIVEDAEYVGGSPLNVAVGLGRLGRDVDFLTYLADDDHGRRIAAYLKDAGVQLVSESRAAERTATARSTIAADGSADYEFDLDWRLSGTPPVAPPLFVHTGSIAAVRDPGCLAVAALIDTYRVSATVTFDPNVRPSLIADRELAVSRIEHLVERSDIVKVSAEDLHWIDPDRSPEQLAQTWLGLGPAIVAVTMADRGAVGYCAAGTARVPTRAVRVVDTVGAGDSFMAGLLDALWEAGLLGGDRRGALRDIGIDTLTSALDAASLSSALTIARAGADLPDRAAVQAALRR

SEQ ID NO: 23921 - protein, 289 aa, Mycobacterium avium subsp. paratuberculosis str. k10
MTGWTAADLPSFAQRTVVITGANSGLGAVTARELARRGATVIMAVRDTRKGEAAARTMAGQVEVRELDLQDLSSVRRFADGVSGADVLINNAGIMAVPYALTVDGFESQIGTNHLGHFALTNLLLPRLTDRVVTVSSMAHWPGRINLEDLNWRSRRYSPWLAYSQSKLANLLFTSELQRRLTAAGSPLRALAAHPGYSHTNLQGASGRKLGDALMSAATRVVATDADFGARQTLYAASQDLPGDSFVGPRFGYLGRTQPVGRSRRAKDAGMAAALWALSEQLTKTEFPL

SEQ ID NO: 23922 - protein, 429 aa, Mycobacterium avium subsp. paratuberculosis str. k10
MPIIEQVGAREILDSRGNPTVEVEIALTDGTFARAAVPSGASTGEHEAVELRDGGERYGGKGVQKAVQAVLDEIGPAVIGLNADDQRLVDQALVDLDGTPDKSRLGGNAILGVSLAVAKAAADSAELPLFRYLGGPNAHILPVPMMNILNGGAHADTAVDIQEFMVAPIGAPSFAEALRWGAEVYHSLKSVLKKEGLSTGLGDEGGFAPDVAGTTAALDLIGRAIESAGFKLGTDVALALDAAATEFYSDGTGYKFEGSTRTAEQMAEFYAGLLGAYPLVSIEDPLSEDDWDGWAALTASIGDRVQLVGDDVFVTNPERLEEGIEKGVANALLVKVNQIGTLTETLDAVALAHHSGYRTMMSHRSGETEDTTIADLAVAVGSGQIKTGAPARSERVAKYNQLLRIEEALGDAARYAGDLAFPRFALETR

SEQ ID NO: 23923 - protein, 468 aa, Mycobacterium avium subsp. paratuberculosis str. k10
MRIAQHISDLIGGTPLVRLNSVVPDGAGIVAAKVEYLNPGGSSKDRIAVRMIDAAEASGALKPGGTIVEPTSGNTGVGLALVAQQRGYKCVFVCPDKVGEDKRNVLMAYGAEVVVCPTAVPPEHPDSYYSVSDRLVTEIEGAWKPDQYANPEGPASHYATTGPEIWADTDGKVTHFVAGIGTGGTITGAGRYLKEVSGGRVRVIGADPEGSVYSGGTGRPYLVEGVGEDFWPQAYDRTVPDEIIAVSDSDSFNMTRRLAREEAMLVGGSCGMAVVAALRVAEQAGPDALVVVLLPDGGRGYMAKIFNDAWMSSYGFLRTRLDGSTDQSRVGDVLRRKSGELPDLVHTHPSETVRDAIGILREYGVSQMPVVGAEPPVMAGEVAGSVSERELLSAVFEGRAKLADAVSLHMSPPLPMIGAGESVSAAGKALRDWDALMVVEEGKPVGVITRYDLLGFLSEGPRGSGGRR

SEQ ID NO: 23924 - protein, 449 aa, Mycobacterium avium subsp. paratuberculosis str. k10
MARLEQTRRLVTEIPGPASLELSKRRAAAVSHAVNVSVPVFVARAGGGIVEDVDGNRLIDLGSGIAVTTIGNSAPRVVDAVRAQVAEFTHTCFMVTPYESYVAVAEMLNRITPGAGDKRSVLFNSGAEAVENAVKVARAYTRKPAVVAFDHAYHGRTNLAMALTAKSMPYKGGFGPFAPEIYRAPLSYPYRDGLLDKELATDGEKAAARAINIIDGQIGADSLAAVIIEPIQGEGGFIVPVEGFLPTLLDWCRRNDVLFIADEVQTGFARSGAMFACEHEGPNGLEPDLICTAKAIADGLPLSAVTGRAQIMDAPHVGGLGGTFGGNPLACAAALATIETIESDGLIERARQLERLITEPLLRLQARDDRIGDVRGRGAMIAIELVKSGTAEPDKDLTQRLSVAAHAAGVIVLTCGMFGNIIRLLPPLTISDELLAEGIDILGGLLADL

SEQ ID NO: 23925 - protein, 496 aa, Mycobacterium avium subsp. paratuberculosis str. k10
MSSPAVPDHHTLIIGAGFSGIGAAIKLDKAGLPDYRVIEAGDGVGGTWHWNTYPGIAVDIPSFSYQFSFEQSRHWSRTYAPGRELKAYAEHCADKYGIRSRIRFNTKVLAAEFDDEPRLWRVHTDPGGTVTARFLISACGVLTVPNLPDIDGVDSFGGITMHTARWDHGQDLSGKRVAVIGTGASAVQVIPEIAPIVKSLTVFQRTPIWRFPKLDVPLPAPARWAMRIPGGKSVQRLLSQAYVEVTFPISAHYFTVLPLAKRMATLGKSYLRQQVRDPEVREKLTPKYAVGCKRPGFHNGYLATFNRDNVRLVTEPIDKITPDAVATTDGEHHRIDVLILATGFKVMDPDNVPTFAVTGPGGRSLSRFWDEHRLQAYEGVSVPGFPNLFTVFGPYGYVGSSYFALIEAQTHHIVRCLKRAERLGAARVEVSEEANARYFAEMMRRRHRQIFWQDSCKLANSYYFDKNGDVPLRPGTTPEVYWRSRRFNLDDYRFSA

SEQ ID NO: 23926 - protein, 320 aa, Mycobacterium avium subsp. paratuberculosis str. k10
MPRLDNPADEKPGIDPILQKVLDAVPFRLSTEDGIDAARQRFRDLPRRPLHPELRVEDRTIPGPQGAIAVRIYWPPSHSESCPAPVVLYFHGGGFVIGDLDTHDGTARQHAVGAGAIVVSVDYRLAPEHPYPAAVEDAWAATLWAAENAAGLHGDPGRIAVAGDSAGGTLAAVTAQRARDRGGPPVRFQLLWYPSTMWDASLPSFAENATAPILDVKAVAEFSRWYAGDVDLSDPPADMAPGRATDLSNLPPAYIGVAGYDPLRDDGIRYGEPLAAAGVAAQVHNAETLVHGYLGYAGVVPAATAAMERGLAALRTALQG

SEQ ID NO: 23927 - protein, 232 aa, Mycobacterium avium subsp. paratuberculosis str. k10
MPCNTGQPRGPLIAPSILSADFSRLADEAAAVTGADWLHVDVMDNHFVPNLTIGLPVVQSLLATTTIPMDCHLMIENPDRWAPPYAEAGAHNVTFHAEATDNPIGVARDIRAAGAKAGISVKPGTPLEPYLEILPQFDTLLIMSVEPGFGGQSFIPEVLGKVRTARKLIDAGELTILVEIDGGINADTIEQAAEAGVDCFVAGLAVYGADDPAAAVEALRRQALGASQHLRR

SEQ ID NO: 23928 - protein, 415 aa, Mycobacterium avium subsp. paratuberculosis str. k10
MAVHNLKDLLAEGVSGRGVLVRSDLNVPLDSDGEQGRITDPGRITASVPTLSALVEAGAKVVVAAHLGRPKNGPDPALSLAPVAAALGEQLGRHVQLASDVVGTDALARAEGLTDGDVLLLENIRFDARETSKDDAERLALARQLAELVGPTGAFVSDGFGVVHRKQASVYDVATLLPHYAGTLVAEEIAVLEQLTGSTKRPYAVVLGGSKVSDKLGVIESLATKADSIVIGGGMCFTFLAAQGFSVGKSLLETEMVDTCRRLLDTYVDVLRLPVDIVAADRFAADAAPQTVPADAIPDDLMGLDIGPGSVKRFTALLSNAETIFWNGPMGVFEFPAFAAGTKGLAEAIAAATGKGAFSVVGGGDSAAAVRALGIPESGFSHISTGGGASLEYLEGKALPGIEVLGRPQPTGGAA

SEQ ID NO: 23929 - protein, 261 aa, Mycobacterium avium subsp. paratuberculosis str. k10
MSRKPLIAGNWKMNLNHFEAIALVQKIAFALPDKYYDKVDVTVLPPFTDLRSVQTLVDGDKLRLSYGAQDLSQHDSGAYTGDISGAFLAKLGCTFVVVGHSERRTYHNEDDALVAAKAATALKHELTPIICIGEHLEVREAGNHVIHCEEQLRGSLAGLSAEQIGKVVIAYEPVWAIGTGRVASASDAQEVCAAIRKELASLASAQIADSVRVLYGGSVNAKNVGELIAQDDIDGGLVGGASLDGEQFATLAAIAAGGPLP

SEQ ID NO: 23930 - protein, 328 aa, Mycobacterium avium subsp. paratuberculosis str. k10
MKTITFGKTGLEVSRLAFGTWEFCSDWGHADEDAAITMIRSARDLGINFFDTAQQYGFGASERLLGKALRDDLARARDEVVIATKGGLRATDGGLVRDASPQWLRKGVESSLTALGIDHIDVYLVHWPDPRMPAAETAGALAELVSEGKIRHVGVSNYDTAQVEEFSATLPVEVVQPPYHLFRRDIEETLLPYAREHDIGVMVYGPLAHGLLTGTVKPDTRFAPQDWRAKSDIFSGDGFLRNLEVVAQLQELASDLGVTISQLAIARVLAQPGVHVAIVGAQHLHYLQESARAADVTLSDADLAAVDNVLAAATPVGGPYPEMHQKAS

SEQ ID NO: 23931 - protein, 271 aa, Mycobacterium avium subsp. paratuberculosis str. k10
MTVKQSQASRLSPIFEPCRDDDRAALIGYLPTGYPDVPTSVQAMVALVESGCDIVEVGVPYSDPGMDGPTIARATEAALHGGVRVRDTLAAVEAISAAGGRAVVMTYWNPVLRYGVDAFARDLAAAGGYGLITPDLIPDEAGQWLAASERHGLDRIFLVAPSSTPQRLALTVEASRGFVYAASTMGVTGARDAVSHAAPELVSRVREISDIPVGVGLGVRSREQAAQIGGYADGVIVGSALVSALGDGGLTALRALTEELAAGVRQRAAAS

SEQ ID NO: 23932 - protein, 472 aa, Mycobacterium avium subsp. paratuberculosis str. k10
MSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKQLAQDAAVGDRVLVDDGKVGLVVDGIEGDDVICTVVEGGPVSNNKGISLPGMNVSAPALSDKDIEDLTFALELGVDLVALSFVRSPSDVELVHEVMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADAVMLSGETSVGKYPLAAVRTMARIICAVEDNSTAAPPLTHVPRTKRGVISYAARDIGERLDAKALVAFTQSGDTVKRLARLHTPLPLLAFTAWPEVRSQLAMTWGTETFIVPMMTSTDGMIRQVDKSLLELGRYRRGDLVVIVAGAPPGTVGSTNLIHVHRIGEDDV

SEQ ID NO: 23933 - protein, 409 aa, Mycobacterium avium subsp. paratuberculosis str. k10
MVTNTDALRRRWEAVMMHNYGTPPVALASGEGAVVTDVDGNTYLDLLGGIAVNVLGHRHPAIIEAVTKQLSTLGHTSNLYATEPSLALAEELVALLGAGHEPAGHESGGTESAGTARVFFCNSGTEANEVAFKLSRLTGRTKLVAAQEAFHGRTMGSLALTGQPSKQAPFAPLPGDVTHVPYGDAEALAAAVDDGTAAVFLEPIMGESGVVVPPEGYLAAARDITARHGALLVLDEVQTGMGCTGTFFAHQHDGITPDVVTLAKGLGGGLPIGACLAVGPAADLLTPGLHGSTFGGNPVCAAAALAVLRVLASENLVRHAEVLGKSLHQGIEGLGHPLVDHVRGRGLLCGVVLTAPHAKDAEAAAREAGFLVNAAAPGVIRLAPPLIVTEAQIDGFIAALPGILDRAAA

SEQ ID NO: 23934 - protein, 427 aa, Mycobacterium avium subsp. paratuberculosis str. k10
MRYRPGEALLALYRRRGPVIDAGAGRHGYTLLLGAEANKFVFANADAFSWRATFENLALVDGPTALIVSDGDDHRRRRSVVAPGLRHRQIQDYVTTMVSCIDRVIDGWRPGQRLDVYQHCRAAVRRSTAESLFGPRLAVHSDALGEHLQPLLDLTHQPPQLVGLQRRINAPAWRRAMAARQRINNLVDTLIADARAAPNPNDHMLTMLIDGRGDEGYTLSDNEIRDAIVSLVTAGYETTSGALAWAVYLLLSQPGAWATAAGEVRRVLAGLPPAAADLSGLTYLNGVVHETLRLYPPGVISARRVMRDLRFKGRRIRSGRLLIFSPYVTHRLHEIWPEPRRFAPERWNPDAPGYRRAAPHEFIPFSAGLHRCVGAAMATTEMTVMLARLLARTRLRLPAQRLRAANVAALRPTPGLTVEVIDSVPAQ

SEQ ID NO: 23935 - protein, 466 aa, Mycobacterium avium subsp. paratuberculosis str. k10
MIGLGGVWVLDGLEVTMVGNVSARLMEPGSGIALNPAQIGMAAAIYIAGACSGALFFGHLTDRFGRRNLFILTLALYLIATVATAFAFAPWYFFLTRFFTGAGIGGEYAAINSAIDELIPARVRGRVDLVINGTYWLGSAAGAGGALILLDTSNFAADLGWRLAFGIGAILGIFVLLVRRNVPESPRWLFIHGREEEAEHIVGEIEEAVQQQTGRPLPEPQGKALRIRQRTAISFREIAAVAFKLYPRRAVLGLALFIGQAFLYNGVTFNLGTLLSQFYAVPSGMVPVFFVLWALSNFAGPLLLGHLFDTVGRKQMITLTYIGSAVVVVALALVFLTQAGGVWAFIGVLIVAFFLASAGASAAYLTVGEIFPMETRALAIAFFYAMGTAIGGITGPLLFGQLIDSGQRDHVVWSFLIGAVVMAAAGLVELWLGIAAEQRPLEDLALPLTVDDAEDTEPQGDSAPVD

SEQ ID NO: 23936 - protein, 327 aa, Mycobacterium avium subsp. paratuberculosis str. k10
MTSPPLDPDAAARIASFGETAPMRQRGLPAVRAGLESAPRPATMPEMASVTEALVPSAAGGIPVRIYRPTTDSGVAVLVYLHGGGLVMGSNRSFEPLARELASASAATVVAVDYRLAPESPPPAQFDDAYAATEWVSRKAGELGVDADRLAVIGDSAGGSLAAAVALAARDRRGPPICAQVLLYPGLDRDMSVASIAAMPDAPLLIRDDIDYMHALVDGDAGPPTDPYLVPAYAADLSGLPPAIVVTAGCDPIRDWGERYADRLRDAGVQTTVTRYPGMYHGFLMRSDATARGRLAIAEIGGLLRAKFSHPLRFDVPITGRHSTATR

SEQ ID NO: 23937 - protein, 307 aa, Mycobacterium avium subsp. paratuberculosis str. k10
MSLEPQIAAIIEQLDSGFPPVQQMSGAEARALIRSRLVPPAQPEPVAEVADRLVEGPGGPLRIRVYRPEAAAPLPVVVYAHGGGFVFCDLDSHDGLCRNLANLVPAVVVSVDYRLAPENAWPAAAEDVYAVTCWARDHADALGADPARLVVGGDSAGGNLAAVTTVMCRDRGGPAPAAQLLIYPVIAADFDTESYRLFGQGYYNPAPALRWYWDCYVPSTRDRAHPYATPLNADLRGLPPAVVVVAGHDPLRDEGLAFGAALEAAGVPTVQLRYEGGIHGFMTMPMLDIAHRARNEAAAALADLLQW

SEQ ID NO: 23938 - protein, 315 aa, Mycobacterium avium subsp. paratuberculosis str. k10
MVKPNLTLEIPDLRGKFAVVTGANSGLGFGLAKRLAAAGAEVVLAVRDPAKGDQAVAAIRREVPQAKLTIRQLDLSSLRSVAALGEQLTAEGRPIDILINNAGVMAPPRRQQTSDGFELQFGTNHLGHFALTGRLLALLRAADSARVVTVSSIAATQRKLDFADVNAEHGYQPMYSYGVAKLAQLMFAVELDRRSRLGGWGLMSNAAHPGLAKTNLLSGASYGRSAPTLQARLTRLTWRLLPFMWLDIDEAVKPTLYAAVSPDAQGARYYGPRGFYETARGGVTFARVPPLARSEPEMARLWRLSEQLSGVDYPG

SEQ ID NO: 23939 - protein, 478 aa, Mycobacterium avium subsp. paratuberculosis str. k10
MRFLDGHRPGYDLTYNDVFIMPNRSEVPSRFDVDLSTGDGSGTTIPVVVANMTAVAGRRMAETVARRGGLVILPQDLPITAVQQTVQFVKSRDLVLDTPVLLEPDDSVSDAMALIHKRAHGVAVVAFEGRPLGLLSESSCLGVDRFTRVRDVAMTDFVVAPVGTEPRKIFDLLEQAPIGVAVVTNTDGTLAGVLTRTGAVRAGLYTPAVDAQGRLRVGAAIGINGDVGAKARSLVEAGIDLLVIDTAHGHQVKTLEAIRTVASLELGVPLVAGNVVSADGTRDLLGAGANIVKVGVGPGAMCTTRMMTGVGRPQFSAVVECASAARELGGHVWADGGIRHPRDVALALAAGASNVMIGSWFAGTYESPGDLMRDREDQPYKESYGMASKRAVVARSGAETAFDRARKSLFEEGISTSRMGLDPARGGVEDLIDHITSGVRSTCTYVGAATLAQLYERVVVGVQSTAGFAEGHPLPLGW

SEQ ID NO: 23940 - protein, 489 aa, Mycobacterium avium subsp. paratuberculosis str. k10
MSSSVTPSRPTTGTAQIGVTGLAVMGSNIARNFARHGYTVALHNRSIAKTDALLKEHGDEGKFVRCETIAEFLDALEKPRRVLIMVKAGDPTDAVINELADAMEPGDIIIDGGNALYTDTIRREQAMRERGLHFVGAGISGGEEGALNGPSIMPGGPAESYRSLGPLLEEISAHVDGVPCCTHIGPDGAGHFVKMVHNGIEYSDMQLIGEAYQLLRDALGKTAEQIADVFDEWNSGDLDSFLVEITAQVLRQTDAKTGKPLVDLILDEAEQKGTGRWTVKSALDLGVPVTGIAEAVFARALSGSVAQRRATTGLASGRFGEKPSDAAQFTEDIRQALYASKIIAYAQGFNQIQAGSAEYGWDITPGDLATIWRGGCIIRAKFLNRIKDAFDENPDLPTLIVAPYFRSAIEAAIDGWRRVVVTATRLGIPIPGFSSALSYYDALRTERLPAALTQGLRDFFGAHTYGRIDEDPDKRFHTLWSADRREVPA

SEQ ID NO: 23941 - protein, 343 aa, Mycobacterium avium subsp. paratuberculosis str. k10
MMSSPVTTTAMRAWRVRRPGPMDTHPLEEVTTEVPRPGPSDLLVAVRACGVCRTDLHVTEGDLPVHRDRVTPGHEVAGEVIEVGAEAGDEFGVGDRVGIAWLRHTCGVCKYCRRGDENLCPESRYTGWDADGGYAEFATVPAAFAHPLPGGYSDSELAPLLCAGIIGYRALLRAQLPPGGRLGLYGFGGSAHITAQVALAQGAEVHVMTRGDRARELAIELGAASAQGAADPPPVPLDAAILFAPVGDLVLPALAALDRGGTLAIAGIHLSDIPSLNYQRHLFQERQVRSVTSNTRADARAFLDFAGTHHISVTTPEYPLGQADRALADLSAGRIAGAAVLLV

SEQ ID NO: 23942 - protein, 410 aa, Mycobacterium avium subsp. paratuberculosis str. k10
MASATGFVIIGGGLAAAKAVDALRDNNFDGRIIVFADEEHLPYERPPLSKEFLAGKKSLTDFTVQNSDWYRDNDVDLRLNTRVCALDAAGHTVGLADGTTVAYDKLLLATGSAARRPPIPGSDCAGVHYLRTYEDAVALNSFLGEGKSLAVVGAGWIGLEVAAAARQRGVEVTVVEAARQPLTAALGETVGEVFATLHREHRVDLRLETQVREITRADGSATGLRTTDGSAIPADAVLVAVGAQPNIELAEAAGLSLADGGVLVDASLRTSDPDIYAVGDIAAAEHPLLRTRIRTEHWANALKQPAIAVAGMLSRPGEYDELPYFFTDQYDLGMEYVGHAPRFERVVFRGDVAAREFVAFWLDADDRVLAGMNVNIWDVLDDVKALIRSRAPIDADRLGDPGAPLGELLG

SEQ ID NO: 23943 - protein, 444 aa, Mycobacterium avium subsp. paratuberculosis str. k10
MASVVTGPDWVQHVIWWQVYPLGFVGAYPLPQSSEPPQPEQHRLRRLVDWFDHAIELGASGIALGPIFASRTHGYDTTDHYRIDPRLGDDTDFDHLIAQAHRRGLRVLLDGVFNHVGVDFPRYRAAIDSDDHAAARWFRGSRGRFHTFEGHDGLITLNHDNPEVVDYTVDVMAHWLGRGADGWRLDAAYAVPETFWAATLPRVRDRYPQAWFVGELIHGDYAAVVRAAGFDSATQYELWKAIWSSLNDGNFYELDWALQRHNAFLGRFSPLTFIGNHDVTRIASQLNNPAHLAHALVLLLTVGGVPSVYAGDELGFRGVKEERFGGDDAVRPEFGSPPIPLDDFGTEVWRLHQYLIGLRRRHPWLHGATTTALLLQNRHYVYETRSGDEALLIVLNIGDEPLRVSLRELGGRRGRVIGGSAAPPPEVLDTVVVEPQGWRILSPI

SEQ ID NO: 23944 - protein, 450 aa, Mycobacterium avium subsp. paratuberculosis str. k10
MTGTPLAAAAIAQLEAEGVDTVIGTVVNPAGLTLAKTVPIRRTNTFADPGLGASPSWHAFAVDQTGIAFTAEVGVVGDQRLRIDLSALRIVGDGLAWAPAAFFAQDGTPIPSCARGTLKRVEAALADAGIDAAIGHEVEFVLVAPDGQRLPSTLWAQYGLAGVLEHEAFVRDVIGSATRAGIAIEQLHPEYGANQFELSLAPQPPVAAADQLILMRLIIGRAARRHGFRISLSPAPFAGDVGSGAHQHFSLSMAEGPLFSGGAGTAGMTPAGENAVAGVIRGLPEAQGVLCGSIVSGLRIRPGNWAGAYACWGTENREAAVRFIVDGPGSPRGGNVEVKIVDPSANPYLASAAILGLSLDGIKSQAALPPEVTVDPAALSDADRDRDGVVLLTDSAAEAIAALDDSELMRHILGDPVVDMVVAVRRLEQERYGDLDPAQLADRFRMAWSL

SEQ ID NO: 23945 - protein, 337 aa, Mycobacterium avium subsp. paratuberculosis str. k10
MPTHQAVQIQSAGAALELVDTETRPPGRDEVRLTVGACGICGTDAHFVNGAFPGLSWPLTPGHEIAGRIAELGEGVEGFAVGQRVAVGWFGGCCYRCDPCRAGLFIHCVNGKVPSWHYPGGYAESVTVPTSALARIPEELTDAEAAPMGCAGVTTYNALRHTKALPGDRVAILGVGGLGHLGVQFAAAMGFETIAINRGTGKADDARKLGAHHYIDSTAEDPAEALRALGGAAVVLATAGNSQAMAATVGGLAPQGELVTIGVTPEPLPISPLQLITPGLSIVGHPSGTAKDVEDTMQFAVLSGVRAWIEELPLSRAADGYAALEGGRAHYRTVLTM

SEQ ID NO: 23946 - protein, 424 aa, Mycobacterium avium subsp. paratuberculosis str. k10
MTKPSPGRKLTADQRNSFIAALLGWTMDAFDYFIVVLVYADIAKTFHHSKAEVAFVTTATLIMRPVGALLFGLWADRVGRRLPLMVDVMFYSVVGFLCAFAPNFTVLVILRLLYGIGMGGEWGLGAALAMEKVPVERRGFFSGLLQEGYAFGYLLASVASLVVMDWLELSWRWLFGLSIVPALISLIIRYRVEESEVWEAAQDQLRLTSTRIRDVLRNGAIIRRFVYLVLLMTAFNWMSHGTQDVYPTFLGAHANHGAGLSSTTVKWIVVVYNVGAIIGGLVFGTLSQRFSRRYTVVFCAMLALPIVPLFAYSRTAAMLGLGSFLMQLFVQGAWGVIPAHLTEMSPDAIRGLYPGVTYQLGNLLAAFNLPIQERLAETHGYPFALAATIVPVLLTVAVLTLIGKDATGIRFATSESAFLPTEMT

SEQ ID NO: 23947 - protein, 153 aa, Mycobacterium avium subsp. paratuberculosis str. k10
MRSGPRTTIAVFGGAAMLVLAVGCGGGHKGGPSTTSTTTPTTTPSTSVVPSTTPGGGGTVPGGPTGGGGPGGGGGSIPGGPTGGGGPGGGGGSIPGGPTGGGGPGGGGGSIPGGPTGGGGPGGGGGSIPGVGGGGGGPGGGGGCVGNVCGGYP

SEQ ID NO: 23948 - protein, 512 aa, Mycobacterium avium subsp. paratuberculosis str. k10
MLSKCSALSAVGAGHDGSPEDSPEERDQMTVQAVLDDIRKRPGTGDVIAVIDPATEEKITEFTDCGAEAVDEAAARAKASFESGVWSQLPGRERAKILWRIGDLIDEHAEEFAQLDSLNTGMPLLQAQLQMSTCSEFFRYYAGWCSKINGTAYDVKTDGIATDTFVNMHAYTLKEPYSVVGLIFPWNGPIFNANAKLAPALAAGCSLLVKPAEETPLSALLLDRLVHEAGVPEGVVNLLTGYGHTAGAAITAHPDVEKVAFTGSTEVGKEIVRASAGNLKKVTLELGGKSPVLIFDDADLDKAILMASLGIFVHSGQGCVCGSRIFVQRGVYDRVVEGIAMMANTFKLGAPSEEGCVSGPLISQKQLNRVMGFIDEGKNDGVEVVTGGYRLDRKGYFVHPTVLTNVDPGMRLYQQEIFGPVVAILPFDDEDEAVAMANDTTYGLAATAWTENLGRAHRIVKRLQAGSVQVNCQLVFDHDVPFGGYKQSGWGHEFGKEGLEIYLKTKSVWAQL

SEQ ID NO: 23949 - protein, 308 aa, Mycobacterium avium subsp. paratuberculosis str. k10
MADRLPDDAFTAPQVVDPGLRKVARFLPRGYALHRGLKLQRAIMNLMGNAGRLRTVPVVAVNEHVTVRLHRPPNLAEHAPALLWIHGGGTVMGRAAQDDKYLRKLSHRTGVAIAAVEHRLAPEHPYPAPVEDCYAALLWLARQPWVDPERVAVGGASAGGLFAATLAQRAHDRNDVKIAFQMLVYPMLDDRTGAQRDGPRRLMWTESDNQLAWQWYLNGADPDEAAPARRKDLSGLAPAWIGVGTLDLFYPECLEYARRLREAGVPAQEEIVPGAFHAFDQIVDKAPISAKFFESQCDFLRGALAPNG

SEQ ID NO: 23950 - protein, 323 aa, Mycobacterium avium subsp. paratuberculosis str. k10
MKQAQLGGLQVGRLGLGAMGMSVAYAGAGTDDAESIRTVHRAIELGVTLIDTAEVYGPYVNEELLARALRGRRDRVVLATKFGLISHTGRDGLDSSPANIRVAVDGSLRRLATDRIDLYYQHRLDRQTPIEDTVGALAELVAAGKIRHIGLSEVGVNTIRRAHAVHPITAVQSEYSLWTRDQEDEILPVLRELGIGFVAYSPLGRGFLTGAIRSAHELPDTDYRRTNPRFAEQNFAHNLRCADELRDIAADVGATPAQVALAWLLAKGPDVVPIPGTKRVARLEENVGADALELTTEQLSRLDRLTPPVGGHHADAQLAWIDR

SEQ ID NO: 23951 - protein, 456 aa, Mycobacterium avium subsp. paratuberculosis str. k10
MTKHFDAIIVGAGQAGPPLAGRLTAAGQRVAIIERKLIGGTCVNTGCIPTKTLVASAHAAHLARRGADYGVGTGAVSVDMAKVKARKDEIMLGDRKGVEDWLAGMAGCTVVRGHARFRDPHTLQVGEDLLRAERIFLNVGGRAVVPDIPGLAEVDFLTNVSILELDTLPTHLVIVGGSYIALEFAQMYRRFGAAVTVVERGPRLASREDEDVSAAVQEILRAEGIDIVVNADDVRIAKTGNGFELTPRDGAPPIRGSHLLLAVGRRPNTDDLDLAAAGVRTDARGYILVDDQLKTNVEHIWAMGDCNGRGAFTHTSYNDFEIVAANLLDDDPRRVSDRITTYALYIDPPLGRAGMTVAQVRASGRRALVGKRPMTRVGRAVEKGETQGFMKVVVDADTREILGAAILGVGGDEAIHGILDVMSAKAPYTTLSRTMHIHPTVSELIPTMLQEMSPLA

SEQ ID NO: 23952 - protein, 478 aa, Mycobacterium avium subsp. paratuberculosis str. k10
MTETTPDDVFKLAKDEKVEFVDVRFCDLPGIMQHFTIPVSFFDESVFEDGLAFDGSSIRGFQSIHESDMLLLPDPATAQIDLFREAKTLNLNFFVHDPFTLEPYSRDPRNIARKAENYLISTGVADTAYFGAEAEFYIFDSVSFDSRTNGSFYEIDAISGWWNTGSPNELDGSPNRGYKVRPKGGYFPVAPVDHYVDLRDQMLSNLIKAGFSLEKGHHEVGTGGQAEINYKFNTLLHAADDMMLYKYIVKNTAWQNGKTVTFMPKPLFGDNGSGMHTHQSLWKDGSPLMYDETGYAGLSDTARHYIGGLLHHAPSLLAFTNPTTNSYKRLVPGFEAPINLVYSQRNRSACVRIPITGTNPKAKRLEFRCPDSSGNPYLAFSAMLMAGLDGIKNKIEPQAPVDKDLYELPPEEAANIPQAPTQLSAVIDRLEEDHEYLTEGGVFTPDLIETWISFKRETEILPVQVRPHPYEFALYYDV

SEQ ID NO: 23953 - protein, 446 aa, Mycobacterium avium subsp. paratuberculosis str. k10
MDRQKEFVLRTLEERDIRFVRLWFTDVLGFLKSVAIAPAELEGAFEEGIGFDGSSIEGFSRVSESDTVANPDPSTFQVLPWASPNGHHHSARMFCDITMPDGSPSWADPRHVLRRQLQKANDLGFSCYVHPEIEFFLLKPGPDDGTPPVPVDTAGYFDQAIHDSASNFRRHAIEALEFMGISVEFSHHEGAPGQQEIDLRFADALSMADNVMTFRYVIKEVAIENGARASFMPKPFGQHPGSAMHTHMSLFEGDVNAFHSPDDPLQLSDVGKSFIAGILEHASEISAVTNQWVNSYKRLVGGGEAPTAASWGAANRSALVRVPMYTPHKTSSRRVEVRSPDSACNPYLTFAVLLAAGLRGVEKGYVLGPQAEDNVWDLTPEERIAMGYRELPTSLDSALRAMESSELVAETLGEHVFDFFLRNKRTEWATYRSHVTPYELRTYLSL

SEQ ID NO: 23954 - protein, 473 aa, Mycobacterium avium subsp. paratuberculosis str. k10
MTITAPETVGESLDPRDPLLRLSNFFDDGSVALLHERDRSGVLAAAGTVNGVRTIAFCTDGTVMGGAMGIEGCSHIVDAYDTAIEEQSPIVGIWHSGGARLAEGVKALHAVGLVFEAMIRASGYIPQISVVVGFAAGGAAYGPALTDVVVMAPESRVFVTGPDVVRSVTGEDVDMASLGGPETHHKKSGVCHIVADDELDAYERGRRLVGLFCQQGHFDRTKAEAGDTDIHALLPESPRRAYDVRPIVTAILDDETPFDEFQANWAPSMVIGLGRLSGRTVGVLANNPLRLGGCLNSESAEKAARFVRLCDAFGIPLVVIVDVPGYLPGVDQEWGGVVRRGAKLLHAFGEATVPRVTLVTRKTYGGAYIAMNSRSLNATKVFAWPDAEVAVMGAKAAVGILHKKKLAAAPEHEREALHDQLAAEHEKIAGGVDSAIEIGVVDEKIDPAHTRSKLTEALAQAPARRGRHKNIPL

SEQ ID NO: 23955 - protein, 361 aa, Mycobacterium avium subsp. paratuberculosis str. k10
MSQTVRGVISRKKGEPVELVDIVVPDPGPGEALVDVIACGVCHTDLTYREGGINDEYPFLLGHEAAGRVEAVGPDVTAVQPGDFVVLNWRAVCGQCRACKRGRPHLCFDTFNATQKMTLTDGTELTPALGIGAFADKTLVAAGQCTKVDPAADPAVAGLLGCGVMAGLGAAINTGAVARDDTVAVIGCGGVGNAAIAGAALVGARRIIAVDTDDTKLDWARGFGATHTVNARQADVVAAIQDLTDGFGANVVIDAVGRPETWKQAFYARDLAGTVVLVGVPTPDMTLEMPLVDFFSHGGSLKSSWYGDCLPERDFPTLIELYLQGRLPLEKFVSERIGLGDVEAAFHNMHDGKVLRSVVML

SEQ ID NO: 23956 - protein, 495 aa, Mycobacterium avium subsp. paratuberculosis str. k10
MVTDRFDAIIVGAGFGGIGAAIQLKRLGFDNIVILDREDDLGGTWHVNHYPGIAVDIPSTTYSYWFEPNPGWSRLFAPGGEVKQYAADVADKYDVRRHMRFNTTVEGAQWDEDAEVWRVALAGGESLTTRFLITATGFLSQPHTPDIPGIGSFGGKVVHTTAWDHDYRYQGRRIAVIGTGASAVQVVPELAKEAGELTVYQRTATHVLPKVDFEFDPAVRRLFARVPAAQRALRWVTDVLLEIIMIVGALHFKESRGRGNISASDLAKINRFRWIRDKELRAKLTPDYDCGCKRPTFSNSFYRVLTQPNVHLETNPIERIEPDGIVTADGRKTVIDTLVLATGFDLWEANFPAIEVIGRKGRNLGKWWRETRFQAYQGVSMPYFPNYLSLASPFAFSGLSFFHTIEYQMRHMDRLLGEVKRRGATIFEVTEEANDRFMERMTKLLDNSVFYAGNCATSRSYYFSPSGEASLLRPTSTLNSIREASSFPLSDYVIA

SEQ ID NO: 23957 - protein, 484 aa, Mycobacterium avium subsp. paratuberculosis str. k10
MSRDDWISADEGPRRTVSTTIPVFNPSTEEQIAEVPDSDQAAVDAAVARARETFELGVWRKAPASHRANVLFRAARIIEERKDELAALESQDNGMNLTAAGHIIPVSVDMLKYYAGWVGKIHGESANLVSDGLLGTWETYHTFTQLEPVGVVGLIIPWNGPFFVAMLKVAPALAAGCSAVLKPAEETPLTALKLEEIFREAGLPDGVLNVITGYGETTGAALTAHPDVDKISFTGSTEVGRLIVKAAAGNLKRLTLELGGKSPLIMFDDANLDKAIMGAGMGLLAGSGQNCSCTSRIYVQRGIYDQVVEGLAEFAKMLPMGGSDDPNSVLGPLISEKQRQRVEGIVNDGVAAGAKVITGGKPMDRKGYFYEATIITNTTPDMRLIREEIFGPVGCVIPFDDEDEVIAAANDTHYGLAGAIWTENLSRAHRVVNELRAGQIWVNSALAADPSMPISGHKQSGWGGERGRKGIEAYFNTKAVYIGL

SEQ ID NO: 23958 - protein, 412 aa, Mycobacterium avium subsp. paratuberculosis str. k10
MTILDGQLTATRVDSAIRLAEKRAAHNYSPLPIVAASAQGAWITDVDGRRYLDCLSAYSAVNFGHRHPEIVATAHAQLDTVTLVSRAVHSDKLGPFCAALAYLCDKDMVLPMNSGAEAVESGLKVARKWGAEVKGVPAGQANIIVADNNFHGRTISIVSFSSDAAARDGFGPFTPGFRSVPFGDAGTLAQAIDDNTVAVLLEPIQGEAGIVVPPDDYLPAVRALCSEHNVLMIADEIQSGLARTGYTFACDRWRVVPDVYLLGKALGGGVVPLSAVVADREILGVLHPGEHGSTFGGNPLAAAIGTTVVSMLARGEYQARATALGAHLQRRLRALVGHGVDEVRGLGLWAGVDIDPSLGSGREMSLRLAERGVLVKDTHGATLRFAPPLVVTAQEIDWAVGQLAAVLREAAS

SEQ ID NO: 23959 - protein, 1411 aa, Mycobacterium avium subsp. paratuberculosis str. k10
MAPENAVNTMCAYCGVGCGMVLQITTDPQTGRRHVAKSVGNKEHPANFGRLCTKGATTADLLAAPGRMDSAHARAGRGEPLEPIDTDQAITRCAKQLRAIIDEHGPDAIAMYVSGQMSLEAQYLANKLTKGFIGTNQIESNSRLCMASAGSGYKLSLGADGPPGSYQDFEHADVFFVIGANMADCHPILFLRMMDRVKAGAKLIVVDPRRTATAEKADLFLQIAPGTDLALLNGLLHLIVENGHTDREFIAEFTEGWEVMPSFLEQYTPDRVSEITGIPEQDIRAAAQLIGEADNFMSCWTMGLNQSTHGTWNTNAICNLHLATGAICKPGSGPFSLTGQPNAMGGREMGYMGPGLPGQRSVASVADREFVEDVWGVPRGRLRTEVGTGTVDMFSRMADGQIKACWIICTNPVASVANRKTVLAGLERAELVIAQDAYLGTETSEYADVLLPAALWAETEGVMVNSERNITLSQPAVAAPGGAMPDWQIIARIACEMGFSEAFSYSCAEEVFEEIKRFWNPTTGYDLRGVSYERLRRQPLQWPCPPQSTADRNPIRYLNDGVSQTQLVREDGTVPRLAFPTPSGRAVFFARPHLQPEEMPDDDYPFLLNTGRLPHQWHTMTKTGKVAKLNKLNPGPFVEIHPDDAARLGIGEHDRVEIASRRGRAVLPAVVSDRVRPGNCFAPFHWNDAFGEYLSINAVTNDAVDPISNQPEFKACAVTLTKVAVSHPDSAIGTGPSAGHDTPESSPTEVREISVSQVDALGELLGVATSFKPEFNELGRSYLAGMLTGLRSDVGRRAGGVPTLPPSAPFDSRTRLWVDGLLAGLFSRADASQQAALPEPPQPAAQQPPAAPAGATPAPERAPVVVLWASQTGNAEELAADVAAQLAAAELPVALHSMDDFPAAELAATRELLLITSTTGDGDAPDNGSGLWRALTGDAAPRLGNTRYAVLALGDSNYDDFCGHGRKLDARLAELGATRIAERVDCEPDYEQAAAKWVADVIDALTRTPTAVGGDGGATVSARTSPVAAPSRPNTPAPHTYSKKHPLITDMVRNTTLNGPKSTKDVRHLVFNLPEDAVSYEAGDALGVWPRNSDELVDEWLAVTGLDGQTPVEVGEHGLMSLRSALTERIEIAHISRDLVRFVQERTGDAKLAELLKPENKRALADWTWGRQSIDLLAQLPVSASAHEWLRVLKRLQPRLYSISSSPKACPGEVHLTVSPVRYNFQGVPRRGVCSTYLAARSPGDRVAVYLQPSSNFRPPSDPDTPMIMIGPGTGIAPFRGFLQERRALGHRGPNWLFFGEQHAATDFYYRDELEQMREDGFLTELDLAFSRDQQHKVYVQHLMRNRGKQLWSWLQDGAQLYVCGTADPMAKDVDRALCDIAAEFGNLDPDAAKAYVQSLSADKRYHRDVY

SEQ ID NO: 23960 - protein, 310 aa, Mycobacterium avium subsp. paratuberculosis str. k10
MSIAENVTQLIGNTPLVRLNRVTEGAVADVVAKLEFFNPGNSVKDRIGVAMIDAAEQAGLIKPDTIILEPTSGNTGIALALVAAARGYRCVLTMPETMSVERRMLLRALGAEIVLTPGADGMPGAIAKAEELAKSDDRYFVPQQFENPANPAIHRSTTAEEVWRDTDGKVDIFVAGVGTGGTITGVAQVIKERKPSAQFIAVEPAASPVLSGGQKGPHPIQGLGAGFVPPVLAMDLVDEVIAVGNEESIALARRLAAEEGLLVGISSGAALVAALQVARRPENAGKLVVVVLPDFGERYLSTPLFADLAD

SEQ ID NO: 23961 - protein, 362 aa, Mycobacterium avium subsp. paratuberculosis str. k10
MIDAGTDRGDIAITVRDAYKRYGDFVALDHVDFVVPTGSLTALLGPSGSGKSTLLRTIAGLDQPDTGTVTIYGRDVTRVPPQRRGIGFVFQHYAAFKHLTVRDNVAYGLKVRKRPKAEIKAKVDNLLEVVGLSGFQGRYPNQLAGGQRQRMALARALAVDPQVLLLDEPFGALDAKVREDLRAWLRRLHDEVHVTTVLVTHDQAEALDVADRIAVLNQGRIEQIGSPTEVYDAPTNAFVMSFLGAVSTLNGTLVRPHDIRVGRTPEMAVAAEDGTAESTGVARAIVDRVVKLGFEVRVELTSAATGGPFTAQITRGDAEALALREGDTVYVRATRVPPITAGATTVPALSRDGADEATLTSA

SEQ ID NO: 23962 - protein, 314 aa, Mycobacterium avium subsp. paratuberculosis str. k10
MARPQGLTRIDPALRDTAAQLGVVEFRAETLAAEREHANRLAAQRAASADTRGVAIDSVSIAGPDGQPLELRLYRGHTESAAPLLVYAHGGAFVTGNLATDHAHCVELARDGGCLVVSVDYRLAPENPCPAALDDVEAAFRYVVDNSAALNADANRIAVMGRDAGAALVAGLTQRMFDQEGPTILMQILHQPMLDSDATPSRREFQRTPGLNGPAVSRAWNHYLGHASASGQHVPAHRANLEGLPPTFISCSEIDPCRDEAIDYANRLLHAYVHTELHVIAATFNGFDSMVPDWIVAQENRALHAQALRRVFAM

SEQ ID NO: 23963 - protein, 498 aa, Mycobacterium avium subsp. paratuberculosis str. k10
MPKAQDWEETLADLQRRRQHAFDMGGPERLDKHRNKGKLDARARIEYLLDPGTFRELGTLVGGEIAADGLVVGSGEINGTPVMLGAEDFTTLAGSIGPGGNSKRYRIAELALRDKIPLVMLLEGAGFRPTGGHYGRTPTDLLAQAQCSGRVPTVAAVLGPSAGHGALVAPVCDFRIMSRQGAIFTAGPPVVKESTGEDISKEDLGGPDVALPSGVIHNVAENDEAALDDVRRYLSYFPPSAWSYPPSLPPGDAAMPRPTPELLDIVSRDNRRVYDMRAVLDVVFDSPDWFEVQPQFGKAIICALAHLGGHPVAVVANQPQVLAGSIDADAADKAAHFIMVADSFHLPIVFLADNPGMLPGSRSERSGVLRAGARMFAAQTAATTLKLHVTLRKAYGFGSMVMSLLGFDHQVATFAYPGATMGAMSAAALSRASHAGEDLSTKLRNAELQASYRSAEHMGFDELIDPRETRDALLASLRRGLSSRQAAAEPVSRTVIMP

SEQ ID NO: 23964 - protein, 467 aa, Mycobacterium avium subsp. paratuberculosis str. k10
MAPTIPRDGRRYRAPIRSRYRYGMNDPVVTGLLTDKYELTMLAAALRDGSAGRRTTFELFARRLPEGRRYGVVGGTGRLLEALPQFTFGDEACQSLRQFLDPDTLRYLRDFRFGGDIDGYAEGELYFPGSPVLSVTGTFAECVVLETLALSIFNHDTAIASAAARMVSAARGRPLIEMGSRRTHEQAAVAAARAAYIAGFAASSNLEAQRCYGIPAEGTSAHAFTMLHARTDAAAESTELAAFRAQVQALGVDTTLLVDTYDVTTGVANAVTAAGAGLGAVRIDSGELGVLARQVREQLDRLGASRTRIVVSGDLDEFSIAALAAEPVDSYGVGTSVVTGSGAPTANMVYKLVEVDGLPVQKRSSHKESRGGRKEALRLSRDTGIITEELVYPAGHRPDVAEPARAVTVPLVRGGELVSKPNLAAARELVASGLRSLPWEGLNLSHGEPAIPTTQIPADRRRPPGID

SEQ ID NO: 23965 - protein, 486 aa, Mycobacterium avium subsp. paratuberculosis str. k10
MADPPALVQTYQLYIDGQWVEPQDGRYDDLSPSTEAVIATAPDASVAQVDDAIAAARRAFDSGPWGRMSAEQRARCLNQLGEALTKHADDFFALSQTEWGCIGNERIMQIDGAGFMSLHAAQLATQLVDQEVAGISAGTTLLRHVPLGVVAVLTPWNFPHCLNVMKLNHALAAGNTVVLKPSPLTPLAGLALARLIDEHTDIPPGVVNVVTPSGVEAAKLLTTDPRIDMVSFTGSSAVGRQVMSAAGDTIKRILLELGGKSASIVLDDANVTDEMLEQMLFQSCSLHAGQACILHSRLLLPDSLHDDVVDRLAALAREVKVGDPTDPDVQMGPLISAAQRDRVEAHIAGARSDGATLVTGGGRPAGLDVGYYVEPTILSGVEPNSTIAQEEVFGPVLSVLRYRDDDDAVAIANNSRYGLSGAVWGDDVDRAVGVARRIRTGQIAVNGISPAGAPFGGFRLSGLGREGGGIGGLHQYMEPMAIGVPA

SEQ ID NO: 23966 - protein, 340 aa, Mycobacterium avium subsp. paratuberculosis str. k10
MQLGMIGLGRMGANIVRRVVKGGHECVVYDHNPDAVKAMAGEEKTTGVSSLQELAAKLSAPRVVWVMVPAGTITTGVIEELATTLEPGDIVIDGGNSYYRDDIRHSKTLSEKGIRLLDCGTSGGVWGRERGYCLMIGGDEEAFAHAEPIFATVAPGVDAAPRTPGRDGEVTRSEQGYLHCGPSGAGHFVKMVHNGIEYGMMASLAEGLNVLRNADIGKHAQEGDAETAPLSNPEFYQYDFDIPEVAEVWRRGSVIGSWLLDLTAIALHESPELKEFSGRVSDSGEGRWTSIAAIDEGVPTPVLTTALQSRFASRHLDDFANKTLSAMRKQFGGHAEKPAN

SEQ ID NO: 23967 - protein, 308 aa, Mycobacterium avium subsp. paratuberculosis str. k10
MPRRGARRGSAGTVGGVSAPQTIAQASGTLTLGGDLTVNRLGFGAMRLTGAGVWGPPADRDECVRVLRRAVELGVNFIDTADSYGPYVSEEIIREALHPYDGLVIATKAGLLRTGPDIWIPLGNPSYLRQECEMSLRRLGTDTIDLFQLHRIDPNFPLQDQVGELLTLKNEGKIRHIGLSEITPDQLAAAQQITEIVSVQNMYNVTARRAEPLLDAATRQGIAFIPWFPLAAGPLAAPDGPLQRIAAEHDATPSQLALAWLLKRSPVMLPIPGTSKVAHLEENVAAARITLSDEEFEALSTAGTQQTV

SEQ ID NO: 23968 - protein, 487 aa, Mycobacterium avium subsp. paratuberculosis str. k10
MTATASSPPRTGALLIGTERITAASGGSHQHRYPGTGVPNATIPLAGHSEVDRAVHSAREAQREWISYPVDRRRDLLFGLADLLRDHFAELTELNVHDYGVPISVAGNSVLTERFVRYYAGYPDKLTGASTPVSGAFDVNIVEREPYGVVAVIAPWNGPLVVAGAAVAPALAAGNAVIFKPSELASLAPLRFGELCLEAGLPPGLVNVLPAGPEGGEALVRHPGVGKVHFTGGHATAQQVLRAASDNVTPVTAELGGKSAYLVFADADLDTAAVIAAHQGPLTQAGQSCACASRILVEASVYVSFVEKLVAQVQAATIGDPLRPDVMLGPVITEAAADRILGVIDRAVAEKAGDLVTGGRRLGGELASGYFIEPTIFSNVDNRSSLAQTETFGPVASVMPFADEAQAVSLANDSRYGLNAFVATANLERAHRVARRLQAGSVWVNRHSDIEPQGPYGGYKQSGFGRTGGVEGLHEFLQVKNIRIGMS

SEQ ID NO: 23969 - protein, 471 aa, Mycobacterium avium subsp. paratuberculosis str. k10
MSSPQEYDMVVIGSGPGGQKAAIASAKLGKSVAVVERGQMLGGVCVNTGTIPSKTLREAVLYLTGMSQRELYGASYRVKEKITPADLLARTQHVIGKEIDVVRNQLMRNRIDLLIGHGRFVDPHTIEVEDPSRREKITISGKYVVIATGTRPARPSGVEFDEDRVLDSDGILDLKSLPTSMVVVGAGVIGIEYASMFAALGTKVTVVEKRDDMLDFCDPEVVEALKFHLRDLAVTFRFGEEVTAVDVGSAGTVTTLASGKQIPAETVMYSAGRQGQTDHLDLHNAELEADNRGRIFVDDNFQTKVPHIYAVGDVIGFPALAATSMEQGRLAAYHAFGEASDGITELQPIGIYSIPEVSYVGATEVELTKDAIPYEVGVARYRELARGQIAGDSYGMLKLLVSTQDLKVLGVHIFGTSATEMVHIGQAVMGCGGTVEYLVDAVFNYPTFSEAYKVAALDVMNKVRALNQFRR

SEQ ID NO: 23970 - protein, 510 aa, Mycobacterium avium subsp. paratuberculosis str. k10
MPPVIEIAREHNPFPTTGVSRGRDGIPRYDELPATLVDMLADQVDARPDSEAVVELGGGRLTYRQLWDRAARVAGGLRADGLRRGDRVAVRYPAGIDWVLAFWGTVLAGGVAVAVNTRSAQPEVDFVLSDSGARLQLAPGDPLPDGKPYVTEQLGAADTAALFYTSGTTGYPKGVPTTHEAFLTNTENAIRCLQQPRDLGEDMRTLISVPLFHVTGCNSQLLAAARLGGASVILPALDLDALLNAVVAERVSVMVTVPAIYALLLRHKDFAGTDVSRVRWVGYGGAPIAPSLVRTVKDAFPHATVFNGYGMTETASLMTVLPDREAVEHADSVGYAVPSVDLGLIPFGDNEPGVGELVTRGANVTAGYWNRPQATASTFAGGWLHTGDVVRVDDAGRVHIIDRLKDIINRGGENVSSVEVEAVLLGAPGVADACVLGVPDDVMGEKVGAVLFGDDDIDVPAVLEHCRGRLADFKVPQYVTVVDGPLPRNAGGKLLKARLRDQVHWGDPLR

SEQ ID NO: 23971 - protein, 245 aa, Mycobacterium avium subsp. paratuberculosis str. k10
MRVGVLGAKGKVGSTMVAAVQAAEDLTLSAEVDAGDPLSLLTDGGTEAVIDFTHPDVVMGNLEFLVRNGIHAVVGTTGFTAERLAQVREWLADSPGTSVLVAPNFAIGAVLSMHFAKQAARFFDSAEVIELHHPHKADAPSGTATRTAKLIAEARKGLPPNPDATSTSLPGARGADVDGIPVHAVRLAGLVAHQEILFGTEGETLSIRHDSLDRTSFVPGVLLAVRRIREHPGLTVGLEPLLDLG

SEQ ID NO: 23972 - protein, 459 aa, Mycobacterium avium subsp. paratuberculosis str. k10
METYDLAIIGTGSGNSLLDARFAGKRTAICEHGTFGGTCLNVGCIPTKMFVYAADVATTIREAARYGVDTHLDGVRWPDIVSRVFGRIDPIALSGEEYRRSSVNIDLYRSHTRFGPVQFDGRYLLRTDAGEQFTAEQVVIAAGSRPVIPPAILESGVTYHTSDTIMRIPALPEHLVIVGSGFVAAEFAHIFSALGVHVTVVIRSGRMLRQYDDMICERFTRLAAAKWELRTQRNVVGGSNRGSGVTLRLDDGSTLDADVLLVATGRISNADLLDAGQAGVDVENGRVVVDEYQRTSARGVFALGDVSSPYQLKHVANHEARVVRHNLLCDWDDTESMAVTDHRYVPSAVFTDPQLATVGLTENQAIARGFDISVAIQNYGDVAYGWAMEDTTGVVKLIAERTSGRLLGAHIMGPQASSIIQPLIQAMSFGLTAAQMARGQYWIHPALPEVVENALLGLY

SEQ ID NO: 23973 - protein, 455 aa, Mycobacterium avium subsp. paratuberculosis str. k10
MSTARLINPATEEVLRSVEHADAAAVDDAVDRARAAQRRWARLAPADRAAGLRAFAAAVDAHRDELAALEVANSGHPIASAEWEAGQVRDVLTFYAGSPERLSGKQIPVAGGLDVTFHEPLGVVGVITPWNFPMPIASWGIAPALAAGNAVLVKPAEPTPVTTIRLAELAVQAGLDRDLLQVLPGPGTVVGERFVTHPDVRKIVFTGSTEVGKKVLAGAAAQVKRVTLELGGKSANIVFADCDLQRAAATAPAGVFDNAGQDCCARSRILVQRTVFDRFMELLEPAVTGIVVGDPASRDTQMGPLVSAAHRAKVASYVPDGAPVAFRGTAPTGPGFWFPPTVLTPSRTDRCVTEEIFGPVVTVLAFDDEQDAVALANDTSYGLSGSIWTNDLSRALRVSRAVEAGNLSVNSHSSVRYHTPFGGFKQSGLGRELGPDAPAQFTETKNVFIAIDEEP

SEQ ID NO: 23974 - protein, 461 aa, Mycobacterium avium subsp. paratuberculosis str. k10
MTGSDTAMLSLAALDRLVAAGAPETRVDTVIVAFPDMQGRLVGKRMDARLFVDEAAATGVECCGYLLAVDVDMNTVGGYAISGWDTGYGDLVMRPDLSTLRRIPWLPGTALVIADVVGADGSPVAVSPRAVLRRQLDRLAGRGLFADAATELEFMVFDEPYRQAWASGYRGLTPASDYNIDYAISASSRMEPLLRDIRRGMAGAGLRFESVKGECNRGQQEIGFRYDEALRTCDNHVIYKNGAKEIADQHGKSLTFMAKYDEREGNSCRVHLSLRDAQGGAAFADPSRPHGMSTMFCSFLAGLLATMADFTLFYAPNINSYKRFADESFAPTALAWGLDNRTCALRVVGHGAHTRVECRVPGGDVNPYLAVAAIVAGGLYGIEQGLALPEPCAGNAYRARGVGRLPGTLAEAAALFEHSALARQVFGDDVVAHYLNNARVELAAFHAAATDWERMRGFERL

SEQ ID NO: 23975 - protein, 373 aa, Mycobacterium avium subsp. paratuberculosis str. k10
MTKPLTDTAPVDPGAQRGSMPLTNRIQGAVTSVGVKVIPWIPTAVRRGLVRGRSVIIDGNTLDPTLQLMLSGLRAVGIDGLVVDDDPELSRAQMHESTVGFPGPQIHVDVAELALPGPAGDIPARHYRPAGGETQAPLLVFYHGGGWSIGDLDTHDSLCRLTCRDAGIHVLSIDYRLAPEHPAPAAIDDAYAAFTWAHEHAGELGAIPGRVAVGGDSAGGNLAAVVSQLARDAGGPAPVLQWLIYPRTDFTARTRSLSLFSRGFLLTKRDIDWFESQYLRNSRLDRTDPRVSPALAESLAGLAPALIAVAGFDPLRDEGQSYAEALRAAGTPVDLRYLGSLTHGFANLFQLGGDSMVATSELISALRAHLSRV

SEQ ID NO: 23976 - protein, 296 aa, Mycobacterium avium subsp. paratuberculosis str. k10
MTIPWTPDRLGDLTGRRVIVTGATNGVGLGTARALAKAGAEVILAVRNTELGKQRAAQMGGSTAVEKLDLADLSSVRAFADRIEAPVDILINNAGALTDRRTETVDGFEMTLGTNLLGPFALTNLLLPKVRSQIINVGSDAHRSATLHLDDLHLRRHKWTRLGAYAQSKLAVMLWGLELDRRLRAAGSPIVTQLTHPGWVASNLSNLGDAPLKAVAHKAVKVVADRLANDIDEGAAPTLYCISEPIPPGSYVGVSGRFGLRGGPVLIGRTPLACDYDTAARLVAFAERETGTELRV

SEQ ID NO: 23977 - protein, 346 aa, Mycobacterium avium subsp. paratuberculosis str. k10
MSTVSAYAATSATEPLTKTTIERRDPGPRDVAIDIKFAGICHSDIHTAKGEWGHTNYPVVVGHEIAGVVTEVGAEVTKYKVGDHVGVGCMVNSCRQCSSCTAGLEQYCKRGATFTYNSIDRDGSVTQGGYSQAIVVDEDFVVRIPDSLPLDKAAPLLCAGITLFSPLRHWNAGPGTRLAIVGLGGLGHMGVKLGAAMGAEVTVLSQSLKKMEDGLRLGAKHYHATADPDTFTKLRGSFDLMLNTVSANLKLNDYLSLLDVDGTLVELGIPEHPMEVGAFPLALARRSLSGSNIGGIAETQEMLDFCAEHNVTPEIELIEPDYINEAYERVLASDVRYRFVIDISKL

SEQ ID NO: 23978 - protein, 492 aa, Mycobacterium avium subsp. paratuberculosis str. k10
MTATISTPQYLLDQARRRFTPTLNTIPGMGAIEKRLLAHEWQTKVLAEPPAGSGLKPVLGDAGLPILGHIIELFRGGPDYALFLYRNHGPLIYLDSPIMPAVTALGPDATQAVFSNRNKDYSQKGWHPVIGPFFNRGLMMLDFDEHMYHRRIMQEAFTRSRLTGYVEHIDRVATAIVADWPTNDARFLFHPAMKELTLDIASLVFMGHEPGTDHDLVTTVNQAFTTTTRAGGAIIRQPIPPFKWWRGLRARQLLEDYFSERVKERRNATGNDMLTVLCHTEDDDGNSFTDDDIVNHMIFLMMAAHDTSTSTTTTMVYNMAAHPEWQERAREESARLGDGPLDIEALEKLETLELIMNESLRMVTPLPFNMRQAVRDTELLGHYIPAGTNITIWPGMNHRLPELWTDPDKFDPERFAEPRAEHKKHRYAFAPFGGGAHKCIGMVFGQLEVKTVVHRLLRRYRLELARPGYQPRWDYGGMPIPMDGMPIVLRPL

SEQ ID NO: 23979 - protein, 427 aa, Mycobacterium avium subsp. paratuberculosis str. k10
MVRIASVVARQLLDCKARPLVEVEITTDTGHVGRGAAPTGTSVGAHEAFVLRDGDPTRYRGRSVHRAVAAVRDEIAPALTGAELDDPRSLDRVMIELDDTPDKHRLGGNAIYSTSIALLRAAAAAAGTPTYTYVGALLGLTPPTTVPMPSFNMINGGRYGDVEQSFSEFLVVPYRAESIQAAVEKGVSLFEVLGEVLAEHLGRTPLLASSYGYIAPSGDPHAVLELLAEAVERAGCADVMAFALDCASSEVCDNGSATYAFNGGRVTAEALIDYARALSQEFPMLFIEDLLDGDDWAGFTKAVQTVNRSIIVGDDLIVTNRDRLRRAVETSAVDGFILMPNQVGTIAEALDCFEYASQNGLLAIPSGRSGGVIDDVVMDLAVGLGAPLQKNGAPRSGERIEKLNFLLRAAEGIPDCALADVPALARF

SEQ ID NO: 23980 - protein, 293 aa, Mycobacterium avium subsp. paratuberculosis str. k10
MPDWTAAQLPSFAGRTVIVTGANAGLGEVTARELARVGGHVILAVRNTDKGRAAADRMAGVATGRVEVRELDLQDLASVRRFADGIDTVDVLVNNAGIMATKHAVTVDGFEGQIGTNHLGHFALTNLLLPKLTDRVVTVSSLMHHFGYISLKDLNFRSRPYSAWLAYSQSKLANLLFTSELQRRLDAVPSSLRALAAHPGWSHTNLQGNSGRKLGDAAVLAVDRIVSTDADFGARQTLYAVSQDLPGDTFVGPRFGLYGRTQPTWRNWPAKRAGTAAALWELSEELTGTKFPL

SEQ ID NO: 23981 - protein, 505 aa, Mycobacterium avium subsp. paratuberculosis str. k10
MASRWRTKSVEQSIADTDEPDTRLRKDLTWWDLVVFGVAVVIGAGIFTVTASTTGDITGPAIWVSFVIAAGTCALAALCYAEFASTLPVAGSAYTFSYATFGEFLAWIIGWNLLLELAIGAAVVAKGWSSYLGTVFGFSGGTVKFGAAQLDWGALVIVGGVATLIALGTKLSSRFSAVITGIKVSVVVFVVVVGVFYIKRANYSPFIPKPEAGGQAKGIDQSVLSLLTGAHTSHYGWYGVLAGASIVFFAFIGFDIVATMAEETKHPQRDVPRGILASLGIVTLLYVAVAVVLSGMVSYTQLKTMPGRGQANLATAFTANGIHWASKIISIGALAGLTTVVMVLMLGQCRVLFAMARDGLLPRALAKTGSRGTPVRITVLVALVVAVTASVFPITKLEEMVNVGTLFAFVLVSAGVMVLRRTRPDLERGFKAPWVPVLPIASIGACVWLMLNLTALTWVRFGIWLVVGTAIYAGYGYWHSVQGRRDAGEPDRSDALAADPNSPVP

SEQ ID NO: 23982 - protein, 492 aa, Mycobacterium avium subsp. paratuberculosis str. k10
MARLLLPPRCGGHRRRARLGVVVTRIVILGGGPAGYEAALVAASSHPDSTHVTVIDSEGIGGAAVLDDCVPSKTFIASTWLRTELRRAPRLGFEIDIDDAKISLPQIHARVKQLATEQSADITEQLLGVGVHVVAGRGELIDPTPGLARHRIKATAPDGSSSEYEADVVLIATGASPRILPSAQPDGERILTWRQLYNLDALPDHLIVVGSGVTGAEFVHAYTELGVPVTVVASRDRVLPYEDADAALVLEEAFSERGVQLVKNARAQSVTRTPDGVLVTLTDGRTVAGSHALMTIGSVPNTAGLGLERVGIELGRGGYLTVDRVSRTSVPGIYAAGDCTGLLPLASVAAMQGRIAMYHALGEGVSPIRLRTVAATVFTRPEIAAVGVPQTMIDDGSVSARTIMLPLRTNARAKMSGLRQGFVKVFCRKSTGVVIGGVVVAPIASELILPIAVAVQNRITVNELAQTLAVYPSLSGSITEAARRLMAHDDLD

SEQ ID NO: 23983 - protein, 437 aa, Mycobacterium avium subsp. paratuberculosis str. k10
MHFARHGPDITPPIITRGHGVTIYDDRGNSYLDGLSGLFTVQVGHGRAELAEAAARQAGTLAFFPLWGYATPPAIELAERLAGYAPGDLNRVFFTTGGTEAVETAWKLAKQYFKLTGKPGKHKVISRAVAYHGTTQGALAITGLPRYKAPFEPVTPGGFRVPNTNFYRAPEAFANDPKGFGLWAADRIAEAIEFEGPDTVAAVFVEPVQNAGGSIPPPPGYFERVREICDRYDVLLVSDEVICAFGRIGSMFACADFGYVPDMITCAKGMTSGYSPIGAMIASERLFEPFDDGDTMFPHGYTFGGHPVSAAVGLVNLDIFEREGLNDRVRTLAPTFRATLEKLYDLPIVGDVRGEGFFYGVELVKDRATKQTFTDSERRALLGRVGAALFEAGLYCRTDDRGDSVIQLAPPLISGQAEFDTIEAALRGVLSDECRRL

SEQ ID NO: 23984 - protein, 450 aa, Mycobacterium avium subsp. paratuberculosis str. k10
MARGSRRGLLVGLTAASVGVIYGYDLSIIAGAQLFVTEDFGLSTRQQELLTTMAVIGQIGGALFAGVLANAIGRQRSVLLILSGYAVFALLAAFSVGLPMLLTARLLLGLTIGVTVVVVPVYVAESAPTAVRGALLTAYQLAIVSGLIVGYLSGYLLADTHSWRWMLGLACVPAVLLLPLVFRMPDTARWYLLKGRVDDARRALLRVEPVARVDDELAEIDRAVSEEAASLPAMLAEMVRSPYRRATVFVVVLGFLIQITGINAIIYYSPRIFEAMGFTGNFALLALPALVQVAGLVAVGTALLLVDRVGRRPILLCGTAMMIVADVVLVAVFGRGPGGVIAGFAGVLLFIFGYTMGFGSLGWVYASESFPSRLRSIGSSTMLTSNLVANAIVAAVFLTLLHSLGGAGTFAVFAVLAVVAFAFVHRYAPETKGRQLEDIRHFWENGGRWD

SEQ ID NO: 23985 - protein, 405 aa, Mycobacterium avium subsp. paratuberculosis str. k10
MPTPPDVFSPAKLGPITLRNRIIKSATFEARTPDALVTDDLIEYHRLPAVGGVGMTTVAYCAVSPGGRTEGNGIWMRPEAVPGFRRLTDAIHAEGAAVSAQIGHAGPVANARSNKAQALAPVRFFNPIGMRFAKKATRDDIDEVIAAHANAARLAIEAGFDAVEIHLGHNYLASSFLSPLINRRNDEFGGSLQNRAKVARGMVMAVRRAVEKEGTPIAVTAKLNMADGVRGGISTEESLTTAKWLESDGGLDAIELTAGSSLVNPMYLFRGDAPLKEFAGAFKPPLRWGMRMTGKKFLREYPYRDAYLLRDAKLFRAELKMPLILLGGITNRETMDLAMAEGFEFVAMARALLAEPDLINRIAADGAAHRVHSACTHCNQCMPTIYSRTHCVVTGAPDRHTSAAT

SEQ ID NO: 23986 - protein, 391 aa, Mycobacterium avium subsp. paratuberculosis str. k10
MGESGPVVIDPRRHDAVLFGVGDALGSALASQLGQIGVGTAAFAADGPAAAADRLRVRPGRCVVVAGDPAAVEAARTAGFALVIGLAPVGRDGDGLRGAGADAVVAELEQITVRTGDRRMSQLPDASQALTGGADGLAGRHPAVFFDFDGTLSDIVDDPDAARPVAGATAALTRLAARCPVAVLSGRDLADVTKRVGVLGIWYAGSHGFELTAPDGSHHQNDDAAAAIPVLAQAAGRLRDELGAIPGVVVEHKRFGVAVHYRNAARDRVGEVAAAVRAAGRHDALRVTTGREVIELRPDLDWDKGKTLHWVIEHLRRSGSGALTPVYLGDDITDEDAFDAVRGGPVQGVPILVRHNDDGDRATAALFALDSPARAAEFTERLADQLERGEG

SEQ ID NO: 23987 - protein, 386 aa, Mycobacterium avium subsp. paratuberculosis str. k10
MKCRAAVIRGVGRDWEIAEIELDPPRSGEVLVRMAVAGICHSDDHLFTGDVVPTPEVVAASGQPAPDWFPLLGGHEGAGVVAEVGPNVTSVRPGDHVALSFIPACGSCRFCVNGQSYICDIGASLFQREMPTDGTCRRHLGAENLLAYGQLGTFAEYAVLSERSVIKIDEAIPFHAASLVSCGVSTGWGSATVSAGTEPGDTVVVIGAGGVGMNALQGARAVGAKYVVAVDPVAAKRDSAKIFGATHTAASARDAIPLVREITAGLMADRVVVCPGVVHVDLIPLALALLRKGGVCVLTGITPFTEPPVPLVLQEMTLSAKQLRGALYGGMNPRTSVPMLLSLYQAGDLKLDELVTRHYRLDEINEAFADLREGRNIRGVIDFASR

SEQ ID NO: 23988 - protein, 478 aa, Mycobacterium avium subsp. paratuberculosis str. k10
MREYLKFYIDGQWVDPVRPNTFDVENPATEQVCGKISLGSAADVDVAVGAARRAFGRWSQSSREDRLDLLQAILAEYQKRADDLAAAVTEEIGAPPSLAAGPQVFLGIGHLTTAIEVLKNFPFTEQRGATLIAREPIGVCGLITPWNWPINQVAVKVYPALATGCTVVLKPSEVAPFSSYIFAEILAAAGVPAGVFNLVNGDGPGVGAALASHPDIDLVSFTGSTRAGVEVARNAAPTVKRVTQELGGKSPNIVLDDGGFADAVRAGVANMMPNSGQSCNAPSRMLVPASRMAEAISIAREVAEQVQVGDPDDATAIGPVASRAQFEKVQRLIQQGIDEGATVVAGGPGRPAGLDQGYYVKPTVFADVTNDMTIAREEIFGPVLCILGYDDLDHAVRLANDTDYGLAGYVSGADLDTAREVAGKIRAGWVTINHAFDLNAPFGGYKRSGNGREWSDFGFHEYLEVKSILGYAPAQGDQ

SEQ ID NO: 23989 - protein, 439 aa, Mycobacterium avium subsp. paratuberculosis str. k10
MHERSSHRPAGRGPPASRGPSPKLLQGIGFAVSRRTMMRRLSRRYGNVFTLRLPMWGPVVMVSDPQLAKQIFTTTPDELGNIQPNLSRLFGSGSVFGLEGDDHRRRRRLLAPPFHGKSMKNYESIIEEETLRETAGWPEGESFPTLPPMMRITLNAILRAVFGAEGAELDELRRLIPPWVTLGSRLAALPKPQRYPRFGPWGQLDRWRRHYDGVIERLIAAEQADPNFAERTDVLALLLRSTYDDGAAMSHKEIGDELLTLLAAGHETTASTLAWAFERISRHPELLARLVEEADNGGNELRQATILEVQRARTVIDFAGRHVYPDVYRLGEWVIPRGYSIIVGIAQIHDNPDVFPDPRRFDPQRFIDNKPSALSWIPFGGGTRRCVGAAFANMEMDVVLRTVLRHFTIETTDAPDEPWHCRGVAFTPKHGGRIVVHRR

SEQ ID NO: 23990 - protein, 488 aa, Mycobacterium avium subsp. paratuberculosis str. k10
MSGRRAARLCSGRTMMTTESVASKTTTSANGTASADIAGTVARLRQTFATGRTRDVEWRKRQLLQLQKLMEENEAAIAAALAEDLDRGPFEAYIADIATTAGEAKYAAKRVRKWTRRRYQLLELPQLPGRGWVEYEPYGTVLIIGAWNYPFYLTLGPAVGAIAAGNAVILKPSEIAAASSRVMAELVPKYLDNDAIAVIEGDGATSQELIAQGLDRVMFTGGTEIGRKVYEGAAPHLTPCTLELGGKSPVIVAADADVEVAAKRIAWMKLLNAGQTCVAPDYVLADAKIRDELVDKIGAAITKFTADKPEGMRVVNQRQFDRISSYLSGSDGKVTVGGACDPSTLRIQPAVVVDPDPDGPLMRNEIFGPVLPVITVQNLDEAIRFVNSRPKPLSAYLFTKTRETRERVIKEVPAGGMLINHLAFQVSTAKLPFGGVGASGMGAYHGRYGFEEFSHRKSVLTKPTRPDLSSFIYPPYTERAFKMARKMF

SEQ ID NO: 23991 - protein, 305 aa, Mycobacterium avium subsp. paratuberculosis str. k10
MTALDGAERLDPALRAVATTRTDFSPAAIELTRAPFNERRRLAAAQTDTAGVRIVDDDANGVGVRIYRGGPEPAPAVIYCHAGGFALGNLDTDHRQCVELARRGRCTVVSVDYRLAPEHPYPAALQDAGTVLRWVHAEAAALGVDPARLAVAGSSAGAALAACLAHPDGSLPAVVFQLLHQPVLDDRATGSKARFRTSPAFDGEAAELMWRYYLGPTVGSAAAVPARRPELAGLPPALITCAEIDPFRDEAIDYARRLLDAGVCTELHVFARACHGFDSLLPDWPGSQRLFALQGEVLSAALHRD

SEQ ID NO: 23992 - protein, 363 aa, Mycobacterium avium subsp. paratuberculosis str. k10
MLQRIGAPRPYARSRPITITDVELAPPGRDEVLVRIEAAGICHSDLSVVDGNRVRPVPMLLGHEAAGIVERVGPGVADLAVGARVVLVFLPRCGRCAACATEGLTPCEPGSAANGAGTLLGGDIRLSRAGRPVYHHLGVSGFATHAVVNRASAVEVPPDVPAEVAALLGCAVLTGGGAVFNVGRPAPGQTVAVVGLGGVGMAALLTALTYDGVPVVAVDQLPEKLAAARRLGAHQAYTPQQAVEARVKAAVVIEAVGHPAALQTAIDLTAPGGRTITVGLPPPDARITLSPLGFVAEGRSLIGSYLGSAVPSRDIPRFVELWRAGRLPVESLVSSTIRLEDINEAMDHLADGTAVRQLIRFDA

SEQ ID NO: 23993 - protein, 493 aa, Mycobacterium avium subsp. paratuberculosis str. k10
MSDIQTQAKTEYDKLFIGGKWTEPSTSEVIEVHCPATGEYVGKVPLAAAADVDAAVAAARAAFDNGPWPTTPPKERAAVIANALKVMEERKDLFTGLLAAETGQPPTSVETMHWMSSIGALNFFAGPAVDQVKWKEVRTGGYGQSIVHREPIGVVGAIVAWNVPLFLAVNKLGPALLAGCTVVLKPAAETPLSANALAEAFAEAGLPEGVLSVVPGGIETGQALTSNTDVDIFSFTGSSAVGREIGRRGADMLKPCTLELGGKSAAIVLDDVDLPSALPMLVFSGIMNSGQACVAQTRILAPRSRYDEIVDAVSTFVQSLPVGLPSDPAAQIGSLISEKQRARVEGYIAKGIEEGARLVCGGGRPEGLDSGFFVQPTVFADVDNKMTIAQEEIFGPVLSIIPYDTEEDAIKIANDSVYGLAGSVWTADVQRGIAVSEKIRTGTYAINWYAFDRCCPFGGYKNSGIGRENGPEGVEHFTQQKSVLMPMGYTLEG

SEQ ID NO: 23994 - protein, 476 aa, Mycobacterium avium subsp. paratuberculosis str. k10
MRDDDSANRWSGVREAPTAPSRQLTGAVVIIALVAAISGMLYGYDTGVISWALLQLTQDFNITEGWQQVIAASILLGAVAGALTCSWLSDLRGRRGTLLMLAVVFIVGALWCADAADSVMLSLGRLVLGFAVGGATQTAPMYVAELAPPAYRGRLVLCFQIAIGVGILTATLVGAGGSISWRGPIGLACVPAAIMLWLLLRLPESPRWLVKKDNRDAARAVLEHVRPEGYDVAAELDEATELARVERTAATRGWRGLRDAWVRPALVLGCGIAVFTQLSGIEMIIYYSPTILTDDGVYRSVALQVSVCLGAAYLIAQLVGLAIIDRVGRRRLTLIMVPGAAVSLFALGLLFITSDSGRDVIPYIMICLIAFMLFNGGGLQLMGWLTGSETYPLAVRPAATALQSATLWGTNLVITLTMLSLIKAIGVGPLMWLYALFNVAAWIFVFFRMPDLTGKTLEEIEYQLSEGKFRPSDFGR

SEQ ID NO: 23995 - protein, 449 aa, Mycobacterium avium subsp. paratuberculosis str. k10
MSKVHPDAESALHGLLKDGITVAAGGFGLCGIPEKLIQALVDSGIKDLTIVGNNAGVDDFGMGLLLKGRQVKKVIASYVGENKEFERQVLSGELDLVLTPQGTLAEKLRAGGAGIPGFYTRTGYGTTLAEGKDTRVFDGVEYVLEEGIRADLAIVKAWKGDKAGNLVYRKTARNFNPMIATCAAVTVAEVEELVEVGDLDPDLIHTPGIYVDRIIQGIGYEKRIEFRTTSGGAALKNDSPIRERMAQRAAKELRDGYYVNLGIGIPTLVANFIPDDIQVTLQSENGLLGIGAYPSEDTVDPDLINAGKQTITSLPGSSFFSSADSFAMIRGGHIDLSILGALEVASNGDLANWMVPGKMVKGPGGAMDLVSGVKRVIVLMDHTAKDGSPKVLEQCTLPLTGKGVVDMIITTLCVFDVEPGRGLLLTELHPGVTVEEVRAKTGCDFTVAL

SEQ ID NO: 23996 - protein, 398 aa, Mycobacterium avium subsp. paratuberculosis str. k10
MSTETSTKTPPSFDRYDPLGLDALLSDDERAVRDTVRGFCAEHVLPHVAEWFEIGDLPVRELAREFGRLGLLGMHLHGYGCGGASAVHYGLACVELEAADSGLRSMVSVQGSLAMFAIWNFGSEEQKRQWLPGMATGELLGCFGLTEPDVGSDPAAMKTRARRDGSDWVLDGRKLWITNGSVADVAVVWAGTDDGIRGFLVPTDTPGFTANTIHHKLSLRASITSELVLDDVRLPGEAMLPGATGLRGPLSCLSEARYGIIWGARGAARSAWQAALDYATQRTQFGRPIAGFQLTQAKLVDMAVELHKGQLLSLHLGRLKDSTGLRPEQVSFGKLNNTREAIEICRTARTILGGNGISLEYPVIRHMVNLESVLTYEGTPEMHQLVLGQAFTGADAFR

SEQ ID NO: 23997 - protein, 312 aa, Mycobacterium avium subsp. paratuberculosis str. k10
MAPHDKQHRDWSEADVGDQSGRVVVITGANTGIGYETAAVLAHRGAHVVLAVRDLEKGNAALSRIVAASPNADVTLQQLDLASLASVRSAAEALRAAYPRIDLLINNAGVMWTPKQVTEDGFELQFGTNHLGHFALTGLLLDHLLGVRDSRVVTVSSLGHRLRAAIHFDDLHWERRYDRVAAYGQSKLANLLFTYELQRRLAAAPDAKTIAVAAHPGGSNTELARHLPGIFRPVQAVLGPVLFQSPAMGALPTLRAATDPAVQGGQYYGPDGFLEQRGRPKLVESSAQSHDEQLQRRLWAVSEELTGVHFPV

SEQ ID NO: 23998 - protein, 507 aa, Mycobacterium avium subsp. paratuberculosis str. k10
MTVFARPGSAGALMSYESRYDNFIGGQWVAPARGRYFENPTPVTGQTFCEVARSDEADVDKALDAAHAAAPAWGKTAPAERAAILNKIADRIEENLESLAVAEVWDNGKPIREALAADIPLAADHFRYFAGALRAQEGSLSQIDDDTVAYHFHEPLGVVGQIIPWNFPILMGAWKLAPALAAGNAVVLKPAEQTPVSVLYLMSLIGDLLPPGVVNVVNGFGAEAGKPLASSNRIAKIAFTGETTTGRLIMQYASQNLIPVTLELGGKSPNIFFSDVMAKADDYQDKALEGFTMFALNQGEVCTCPSRSLIQADIYDEFLELAAIRTKAVRQGDPLDSETMLGSQASNDQLEKVLSYIAIGKDEGATIITGGERAELGGDLSGGFYMQPTIFAGNNKMRIFQEEIFGPVVAVTSFTDYDDAISIANDTLYGLGAGVWSRDGNTAYRAGRDIQAGRVWVNCYHAYPAHAAFGGYKQSGIGRENHKMMLDHYQQTKNMLVSYSNKAQSFF

SEQ ID NO: 23999 - protein, 431 aa, Mycobacterium avium subsp. paratuberculosis str. k10
MTSHYDVVVLGAGPGGYVAAIRAAQLGLSTAIVEPKYWGGVCLNVGCIPSKALLRNAELAHIFTKEAKTFGINGEATFDYGAAFDRSRKVAEGRVAGVHFLMKKNKITEIHGYGRFTDPHTLAVELNDGGTETVTFDNAIIATGSSTRLVPGTSLSANVVTYEEQILSRELPESIIIAGAGAIGMEFGYVLHNYGVEVTIVEFLPRALPNEDADVSKEIEKQFKKLGVKILTGTKVESISDDGSQVTVVVSKDGNSQELKAAKVLQAIGFAPNVEGYGLEAAGVALTDRKAIGITDYMRTNIEHIYAIGDVTGKLQLAHVAEAQGVVAAETIAGAETLALGDYRMMPRATFCQPNVASFGLTEQQARDEGHDVVVAKFPFTANGKAHGVGDPSGFVKLIADANTVSCWAGTWSATTSPSCCRSSPWRRSGT

SEQ ID NO: 24000 - protein, 249 aa, Mycobacterium avium subsp. paratuberculosis str. k10
MGETATLVLLRHGESEWNSLNLFTGWVDVGLTDKGRAEAVRSGELLAEQGLLPDALYTSLLRRAITTAHLALDAADRLWIPVRRSWRLNERHYGALQGLDKAETKARYGEEQFMAWRRSYDTPPPPIERGSTYSQDADPRYADIGGGPLTECLADVVVRFLPYFTDVIVPDLRSGKTVLIVAHGNSLRALVKHLDQMSDDDVVGLNIPTGIPLRYDLDARLRPLVPGGTYLDPEAAAAGAAAVASQGRG

SEQ ID NO: 24001 - protein, 316 aa, Mycobacterium avium subsp. paratuberculosis str. k10
MLALGGVIGAGLFVGSGVVIKDTGPAAFLTYALCGLLIVLVMRMLGEMAAANPSTGSFADYAAAALGRWAGFSVAWLYWYFWVIVVGFEAVAGGKVLNYWFHAPLWVLSLGLMLLMTATNLFSVSSFGEFEFWFAGIKVATIVIFLAVGAAYVVGLVPGHHDGLTNLVSHGGFFPRGVGAVFAAIVVVIFSMVGAEIVTVAAAESRDPRRAVQKATRSVVTRIGIFFVGSVFLLVAILPWDSVELGASPYVAALKHLGLAGADQVMNAVVLTAVLSCLNSGLYTASRMLFVLAERGEAPARLVRLSGRGVPHIAIL

SEQ ID NO: 24002 - protein, 445 aa, Mycobacterium avium subsp. paratuberculosis str. k10
MGSSDQATAHARAQAASARLFDDACAVIPGGVNSPVRAFTAVGGTPPFITAARGCRLTDADGNHYVDLVCSWGPMILGHAHPAVVEAVAKAAASGLSFGAPTPAESELAAEMIARVAPVERIRLVNSGTEATMSAVRLARGFTGRAKIVKFSGCYHGHVDALLADAGSGVATLGLPSSPGVTGATAADTIVLPYNDIDAVRQAFTEFGDQIAAVITEASPGNMGVVPPAPGFNAALRALTADHGALLIVDEVMTGFRVSRSGWYGIDPVDADLFTFGKVMSGGLPAAAFGGRAEVMERLAPLGPVYQAGTLSGNPVAMAAGLATLRHADAAAYAALDANADRLARLLSDALTNAGVPHQIPRAGNMLSVFFTDTPVTDFASARATQTWRYPPFFHALLDAGVYPPCSAFETWFVSTALDDDAFDRIAAALPAAARAAAGADEGNS

SEQ ID NO: 24003 - protein, 257 aa, Mycobacterium avium subsp. paratuberculosis str. k10
MSSRKLIGVHDHRGEYGVDGSFHTVSARAQAIGIGAQAAGLAVWAGISWARGKRRRAALAALSSAGIAANTALYMYATRAGKFVVWDRILSDLRLAGDETLLDLGCGRGAVLLAAAKRLPRGRAIGVDLWQADQTDNSEQATLANAAAEGVADRVELHTADMTALPLADESVDVVVSNLAIHNIPTRAGRRQALDEAVRVLRPGGRLAIADLWETRQHAARLRELCWRNVRRRNLGWRMWYGGPWFSTRIVTATKPE

SEQ ID NO: 24004 - protein, 336 aa, Mycobacterium avium subsp. paratuberculosis str. k10
MGVAIEVNGLTKSFGSSRIWEDVTLEIPAGEVSVLLGPSGTGKSVFLKSLIGLLRPERGSVVIDGTDILQCSAKELYEIRTLFGVMFQDGALFGSMNLFDNAAFPLREHTKKKESEIRDIVMEKLELVGLGGDEKKFPGEISGGMRKRASLARALVMDPQIILCDEPDSGLDPVRTAYLSQLILDINAQIDATVLIVTHNINIARTVPDNMGMLFRRKLVMFGPREVLLTSDEPVVKQFLNGRRIGPIGMSEEKDEATMAEEQAALEAGQHAGGVEEIEGVPPQIVASPGMPERKAVARRQARVREILHTLPQKAQAAILDDLEGTHKYRAHEVGD

SEQ ID NO: 24005 - protein, 398 aa, Mycobacterium avium subsp. paratuberculosis str. k10
MSSDASASNGIVIVGGGLAAARTAEQLRRSEYSGPITIVSDEVHLPYDRPPLSKEVLRKEVDDTALKPRQWYDDNDITLRLGSAARSLDTAAQTLTLEDGTTLGYDELVIATGLVPRRIPTIPDLDGIRVLRTFDESLALREHASAAQRAVIIGAGFIGCEVAASLRSLGVDVVLVEPQPTPLAAVLGEQIGELVARLHRAEGVDVRLGVGVAQVRGDTHVEAVVLTDGTELAADVVVIGIGSRPATDWLEGSGVAIDSVDRGVLCDEAGRTSAPNVWALGDVASWRDATGHQGRVEHWSNVADQARVVVPAMLGKEVPPVVVVPYFWSDQYDVKIQCLGEPEADDIVHIVEDDGRKFLAYYERDGALVGVVGGGMPGKVMKTRAKIAAAVPIAEMLG

SEQ ID NO: 24006 - protein, 181 aa, Mycobacterium avium subsp. paratuberculosis str. k10
MRVVLLGPPGAGKGTQAQKLSEKLGIPQISTGELFRSNIENGTKLGLEAKRYLDAGDLVPAELTNQLVDDRLSEPDAANGFILDGFPRSLQQAKALHEMLERRGTDIDAVLEFRVSQDELLARLKARGRADDTDEVILNRMKVYRDETAPLLDYYRDQLKTVDAVGTLDEVFARALCALGK

SEQ ID NO: 24007 - protein, 295 aa, Mycobacterium avium subsp. paratuberculosis str. k10
MTERVVVAFLGLGNMGAPMAANLVAAQHAVRGFDPVPAALSAATASGVTGFDTATDAVTGADVVITMLPNGEVVKRCYAEILPAARPGALFIDSSTISVADAREVHAQAQSHGVAQLDAPVSGGVKGAVAGTLAFMVGGEPEALERARPVLEPMAGKIIHCGAAGAGQAAKVCNNMVLAVQQIAIGEAFILAEKLGLSAQSLFDVITGATGNCWAVHTNCPVPGPVPTSPANNDFKPGFAASLMNKDLGLAMDAVTSTGAAAPLGRHAAEIYAKFAASHGDKDFSAVIEMLRGAC

SEQ ID NO: 24008 - protein, 473 aa, Mycobacterium avium subsp. paratuberculosis str. k10
MRHYYSVDAIRAAEAPLLASLPDGALMRRAAFGLATEIAAELTARTGGVAGRRVCAVVGSGDNGGDALWAATFLRRRGAAADAILLNPERAHRKGLAAFGKAGGRIVESVSPTTDLVIDGVVGISGSGALRPAAAEVFAAVDDAGIPVVAVDIPSGIDAATGATSGPAVHAVLTVTFGGLKPVHALGDCGRVKLIDIGLDLPQTDVLGFEAADVAARWPVPGPHDDKYTQGVTGVMAGSATYPGAAVLCTGAAVAATSGMVRYAGSAHREVLAHWPEVIASPTPASAGRVQSWVVGPGLGTDDAGAAALWFALETDLPVIVDADGLTMLAAHPELVANRAAPTVLTPHAGEFARLAGSPPGDDRVGATRKLADTLGVTVLLKGNVTVIADPGGPVYLNPAGQSWAATAGSGDVLSGMIGALLASGLPAGEAAAAAAFVHARAAALSAADPGPGEAPTSSSRMVPHIRAALAAL

SEQ ID NO: 24009 - protein, 265 aa, Holcus lanatus
MASSSRSVLLLVAALFAVFLGSAHGIAKVPPGPNITATYGDEWLDAKSTWYGKPTGAGPKDNGGACGYKDVDKPPFSGMTGCGNTPIFKDGRGCGSCFEIKCTKPESCSGEPVTVHITDDNEEPIAPYHFDLSGHAFGSMAKKGEEQKLRSAGELELKFRRVKCKYPDGTKPTFHVEKGSNPNYLALLVKYIDGDGDVVAVDIKEKGKDKWIELKESWGAVWRVDTPDKLTGPFTVRYTTEGGTKGEAEDVIPEGWKADTAYEAK

SEQ ID NO: 24010 - protein, 349 aa, Solanum tuberosum
MAGSNINQPLLDQLPKTLQNVDSRRRRLRRLKSAPMPEFVPGEMNDIKDDQSLPRYESILDKLHPSFRKVILYLAIYLTIGTTCFYFVQNQIQGKKVNGVLDSVYFCVVTMTTVGYGDLVPNSATAKLLASFFVFSGMALVGMVLSKGADYLVEKQETLLIKALHMRDKVGPSVILEEIETNKVRYKCFVITATLVVLIVVGTVFLAEVEKLSTIDAFYCVCSTITTLGYGDKSFSTKAGRIFAIFWILTSTLCLAQFFLYVAEFNTERKQKELVQWVLSRKMTNVDLEVADLDNDRVVAAAEFVVYKLKEMGKISQDDVSLLLDEFECLDVDQSGTLSTTDLSLAQSS

SEQ ID NO: 24011 - protein, 129 aa, Neurospora crassa
MEGIKQTFQRCKAQNRAALVTYVTAGFPHPEQTPDILLAMEKGGADVIKLGVPFTDPIADGPTIQTANTIALQHGVTLQSTLQMVRDARQRGLKAPVMLMGYYNPLLSYGEERLLNDCKEAGVNGFIIV

SEQ ID NO: 24012 - protein, 129 aa, Neurospora crassa
MEGIKQTFQRCKAQNRAALVTYVTAGFPHPEQTPDILLAMEKGGADVIELVVPFTDPIADGPTIQTANTIALQHGVTLQSTLQMVRDARQRGLKAPVMLMGYYNPLLSYGEERLLNDCKEAGVNGFIIV

SEQ ID NO: 24013 - protein, 129 aa, Neurospora crassa
MEGIKQTFQRCKAQNRAALVTYVTAGFPHPEQTPDILLAMEKGGADVIELGVPFTDPIADDPTIQTANTIALQHGVTLQSTLQMVRDARQRGLKAPVMLMGYYNPLLSYGEERLLNDCKEAGVNGFIIV

SEQ ID NO: 24014 - protein, 131 aa, Neurospora crassa
MEGIKQTFQRCKAQNRAALVTYVTAGFPHPEQTPDILLAMEKGGADVIELGVPFTDPIADGPTIQTATANTIALQHGVTLQSTLQMVRDARQRGLKAPVMLMGYYNPLLSYGEERLLNDCKEAGVNGFIIV

SEQ ID NO: 24015 - protein, 193 aa, Neurospora crassa
VNGFIIVDLPPEEAVSFRQLCTRGGLSYVPLIAPATSDARMRVLCQLADSFIHVVSRQGVTGASGTLNANLPELLARVKKYSGNKPAAVGFGVSTHDHFTQVGAIADGVVVGSMIITTIQKAAKGEEVKAVQEYCSYLCGRNFEQSAHELNMGEALEAAKEPVGTATVDGVITEADIDAQLAALHGTIPKRFG

SEQ ID NO: 24016 - protein, 193 aa, Neurospora crassa
VNGFIIVDLPPEEAVSFRQLCTRGGLSYVPLIAPATSDARMRVLCQLADSFIYVVSRQGVIGASGTLNANLPELLARVKKYSGNKPAAVGFGVSTHDHFTQVGAIADGVVVGSMIITTIQKAAKGEEVKAVQEYCSYLCGRNFEQSAHELNMGEALEAAKEPVGTATVDGVITEADIDAQLAALHGTIPKRFG

SEQ ID NO: 24017 - protein, 193 aa, Neurospora crassa
VNGFIIVDLPPEEAVSFRQLCTRGGLSYVPLIAPATSDARMRVLCQLADSFIYVVSRQGVTGASGTLNANLPELLARVKKYSGNKPAAVDFGVSTHDHFTQVGAIADGVVVGSMIITTIQKAAKGEEVKAVQEYCSYLCGRNFEQSAHELNMGEALEAAKEPVGTATVDGVITEADIDAQLAALHGTIPKRFG

SEQ ID NO: 24018 - protein, 193 aa, Neurospora crassa
VNGFIIVDLPPEEAVSFRQLCTRGGLSYVPLIAPATSDARMRVLCQLADSFIYVVSRQGVTGASGTLNANLPELLARVKKYSGNKPAAVGFGVSTHDHFTQVGAIADGVVVGSMIITTIQKAAKGEEVKAKQEYCSYLCGRNFEQSAHELNMGEALEAAKEPVGTATVDGVITEADIDAQLAALHGTIPKRFG

SEQ ID NO: 24019 - protein, 343 aa, Medicago truncatula
MDMKLSITAIVLSFATLGIAQPNIFDIKSFGGASNADITMAFTNAWKAACGSTTASKVIIPRGIYKIHAVDVKGPCKAPIEVQVDGTIQASQNPDELNDASYQWVKFGYVDYFTLSGKGVFDGNGETAWTQNDCGKNSTCKRRSMNFGFNFLKLSIVQDIISKDSKNFHVNVLGCTNFTFDGLTITAPATSKNTDGIHIGRSTDDVKVLNTNISTGDDCISLGQGSRQITVQNVNCGPGHGISVGSLGKNPKEEATEHVLVKNCTISNTDNGVRIKTWPSSPGTSPITDMHFEDTIMVNVLNPVIIDQEYCPWNQCSKQVPSKIKISKVIFKNIRGTTTAAAV

SEQ ID NO: 24020 - protein, 507 aa, Saccharomyces cerevisiae
MTKSEQQADSRHNVIDLVGNTPLIALKKLPKALGIKPQIYAKLELYNPGGSIKDRIAKSMVEEAEASGRIHPSRSTLIEPTSGNTGIGLALIGAIKGYRTIITLPEKMSNEKVSVLKALGAEIIRTPTAAAWDSPESHIGVAKKLEKEIPGAVILDQYNNMMNPEAHYFGTGREIQRQLEDLNLFDNLRAVVAGAGTGGTISGISKYLKEQNDKIQIVGAEGFGSILAQPENLNKTDITDYKVEGIGYDFVPQVLDRKLIDVWYKTDDKPSFKYARQLISNEGVLVGGSSGSTFTAVVKYCEDHPELTEDDVIVAIFPDSIRSYLTKFVDDEWLKKNNLWDDDVLARFDSSKLEASTTKYADVFGNATVKDLHLKPVVSVKETAKVTDVIKILKDNGFDQLPVLTEDGKLSGLVTLSELLRKLSINNSNNDNTIKGKYLDFKKLNNFNDVSSYNENKSGKKKFIKFDENSKLSDLNRFFEKNSSAVITDGLKPIHIVTKMDLLSYLA

SEQ ID NO: 24021 - protein, 474 aa, Escherichia coli
MSSPLIPVILSGGNGTRLWPLSREEYPKQFLKLTDSISMLQSTISRLDSLNTSSPVVICNELHRFIVAEQLRHLNKLDNNIILEPSGRNTAPAICIAALILKMKHPNENPLMLVLPADHSVKKVKTFCNTIKSAIPFAEAGNLVSFGIKPTHPETGYGYIQKGKVLSDSDIYEVSEVRTFVEKPNLKTAESFIEKDEYYWNSGMYLFSVERYLQELSLYRPDIVKVCQETVKNIHYDMDFIRLDDKIFRNCPQESIDYAVMEKTKDAVVATMDIGWNDVGAWSSLWELGKKDSSGNVITGDIVCHETENSYIYTESGLVATIGIQDLVIIHTKDSLLVSRRDSVQNVKNIVQHLDLSGRKEHKEHREVFKSWGRCDSIDSSEKYHYQVKRITVNPSEKLSLQLHHHRAEHWVVVMGIAKLTVAEEIKILKENESVYIPAGIKHSLENIGTIPLVLIEVWTGSYLADDDILRFED

SEQ ID NO: 24022 - protein, 352 aa, Aspergillus fumigatus
MGSLAPTIVPPGGLVLVTGVNGFLASHIALNLLERGYKVRGTVRSQEKADWITEAIAKRYPDASFETALVPNISAPGAFNEAIRGVDGIAHVASDLSFGSDPNKVITPMLEALRHILTSAAKEPSVKRFVLTSSAIAALTPQPEQAIHVDTNTWNDSSIERAWRPAPYEPERCWDVYAALKTSTERELWRFAQENNPAFVVNAVLPDFIVGPIIHARQNGSTGRWVKEFFDDPVHYSKPLQTFIPRHFVDVTDVALLHLAGLTHEDVQSERLLAFAGPFNFNSWLHVFRQIDPAKPWPADDPNQVHDRSTVDTRRSKELLKRYSRLDFTSFFDSVRDNCLNSDPEWKRSNFP

SEQ ID NO: 24023 - protein, 444 aa, Aspergillus fumigatus
MASRYHSAPVDVAPLGKPLQFKISKRTAPNRFYKAAMTERMSSWSPTDLKARGVPSRELINLYKRWGEGGYGLISTGNIMIAYDQLEAPGNPIIDLENPFHGERFDAFRELASQAKRHGSLIIGQVSHPGRQTEERLQPNPVSASDVQLDKEIMGMQFAKPHAASKDEITDFIRRWTHAAVYLHKAGYDGIQLHGAHGYLLAQFLSQTTNRRTDEYGGSLENRARLIVEIAQSIRKELPASTGFILGIKINSVEFQAGGFTADEARELCQILEENEFDFVELSGGTYEFIAFSHKRDSTKQRESFFLEFASLITPALSKTKSYVTGGLRTASGMVGALETVDGVGLARPACQEIRLPRDILDGKVTAAINPKIDQQDFGVTSVAAGTQMKQVGKDEQPIDLSDEKNVEMFMKHLSGWSQRMREDAATMNLYGYVDLPKGEAYRG

SEQ ID NO: 24024 - protein, 390 aa, Amycolatopsis mediterranei
MGAEVVIEGLTKSFGKQAIWRDVTLTLPPGEVSAMLGPSGTGKSVFLKSMIGLLKPDRGRCMINGVDIVTCSEHKLYEIRKLFGVLFQDGALFGSMNLYDNVAFPLREHTKKSETEIRRIVLEKLDMTGLNGADKKLPGEISGGMRKRAGLARALVLDPEIILVDEPDSGLDPVRTTYISQLFLDVNAQIDATFLIVTHNINLARTVPDNLGMLFRKELVMFGPREVLLTSEEPVVKQFLNGKMQGPIGMSEEKDSAQMAAEQAMFEAGHHAGGVEDVSGVPPQMQPTPGVPTRMGAVRRKDRVMEIMHRLPPAAQESIIESLSPEEQRHYGVRPHRGQPQQVGARPQGDGVPNQHHGQLPADQVARIPGGQPPRTGTHRMPPNNGPGGR

SEQ ID NO: 24025 - protein, 430 aa, Amycolatopsis mediterranei
MTVQKAPSQLLAAKLQIPPIPYSHAAGSWVYASDGTRYLDGASGIVNVNIGHAHPTVVAALRDQVGICTYASPGTFAPDLMEQLAAAAARAVHRPDDRVMFTPTGTHATESAIALARLVQRARGEEGRHKILTSTLGYHGNSAFVLALSGHRSRRPHEDDSFGLAPAFNPPYPGQHLGCPFDACRVECVRAVRDAIVAAGPESVAAVLMEPVNGTTGGGYVPPAGYLRALREVCDEFGVLVIHDEVLTGLGRCGLPLASHHTPGSAADIVTLSKGLGAGYVPLAATMLSPDLAEDIMTSGKWLPLMGTMSATPLQGRAGLAVLSVLEELGALDRDEVRGAALGRLVADAVRGRQVVTDVRGLGYFYGIELAPGTLGDVMRITRSRGLLLYPYVGFRPDRTGEGLLVAPRSTRPTAISASSARRWARHWTS

SEQ ID NO: 24026 - protein, 492 aa, uncultured bacterium 463
MDPSQFEALYTAKQTRALDRCAIEDHNIPGITLMSRAADATFDSMINHWPEPELVQVLCGTGNNGGDGFLVADLAHKRGIKTIVLQVGASDKISGDALLARNQALANGVDIQPFEDGAVLSLGVVVDALLGTGLGGDVRGDYLEAITEVNAAGTSVVAVDIPSGLCADTGRVLGQAIKADMTVTFIGLKRGLFALEAMDYTGDLQFADLSVPSEVYQQVPADCHRLELELLLEELRPRPATAHKGMYGTVLVIGGDYGMAGAAAMAAEAALRCGAGLVKVATRPEHVSALVARAPEVMPLGVESGDELEPLLASADVLVVGPGLGQSPWSEYLLQAAVASGKPMVLDADGLNMLAGGKVKARDGMIITPHPGEAGRLLSCSTAEVQADRFAAARALQQQTGAVVVLKGNGSLIAGDGQLLLSDYGNPGMATGGMGDVLGGVIASLLAQGLEPVAASALGVCLHGAAGDIAAEDGMRGLLATDLIPWLRELLG

SEQ ID NO: 24027 - protein, 314 aa, uncultured bacterium 463
MSDFGSGTSTSEVIEGVDLKGKCALVTGASSGLGVETSRSLASAGAAVIMVARDASKLDTAVAQVRAAVPDAQLDTALLDLADLESVRAGAQTILAKCPSIQLLINNAGVMACPLMRTAQGFEMQLGTNHVGHFLLTCMLAPALVAGAPARVVNLSSAGHRFSAMDLDDPNYHRRDYEKWQAYGQSKTANALFSVGLDQRLQGQGVRSFAVHPGMIMTELSRHMDPSDMEIILAGRNIEDIGFKTVEQGSATSVWAATSQDLDGLGGLYLEDCHIAEPATPDNEAGIESYALDPVTADKLWQLSEDMVGENFNF

SEQ ID NO: 24028 - protein, 210 aa, uncultured bacterium 463
MALLPEVELTTDEQKVSYGFGLQFGDQLRRNSFDGLDLEAVIGGIRHWYDHQQAQLSDAEINPSYKVIQDRQQAIASELAGKRQALAEQFMRTNAERDEVSVTESGLQYEVLEVGSGETPGLTSTVVTHYHGTFVDGGVFDSSVERGEPAEFGVNQVIPGWTEALQLMSVGDKWRIACPPTLAYGEQGAGDSIPPNTALVFEIHLIAIKD

SEQ ID NO: 24029 - protein, 426 aa, uncultured bacterium 463
MSTSQQLFERASKHIPGGVNSPVRAFKAVGGTPVFIERSEGACIFDSEGKRYIDYVLSWGPMLMGHNHPAVREAVVRQSEKGLSFGAPTELETQLADRICNIMPNMDMVRMVNSGTEATMSAIRLARGYTGRDTIVKFEGCYHGHSDSLLVKAGSGALTLGVPSSPGVPAALADHTMTLTFNDPEGVRAAFAEHGDKIACVIVEPVAGNMSCIPPSPGFLETLREVCDNSGAVLIMDEVMTGFRFGLQGAQGFYGIEADLTALGKVIGGGMPVGAFGGKREIMEQIAPLGPVYQAGTLAGNPIAMAAGLATLEVISAEGFYEPVFKRTEQLCAGLREAANENGVAFTTNSAGTMFGGFFTESSKIENYAQVMACDTERFNRFFHMMLQAGIYLAPASYEAGFLSSAHTDADIEATVDAARSAFAAL

SEQ ID NO: 24030 - protein, 373 aa, Nicotiana tabacum
MAIEHNEQQELSQSFLLDALYCEEEEEKWGDLVDDETIITPLSSEVTTTTTTTTKPNSLLPLLLLEQDLFWEDEELLSLFSKEKETHCWFNSFQDDSLLCSARVDSVEWILKVNGYYGFSALTAVLAINYFDRFLTSLHYQKDKPWMIQLAAVTCLSLAAKVEETQVPLLLDFQVEDAKYVFEAKTIQRMELLVLSSLKWRMNPVTPLSFLDHIIRRLGLRNNIHWEFLRRCENLLLSIMADCRFVRYMPSVLATAIMLHVIHQVEPCNSVDYQNQLLGVLKINKEKVNNCFELISEVCSKPISHKRKYENPSHSPSGVIDPIYSSESSNDSWDLESTSSYFPVFKKSRVQEQQMKLASSISRVFVEAVGSPH

SEQ ID NO: 24031 - protein, 333 aa, Schizosaccharomyces pombe
MPIVNGFKVGPIGLGLMGLTWRPKQTPIKQAFELMNYALSQGSNYWNAGEFYGINPPTANLDLLADYFEKYPKNADKVFLSVKGGTDFKTLAPHGDPESVTKSVKNALTRLRGKKKLDLFQCARVDHKVPIETTMKALKAFVDSGEISCVGLSEASAESIKRALAIVPIAAVETEYSLFSRDIEKNGILDTCTQLSIPIIAYAPFCHGLLTGRVKTAEDLKDFIKAFPFLRNMDKFNPKVFEKNIPFLKAVEQLAQKFGMSMPEFALNFIIANGKGMIIPIPGSTTVQRAESNLSALKKSLSSEQLEEAKKVLDKHQIFGLRYNKQLESTLSI

SEQ ID NO: 24032 - protein, 249 aa, Paracoccidioides brasiliensis
MPRKFFVGGNFKMNGTAKSITHIITNLNSAKLDPSTEIVIAPPAIYLVLARQLANGQVAVSAQNVFDKPNGAFTGELSVEQLRDEKITWTLAGHSERRVLLREDDEFVARKTKAAINGGLNVILCIGESLEEREAGKTIDVVTRQLDAVAEEVSPAEWNKVVIAYEPIWAIGTGKVATTEQAQEVHASIRKWLNEKISPEAAENTRVIYGGSVTESNCRDLAAQPDVDGFLVGGASLKPAFVDIINARL

SEQ ID NO: 24033 - protein, 232 aa, Nanoarchaeum equitans Kin4-M
MHMPKNIKVKPHKLEGVYIGNNKFLLTKNLVKGQKVYTERIFKSKGEEYREWIPFRSKLASAIKKGLKTWPFKKGTIVLYLGIASGTTASHISDIIGEEGIIFGVEFAPRVLRELMFVAKKRKNIVPILADANQPETYQHIVVQSDVIYQDVAQPHQVEIFLKNLRFFAKPNAIGFLAVKARSIDVTKDPKVIFREVERKLREAKLQLLESIRLDPYHKDHMMFVVKVPKAW

SEQ ID NO: 24034 - protein, 341 aa, Nanoarchaeum equitans Kin4-M
MAYLFIHLNGLYVLDEDGTLLEYKPMEFSEEEAYKLKKGILPESLKGEIDKLKSKYELKILGRAYKGLDLPLDLNTKLINKALFYARENDNFSYIRDVQYEVTIRELSESVSHDWLIIQAIKALDDTNKILNLMMERFREWYELYFPELSKKFEDHEQFVKAVLEKPREEWLKELGLDKTMGGNIDEESKQILMTFAQRIKDMYEFRKQLQNYIKQMMERYAPNVTAIAGPLVGARLLALAGGLKELAYLPASTIQVLGAEKALFKHLTKGTPPPKHGVLFNHPYVQKLPKKLRGRMARTLAAKIAIAAKVDAFGHYFIGDKLKKEIDERFEELKKEAERL

SEQ ID NO: 24035 - protein, 230 aa, Nanoarchaeum equitans Kin4-M
MKVLKLEGIRKSYNDLVVLDNINLDIDEGEFVSIMGPSGSGKTTLLNIMGLLDKPDKGKIIIKNKDVTNIYDDNILSYIRGKEIGFVFQHSYLIPVLTALENVLLPSIFIGSPNKDRAKKLLDLVGLKGYYNHYPNQLSGGQQQRVAIARALMNNPSIILADEPTASLDVKTAKTIVNLFKELNDKGHTIVMVTHDPNIAKYSKRIVVLYGGKILSDNASLEEALKLIEQ

SEQ ID NO: 24036 - protein, 287 aa, Nanoarchaeum equitans Kin4-M
MILYNDVFLKHDCPHIENKNRVLAIKKALIDLGIKYYSPQIEEDPIKYIEKAHDKQYIEMIKSLIDMAKEMGCIYIDGDTYLSKDSWDPILYAVYYSVYAVNNDFLFAVVRPPGHHAGKYGKANAISQGFCIFNNAAIAALNYKGRVAIVDIDLHHGNGTEDIVKHNKNIRYYSIYAKDIYPLPDNKSYDNIYKYPLPIDATNEDWISSFDLLLANLIEWDPDKVIVSLGFDAHKDDPLSVFRTDYTIYKYAFQKLAQFNPTYILEGGYNYDVLYNGTKLLIKFSRS

SEQ ID NO: 24037 - protein, 323 aa, Saccharum officinarum
MAPALSFPIIDMGLLGGEERPAAMELLRDACESWGFFEILNHGISTELMDEVEKLTKDHYKRVREQRFLEFASKTLKDAQDVKAAENLDWESTFFVRHLPESNIAEIPDLDDDYRRAMRQFAGELEALAERLLDLLCENLGLDRGYLARAFRGPRTGAPTFGTKVSSYPPCPRPDLVSGLRAHTDAGGIILLFQDDRVGGLQLLKDGAWVDVPPLRHSIVVNLGDQLEVITNGRYKSVMHRVVAQPDGNRMSIASFYNPGSDAVIFPAPALVKAEEAAAGAYPRFVFEDYMKLYVRHKFEAKEPRFEAFKSVETDSSNCIAIA

SEQ ID NO: 24038 - protein, 261 aa, Passiflora edulis
VLNHGIPNEFMDTVERMTKAHYNKCMEQRFNELVASKALEGVQVELKDMDWESTFYIRHLPESNIAEIPDLDDEYRKVMKDFAAKLEKLAEELLDLFCENLGLEKGYLKKALYGSRGPTFGSKVSNYPPCPKPELVKGLRPHTDAGGIVLLFQDGKVGGLQLLKDGQWVDVPPIPHAIVINIGDQLEVITNGKYKSVDHRVVAQTDGARMSLASFFNPGSDAVIYPAPALVEKEAEEKKQLYPKFVFEDYMKIYAGLKFHA

SEQ ID NO: 24039 - protein, 466 aa, Ricinus communis
MPPQAGSKWYDDDGKLKRTGTVWTASAHIITAVIGSGVLSLAWAVAQLGWVAGPAVMFLFSLVTYYTSTLLSACYRTGDPVNGKRNYTYMDAVRSNLGGAKFKICGYVQYVNLIGVAIGYTIASSISMMAVKRSNCFHKSEAKNPCHMKCQSLHDCILEVVESSSSQIPDFDQTMGGLSIVAAIMSFTYSTIGLGLGIAEVTKNGKAMGSMTGISIGTVTETQKIWRSFQALGDIAFAYSYSLILIEIQDTIRSPPAESKTMRKATLISVSVTTLFYMLCGCFGYAAFGDMSPGNLLTGFGFYNPYWLLDIANVAIVVHLVGAYQVYCQPLFAFVEKAAVQRFPDSEFILKDIKIPIPGCKPYNLNLFRMVWRTVFVIFTTVISMLLPFFNDIVGLLGALGFWPLTVYFPVEMYIAQKKIPKWSTRWLCLQILSAACLIITIAAAAGSIAGVIVDLKTVKPFQTTY

SEQ ID NO: 24040 - protein, 314 aa, Dunaliella tertiolecta
MDAYEKLEKIGEGTYGKVYKARDINTGKLVALKKTRLEMEEEGVPSTTLREVSLLLMLSESNHVVKLIAVEHVEENGKPCLYLVFEYLSTDMKKWMDRNGRGPAHPLPKPAIKSLTYQLIKGLAHCHKHGVMHRDLKPQNLLVDDSIMCCKIADLGLGRAFSIPIKSYTHEIVTLWYRAPEVLLGSTHYSTPVDMWSVGCIFAELVRKTPLFPGDCELQQLLHIFKLLGTPNEEVWPGVSKLRDWHEFPQWHPQDLSRIFPTLEPEGVDLLKRMIEYDPAKRISAKEALKHPYFDDPMIREVDQQENPEVRARD

SEQ ID NO: 24041 - protein, 499 aa, Ipomoea batatas
MAPIPGVMPIGNYVSLYVMLPLGVVNADNVFPDKEKVEDELKQVKAGGCDGVMVDVWWGIIEAKGPKQYDWSAYRELFQLVKKCGLKIQAIMSFHQCGGNVGDAVFIPIPQWILQIGDKNPDIFYTNRAGNRNQEYLSLGVDNQRLFQGRTALEMYRDFMESFRDNMADFLKAGDIVDIEVGCGAAGELRYPSYPETQGWVFPGIGEFQCYDKYMVADWKEAVKQAGNADWEMPGKGAGTYNDTPDKTEFFRPNGTYKTDMGKFFLTWYSNKLIIHGDQVLEEANKVFVGLRVNIAAKVSGIHWWYNHVSHAAELTAGFYNVAGRDGYRPIARMLARHHATLNFTCLEMRDSEQPAEAKSAPQELVQQVLSSGWKEYIDVAGENALPRYDATAYNQMLLNVRPNGVNLNGPPKLKMSGLTYLRLSDDLLQTDNFELFKKFVKKMHADLDPSPNAISPAVLERSNSAITIDELMEATKGSRPFPWYDVTDMPVDGSNPFD

SEQ ID NO: 24042 - protein, 332 aa, Gluconobacter oxydans
MRIGIIGLGRMGGNIAVRLTRHGHDVVVHDRTSEVTTSVVGRCEAGRATPADTLADMAKLLEGDEHRVVWVMLPAGAITEDCVQQLGGLLGRGDIIIDGGNTYYKDDVRRSAELAEKGISYVDVGTSGGVWGLERGYCMMFGGTKETAEYIDPILSALAPGIGDVPRTPGRDEAGHDPRAEQGYLHCGPAGSGHFVKMVHNGIEYGMMQAFAEGFDIMKSKNSPILAEKDRFELNMGDIAEVWRRGSVVSSWLLDLTAEALTRSETLNEFSGEVADSGEGRWTIEAAIEEDVPAPVMTAALFTRFRSRSGNNFAEKILSAQRFGFGGHVEKK

SEQ ID NO: 24043 - protein, 408 aa, Psychrobacter sp. 273-4
MNHNLTTLHPYPFAKMATLLADSTPAHSYDEIKLGIGEPKHAPPAFVLDVLRENLDKISHYPTTNGLFELRQTIAHWLEKRFFLNHVNPNTQVLPVMGTREAIFSIVQAVINHQTETISQTATLNQSPVVVMPNPFYQIYEGAAILAQATPYFIPCTADNGFKGDFRSVPKDVWMRTQLLFVCSPNNPTGSVMTMDDWEQLLRLSDQYGFIIASDECYSELYFDKAPIGLLQACAALGRHDFKNCLVFHSLSKRSNLPGLRSGFVAGDATILDSYLQYRTYQGCAMPIPHQLASIAAWEDEKHVAHNRALYQEKFALWMSELGALLDLRMPEAGFYFWIKAPEQFDGDDELFVKALYEHANIHALAGRYLSREVNGKNPGQGYVRIALVASVEESREAIRRIRQLLGA

SEQ ID NO: 24044 - protein, 237 aa, Psychrobacter sp. 273-4
MSQSKVYDSAEAALSGVVRDGQTLAIGGFGLCGIPEALIEALRDSEVKDLTCISNNAGVDDFGLGLLLQTRQIKKMISSYVGENKEFERQYLAGELEVELTPQGTLAEKLRSGGAGIPAFYTATGVGTLVAEGKETRDFNGRTYVLEHSLRADVSLIKAQKADKAGNLIFNKTARNFNPDCAMAGKITIVEVEEIVETGILNPDEIHLPGIFVQRIVLNRNPEKRIEKTTTKAVEGA

SEQ ID NO: 24045 - protein, 329 aa, Psychrobacter sp. 273-4
MNRQPLGFFPTPLIELTRLSKALNGPKIYMKRDDNTGLALGGNKTRKLEFIIGDALAQGADTIVTAGAAQSNHCRQTAAAAASLGLECHLVLGGQEPDQLNGNLLLDKIFGCHIHWAGNNRKGEDIPDIVEQLENAGKKPYVVPYGGSSELGAFAFIEAFKELESQRQEMDISFTHIVFASSSGGTQAGLMLGNKIFNSPYQIVGINIDKGETDKVPFDQYIVSLANSTAALIGADYSFSETDLMLNSDYVGDGYGVIGALENEAIAMTAQTEGILLDPVYTGRAMGGLIDMIRTGKIKKTDSVLFWHTGGAPALFAYASALAVSQSDS

SEQ ID NO: 24046 - protein, 508 aa, Psychrobacter sp. 273-4
MLYAYPNTENSPVQFRKKYDNFINGEWVAPIDGEYFDNSSPIDGKTFCQIARSKEADVEAALDAAHAAKDAWGKTSVTERSNMLLKLADGIEANLEKIAIAESYENGKPVRETLAADIPIAIDHLRYFAGVIRAQEGGISQIDEDTVAYHFHEPLGVVGQIIPWNFPILMAIWKIAPALAAGNCVVLKPAEQTPASILYMLDVIGAADILPKGVLNVVNGFGVEAGKPLASNPRIDKVSFTGETTTGRLIMQYASENIIPVTLELGGKSPNIFFADVMDEDDDFLDKAVEGLVMFALNQGEVCTCPSRALVHESIYDEFMKRCIARVKAIKMGNPLDTDTMIGAQASSDQLEKILSYLDIGKKEGAKVLVGGELAKHDGDIANGYYVQPTIFEGTNDMRVFQEEIFGPVLAVTTFKDDEEAMALANDTLYGLGAGVWTRNGTRAYRFGRGIKAGRVWTNCYHLYPAHSAFGGYKQSGIGRENHLMMLDHYQQTKNMLVSYSPKAMGFF

SEQ ID NO: 24047 - protein, 511 aa, Psychrobacter sp. 273-4
MNKQPDTASDPSAPFDHSTHQNVTRKVSVAVIGAGTAGQNAFRQAKKSVEDIIIINDGFWTTTCIAVGCMPSKLLIAAADRAHDANHSGEFGIHATAHIDGKQVMERVRAERGHFSSYIEKYVDSWSEDSKIAGRAYINKQGLIEVNDELIQADKIIVATGSSTFIPDGWADKLGDTMLTSDTVFELVDLPKSMAVIGAGAIGLELAQAFTRLGVKVTVFNRAKRVAGLKDNDINNKAIDCLSRELTMHLGSKITDIGQKLDGNIDKNIDKKNIAAFIDYEDSAGKVQQWQGDYVLVATGRRNNIDTLGVENLGVELDDKNRPKNLDKKTGKIGDLDVYIVGDANAHIPLLHVASDEGFSAGSMVCGNKKDAYIRPPATPFSIVFSSPQIVNVGMSLPDIEQDPTLEHVIGKVNFDNQGRSRVMGVNCGLLHIYGCEKTDRILGASMVGPDAEYIGHILAMAITNDLSIKDILDTPFYHPTILEALRAALRDVQDLMEIPYQSLDTQQHSS

SEQ ID NO: 24048 - protein, 500 aa, Psychrobacter sp. 273-4
MTDSTDLKHMDNAEQTQTAYINGSYLAVDKALSTFDSINPVTGEVLSTIQQTTTEQINDAVIAAQKGQKVWAAMTAIERSRILLNAVAILRERNDELAVLETKDTGKAISETKYVDIVTGADVIEYYAGLAPMIEGRQIPLRDTSFVYTRQEPLGVIAGIGAWNYPIQIAMWKAAPALAAGNAMIFKPSEVTPLSALKLAEIFTEAGLPEGVFNVVQGNYEVGEALTQHPDIAKVSFTGGVPTGKKVMSSAATSSLKDVTLELGGKSPLIIFDDADIDTAADIAMMANFYSTGQVCTNGTRVFIPKALQAKFEQAIQTRVKRIKLGDPMDDSITMGPLVSFPHMDRVLGYIEQGKASGARLLCGGARVTTGSLADGAYVAATVFTDCTDDMSIVREEIFGPVMSILTYETEEEVIRRANDTEYGLAAGVVTADLNRAHRVIAQIEAGICWLNTWGESAAQMPVGGYKHSGIGRENGIQTLEHYTQTKSIQVELGAFESVF

SEQ ID NO: 24049 - protein, 171 aa, Psychrobacter sp. 273-4
MVDMPPVVELDTSMGAIVIELNEEKAPKTVENFLNYVKSGHYDGTIFHRIIDGFMIQGGGMDADMNEKATNKPVENEADNGLKNNAGTIAMARTQDPHSATSQFFVNVKDNDFLNHSGKNMQGWGYTVFGKVTSGMDVIEKMRGVPTGRFGMHADVPKEPVVINSATIITQ

SEQ ID NO: 24050 - protein, 490 aa, Psychrobacter sp. 273-4
MLRIVDEALTFDDVLLLPAYSEILPKAANLTTRLTKSITLNLPLISAAMDTVTESEMAITMAQLGGLGILHKSMDIDKQAMQVRRVKKFEAGTVVDPITVHPEMTIGELLRLTQDNNISGVPVVEKGTDKVVGIVTHRDWRFETNLSLPVSHIMTPKEQLVTVKEGESNENIKRLLHEHRIEKVIVINDDFRLRGLITVNDFAKAENNPNACKDEQGRLRVGAAVGTGADTQARVEALIAADVDIIVVDTAHGHSKGVIDKVSWIKKHFPHVQVIGGNIATGDAAKALRDAGADAVKVGIGPGSICTTRIIAGIGVPQISAIDSVASALQDSIPLIADGGIRYSGDMAKAIAAGASCIMVGSLMAGTEEAPGEVELFQGRYYKAYRGMGSLGAMSGQNGSSDRYFQDAKDGVEKLVPEGIEGRVPYKGPVAGIVNQLVGGLRSSMGYTGCATIEDMRSKPQFIKVTSAGMKESHVHDVQITKEAPNYRVD

SEQ ID NO: 24051 - protein, 496 aa, Psychrobacter sp. 273-4
MSTAAKNTQANTYTDFHLQYIAGEWKKGDDDSINTNTNPFNGETLVEIQQATDKQLDEAYQAASDAQKQWAKQTPNERAAILYKVVSIFDQRQDEIVDWLIKESGSTRIKAMVEFSSARAITLEAASFPNRVHGEIRPSNTPGKENFIYREPMGVIAVISPWNFPLHLTQRSIAPALALGNAVVLKPASDTPITGGLLLAKIFEEAGLPKGLLNVVVGSGSEIGDAMVTHHVPSLVSFTGSTSVGKHIGELANGGEYIKQVALELGGNSPFVVLKDADIEQAVKAAAFGKFLHQGQICIAINRIIVEDEIYDDFVTRFVAHVKTLNVGDPNKADTAVGPIINKKQVASLKEKIVKAKDEGAKMLLSGEIKGQVVPPHVFSDVTREMDLSCNEVFGPLVGIIRAKDEDDALSIANDSMYGLSSAVFTQDMAKGLRFARGIKAGMTHINDISVNDESNAPFGGEKNSGIGRFNGEWILEEFTTLHWISMQHTPRDYPF

SEQ ID NO: 24052 - protein, 511 aa, Psychrobacter sp. 273-4
MTDSDQNNQVQTIHPSYDEHNEHNEHNEHNEHNEHNEHNEHEGLSIIKTVADMQSQFLRLQNLSRTQPINDWATRRDQLDNLELMLSDNQQLLANAISADFGYRSESETQFAELFPSFTGISHAKKHGKRWMKAQRVSSSALYMPAHNEILPQPLGVVGIMVPWNYPLFLAIGPMIDALTAGNRIMIKMSEAAPQFAQTFAETISRYFSADMVCVVIGEVEIAAAFSKLPFDHLLYTGSTAVGKKVMAAAAPNLTPVTLELGGKSPVIVLEGANLENAVNRVMMGKTLNAGQTCIAPDYVLIQRQYHDEFVRLAKEWMEKHYPNIESNPDYSRIINAQQFKRVKGYLDSLSGEGIHRLTDAEASIETRLMPPVIVSEPAPESDVMQNEIFAPVLPLMHYDTLDNAIAFINARPRPLALYVFGDNNRDIDKVRTNTVSGGLCINEVIMHVAQHDLPFGGVGDSGTGAYHGKAGFERLSHMKPIFVQSKLNGLNILLPPYGGLFKKAMALFLK

SEQ ID NO: 24053 - protein, 1080 aa, Psychrobacter sp. 273-4
MNPVEQFTPQEPILFNPIDLLSPEYIAQSSTELHTRISPLYSVDEERWLTQLLPLAKPTDAERDSAATQTRQLVEHVRNDGKAVKMVDSLLLEYSLDTQEGVLLMSLAEALIRVPDNYTADALIHDKMSVADWKKHLKNDNGFMVNASTWGMMMTGRVVSIDSDTTASGFLDRMTKKMGEPVIRSAMQKAMRIMGHQFVLGETIEGANKNSQPYRNKGYTYSFDMLGEAAITHKDAEKYFNDYLHAIKATASVKVKEGMPKPSVSIKLSALHSRYEATQEAQVMGLLRQRCLLLIEAAREVNVDISIDAEEADRLEISLKLFESLYRDNLTADWDGLGLVVQGYSKRAIAILAWLARLAIEVGDRIPVRLVKGAYWDTEIKLAQQKGLSGYAVWTRKEGTDTAYLACARFLLSEHLRGLIWPQFATHNAHTLASIMTMSSHRDFEFQRLHGMGDALYDHILQAYQIPVRIYAPVGAHKDLLPYLVRRLLENGANSSFVHQLLDKSYPIDKLTVHPYDKLLTNATLHNPDIPLPLAIYGARRASFGPNIFIGSQWIPFKAAIDTHIHKTWSATSVINGKAINDYDADGKIHQLDSQAVRAPWNHEVIVGEVVYANATIAQQAIAAAVAGQGEWQAVSAAKRAAILRKMADLYEENYAELMALCQVEAGKTLQDSIDEIKEAVDFCRFYADEAERLDDVVYEFIDLAGKPSRQVYKARGTFICISPWNFPLAIYTGQVVAALAAGNTVVAKPAEQTSLIAHFAAQLMYQAGVPVAALQLVIGAGDVGAALTAADNIAGVIFTGSTQTAQRINQSLNAHAQVSGELPVFIAETGGQNAMIMDSTALPEQVVRDAVLSAFGSAGQRCSACRILCVQEEMADDVIELLQGNMAELIVGNPLYATTDVGPVIDIDAKRGLEAHIERMRAEPTATILAQTPMSASSEVSQDQATFVLPTAIEVKSIDVIGGEHFGPILHVLRYEARDLNKLIDAINATGFGLTLGIHSRIENTVEHIERRAFVGNTYINRNQIGAVVNVQPFGGCGLSGTGPKAGGPHYVARLMTLTTEQLALKNNTTENITQTTIA

SEQ ID NO: 24054 - protein, 393 aa, Psychrobacter sp. 273-4
MSEQSPEQKNDNLNQTTASNSATATDKEFLNTLRGSIDAVDCEIQTLINNRAKLAQQVATVKKNHIANDPAAENTNPIFYRPEREAQVLKAVMERNTGPIADEKMARLFREIMSVCLDLEAPQRIAFLGPVGTFTHAAALKHFGKAADTVPLNTITDVFREVEAGTAMYGVVPVENSSEGVVNHTLDGFLSSTLKIIGEVELPIHQNFLVAEHTKIDGLSRIYSHQQSLAQCRHWLDVNFPNVERVAVSSNGEAARRLKNEWHSAAIAGDVAAAEYDLHKLYSNIEDNPSNTTRFLIIGHEAIEPSGQDKTSIMVSAHDKAGALIEILKPLSYHGVSMTSIETRPERPNKWAYVFFIDINGHIADPNVSAAIADIRPLVKDLRVLGSYPKAVL

SEQ ID NO: 24055 - protein, 326 aa, Psychrobacter sp. 273-4
MTWGQQNSESDAHEQMDLALSEGVNFWDTAEMYPSPPDKNKQGDTERFMGTWFHKTKQRDKVVLASKISPMDFLRDGQTRFNAAHISSAIDGNLERLQTDYIDIYQLHWPERQTNYFSQRGYTEAMAAQPLDNLTPFLETIQALNDEIKKGRIRAYGLSNDTAWGLMRYLWEADKNGLIAPITVQNPYSLLNRLYEVAMAEIAHRDNVGLLAYSPLGFGVLSGKYLDGKRPTGARLTMYDRFARYTNEQALAATAQYAKIAADAGLDMAQMALAFVNSRSFVTSNIIGATSTEQLKSNIDSIHLTLSSDVLAAIEAVHTQQPNPSP

SEQ ID NO: 24056 - protein, 318 aa, Psychrobacter sp. 273-4
MSATAPLNVNFITQITDLADCVGQTPLVKLQRLPEQEQIDNGAIMLAKLEGNNPAGSVKDRPAFNMIYQAERRGDIKPGDMLIEATSGNTGIALAMVAAMRGYPITLFMPSNSTQERKDAMTAYGATLIQVEEGIEAARDMALQMQADGKGIVLDQFNNPDNKQAHYLTTGPELWAQTEGKITHFISSMGTTGTITGVAQYLKEQNPAIQIIGLQPDEEAAIAGIRRWPAAYMPGIFDADLVDEIMDIDQRVAEVYMRKLAKTEGIFAGVSSGAAAWAATQVAKANPDAVIAFIVCDRGDRYLSTGLYNVDDSIDNAN

SEQ ID NO: 24057 - protein, 451 aa, Psychrobacter sp. 273-4
MTKHYDYIAIGGGSGGIASINRAASYGKKCAIIEANQLGGTCVNLGCVPKKVMWYGAQVAEAIHKYAPDYGFDVEFKGFDFQKLVNSRQQYIENIHRSYDNNLAKNGVEVIKGFAKFVDTNTVEVNGELITADHILIATGGHPIRPDIKGTEHGIDSDGFFALNELPKRVAIVGAGYIAVEIAGVLNSLGAEVHQYVRQHSPLRSFDHSIVETLLIEMEQDGIQLHTNTTLTEVVKNDDGSLTLCTESGSLDTVDCLIWAIGRAPSTDNINLQVTGVETTEFGKIKVDKFQNTNVKGIYAVGDIIENSVDLTPVAIAAGRRLSERLFNNKPDEHLNYELIPTVVFTHPAIGTIGLSEIDAVNQFGKDNIKCYSSTFTPMYSAVTQHRQKCMMKLVCLGDDEKVIGLHGIGFGIDEMIQGFAVAIKMGATKADFDNTIAIHPTGAEEFVTMR

SEQ ID NO: 24058 - protein, 173 aa, Psychrobacter sp. 273-4
MIDADGFRANVGIILANTQGQVLWAKRIGHNAWQFPQGGIDRGETPMDAMYRELWEEVGLHPRHVDLLAVTQDWLRYRLPKRYVRHGQYPLCIGQKQKWFLLRLDEPNTQHIRFDEGKAEFDNWQWVSYWYPLGQVIHFKRGVYRRALQELVPELPLQQGLIIPEQNNHLLQF

SEQ ID NO: 24059 - protein, 278 aa, Psychrobacter sp. 273-4
MTRIESTFEILKAQNKKALIPYVMAGDPNPSNFVGLLHDLVKHGADMIEVGLPFSDPMADGPTVALAGERALAAGTSTRDALKMVAEFRQQDTQTPIILMGYLNPVEIIGYDNFVALCEQSGVDGILMVDLPPAEAGSFTQHLTEHSMNEIFLLSPTTLPERREQVLTHCGGYIYYVSLKGVTGSATLDTDDVATQVQAIKAETDLPVCVGFGIRDAASAKAIGAHADGIIVGSALVQNFADIDGNDATAVAHAQQKIMAKMTELREALDSLSVSSNG

SEQ ID NO: 24060 - protein, 193 aa, Psychrobacter sp. 273-4
MTDSTLEAQFDNFFALFEQPVQFDIVQDSLDQRLRLLQKRYHPDNIAKNVANPEKAQQQSEQASALINQGYQILSAPDSRASYLLDMADQAQNLEHSIADLDFLEDAMEMRMDLDDAIGDKDISTLKQLHPQITERLAKQSASFKSAYDNQDWQTAIDATQKLKFLVKLNADVVTALDGISAATYLDDDDLYV

SEQ ID NO: 24061 - protein, 203 aa, Escherichia coli
MLTEQQRRELDWEKTDGLMPVIVQHAVSGEVLMLGYMNPEALDKTLESGKVTFFSRTKQRLWTKGETPGNFLNVVSIAPDCDNDTLLVLANPIGPTCHKGTSSCFGDTAHQWLFLYQLEQLLAERKSADPETSYTAKLYASGTKRIAQKVGEEGVETALAATVHDRFELTNEASDLMYHLLVLLQDQGLDLTPVIENLRKRHQ

SEQ ID NO: 24062 - protein, 152 aa, Methanococcoides burtonii DSM 6242
MVQEGDLISVNYIGQLEDGTIFDTSLEDVAKEAGQHNPARGYEPLEFTVGAGQMIPGFDAGVVGMTVGEEKTVTIPAAEAYGEYDEELVQPVPRTQLKEMGIEPEVGMPLFTQYGQVTIVRIDETNAYVDYNHHLAGETLTFKITLVSIGKE

SEQ ID NO: 24063 - protein, 215 aa, Methanococcoides burtonii DSM 6242
MNVVLFGPPGAGKGTQAKELDKHYQIPHISTGDILRANVRDGTKLGKEAKGYMDKGELVPDEVLIGVIKNRLAESDCKPGYLLDGYPRTTPQADALSSILVEIGMPLEVVLNIDVADEELVTRLCGRYVCTCGESYHMKFNPPKKENVCDACGADLYQRDDDKEDVIRQRLDSYKEKTQPLISYYGEKGLLVDIDGTGAIDRIFSDICKTLDQYK

SEQ ID NO: 24064 - protein, 259 aa, Methanococcoides burtonii DSM 6242
MRLADKFNEIKNRNETALLAYVCAGDPDIDSTPRIVDSLIKGGADIIELGLPFSDPVADGPTIQAASERALTAGMNPDRYFELVANLDVQVPLVCMTYYNLIYKRGIEKFVKDCISSGISGLIIPDLPAEESADLANCCSQEGVDLIFLVAPITTDERIEMILSKTSGFVYIVSRSGVTGTRSDVTAATSDIISRVRTDIPKAVGFGISNAEQAAKIIDAGADGVIVGSAFVDIIASGNDVEKRLEDLTAEIKSVCRRD

SEQ ID NO: 24065 - protein, 422 aa, Methanococcoides burtonii DSM 6242
MVTLDKSKDLFDKARKILPGGVSSPVRAIKPYPFYTESANGCRIKDVDGNEYIDYCLAYGPNILGHANPVIKQAIIDQLDKGWLYGTPTGLEVTLGEKIASLYPSIDMLRFVSTGTEATMSALRAARGFTCKNKFVKIEGGFHGAHDAVLVKAGSGATTHGKPDSLGIPEDFTKNTLQVAYNDIEAMTEVIESNQDDMAAVIMEPVLGNIGPILPEGDYLKEVRKVTEENDVVLIFDEVITGFRLAMGGAQEYFGVTPDMTTLGKIVGGGLPIGVFGGKREILEMISPSGSVYQAGTFSGSPASVAAGIAAVDVLEKEKVHEKLEATGNMLRAGLNDIIADKRLDFHVGGIASMFKVFFGDKPLNYQDVLKCDKEGYLQFFHDMLDSNVFLPPSQFETNFLSTAHTEADLETTLEAYAVNLK

SEQ ID NO: 24066 - protein, 289 aa, Methanococcoides burtonii DSM 6242
MFYQPGMMDALADYDSASYVIFGVPFDRTSSFRAGSRWAPDAIRSATANFESYNSFYDIDISEIPAHDAGNFEAGALVDDVLDELYLDVINIVDDGKLPIMIGGEHSLTLPCMKACAKHAGEDFGVVVLDAHFDLRDEFEGMKYNHACVSRHILEEVTENYVSIGIRSGPKEEWDYAKENNVRYYTPEDVTEKGIKGLTNEIREYLDCENIYISLDMDALDPAFAPGVGTPEPFGLTSVQVRDIIREFAPIARGFDVMEISPEYDSGQTAILGAKYIREFIAAHAASIK

SEQ ID NO: 24067 - protein, 481 aa, Methanococcoides burtonii DSM 6242
MKGIKSSRMKAIDENCEHLGLKGLQLMENAGAAIAHEVRERVQKGNVLIVAGRGNNGGDAFVAARHLAYDPAITINIALIGSASQIRSEDAINNYGLLEHCRINALIEITDPQKLKEMGWLDNADIIVDALLGTGITGKLKETEATIIDLINDSNVPVIAVDVPSGFDPDGGEFERSVRADVTLTFHRMKKGLVSGHAKEYTSEVKVINIGVCEDAEKYVGEGDINAFRTRHGDSHKGQHGKILIIGGGPYSGAPALTAMAALRAGADIVTVAAPANVADIIASFSPNIIVKALSSNILCKEDMGTITKLIESHDVVVIGMGLGRAEQTKDTVSKIIPLCTKVVADADALYGIDLPVPKGIEMIITPHAGEYNALGGNGKEDTLEFSKRNNVTILLKGREDHISNGKRIAINRNGNPGMTVGGTGDVLAGIAGALFATACKMDAACGAAYINGAAGDLAFERMGSGLLATDIIDMITEVMK

SEQ ID NO: 24068 - protein, 431 aa, Methanococcoides burtonii DSM 6242
MTDKTYGLDTIALHGGHEPDATGSRAVPIYQTAAYVFNDAEHAANLFALKAFGNIYTRLMNPTTDVLEKRVAAIEGGTGALGVASGMSAITLAALAVTQLGDEIVSANNLYGGTYQLFNHTFPKLGRKVNFVDSTKPDDFEKAITEKTRAIYVEIIGNPKLDIPDLEKIAEIAHNAGIPLIVDNTVGVGIVKPIDYGADIVVLSATKFLGGHGTSIGGIIVDSGNFSWDNGKFPEFTDPDPSYHGLKFWESFGNIPGMGNLAFILRVRTQLLRDLGPAMSPFNAFQFIQGVETLSLRVKRHGENALAVARHLNSHPLVEWVNYPGLEDHPSHELAQKYLNGSYGAILGFGVKGGLEAGKKFIENVELLSHLANIGDAKTLVIHPASTTHQQLTKEEREQTGVTDDFIRMSVGLEDIDDIIADIDQALERSQ

SEQ ID NO: 24069 - protein, 284 aa, Methanococcoides burtonii DSM 6242
MIVGVLGPAGSYSEKAAKGWISKESKSEGTSLVYYDDINDTFTSVINGDSDIGIVPIENSIEGSVGITLDLLLESEITIIGEIVVPIGHCLLSKGEIKDIKIIMSHPQALGQCSKFIREHFKNAEIRTTGSTSHAAKLANEFCEMAAIASKESAREYGLKILVPNIQDWEKNHTRFIIIKQGKWKEDEACVPENDTCKTSIIADIDEDKPGSLYEIIGEFAKRDINLTRIESRPSKRSLGDYMFYIDIEGSTGDADIKDALYYINLKVSMLKVLGSYNGYKLDN

SEQ ID NO: 24070 - protein, 390 aa, Methanococcoides burtonii DSM 6242
MTKETTLSKDYNSIVEKDSKYVMQTYTRQPLALESGQGSIVRDIEGREFIDCVAGIAVNNVGHCHPKIVEALSKQAGKLIHTSNLYYTDVQANFAEELVNISGMGRAFFCNSGTEAVEAAMKLARVATGKKEFIATENSFHGRTMGSLTVTYKSTYRKPFEPLIQGERFVPYNSAQAIRDTVTEDTAAVIVEPIQGEGGINVPSDEYLREVREICDENEMLLIFDEVQTGFGRTGKWFCKDHSKVKPDIMTMAKAIGGGFPMGAIVARDGISFEKSQHAATFGGGPLACAAALASINVIRDEKLVERSAEMGQYFMNELNSLDNDSIVEVRGRGLMIGVEINRACADIVDLARDNGILLNCTSEKVIRIAPPLIITKEQIDKVVEIIGQI

SEQ ID NO: 24071 - protein, 416 aa, Methanococcoides burtonii DSM 6242
MTNETQKFFVLGQIKELGYDLPVENVLIEPVGKNTLPAIFFGMHEINERFGKSIVGIFSSDHVLDADSMETIADASNLASDYLVTFGVVPSSPHTGYGYIHPGNDIGFGNEVLEFKEKPDGEIAKMYVKQGYLWNSGMFLFDTDIFFEEVRKYEPSMFDAFCGDEGVIRNIVSIYSSLPSISIDYGIMERSNKVAVVKLEHKWSDLGNFDAIYGESDKDDHSNAVYDCDSNFISSNGNLVYSKPDKIVSLIDINDMVVVDTPDALLVCPRKSSQKVKDVVNSLSVEGDERISLHQTVYRPWGTYTILESTERHKIKNITVMPQKKLSYQLHHHRSEHWVVVEGIACVQIEGKHFYLRQGESTFIRPGDKHRLLNPGKLPLEIIEVQLGESVDEDDIVRFDDEYGRVNDSSSVEDRI

SEQ ID NO: 24072 - protein, 230 aa, Methanococcoides burtonii DSM 6242
MDVNEISEGIFEVRKGGKKILATKNANPGSNVYGENLLEEEGEEYRAWDARRSKLAAMVIKKMKVPIKSNSRVLYLGAASGTTVSHVSDMLPNGIVYAVEFSPRTMRELIQLCDTRSNIVPILADASRPKLYAHIVEQVDVIFQDVAQPNQAQIAAVNAGQFLKEDGYLLLSIKARSIDTVANPSKVFKEEVNKLEKDFDTQFKVIKKYDLAPFHEDHLGLIAKKKLKEN

SEQ ID NO: 24073 - protein, 489 aa, Dechloromonas aromatica RCB
MSQPQRIHHFINGEFTASPDPRYFDKRSPVDGRVIAHIAEAGQADVDAAVTAARAALKGEWGKLSTDQRVDLLYGVANEITRRFDDFVAAEMADTGQPSHVQTHVFIPRGAANFKVFADVIKNVAAESFRMATPDGKGALNYAIRNPKGVIGVISPWNAPFLLMTWKVGPALACGNTVVVKPSEETPLTATLLGEVMNSVGIPKGVYNVINGFGPDSAGAYLTQHPGVDAITFTGETRTGTAIMKAAAEGMRDVSFELGGKNAGIVFADCNFEAAVDGIFRSAFLNTGQVCLGTERVYVERPIFENFVQALKAKVEGVRYGRPEDHTSTYGPLISQEHRDKVLSYYKKAVDEGATVVTGGGVPDMPAELAGGSWVQPTIWTGLPETAAVVREEIFGPCCHIRPFDSEEEVIELANANDYGLATTIWTENLSRAHRVAERVEVGVTWVNSWFLRDLRTPFGGSKQSGIGREGGVHSLEFYTETRNVCIKL

SEQ ID NO: 24074 - protein, 318 aa, Dechloromonas aromatica RCB
MLRIVQLEGESLIAEVRRPVFAHDWVEYPKTSPGQVVERLAGAAIAITNKVAINAAAIEALPELKMIAVSATGTNNVDLDACRRRGIVVSNIRGYAEHTVPEHVMALLLALSRNLIAWRETLQAGAWQRAEQFCLFDHPIRDLHGATLGLIGSGTLGNGVARLAEAFGMRVLRAERKGAAAVRPGYTAFAEVLAEADAISLHCPLTAETTGLIGEAELRAMKRSALLINTARGGIVDEAALVLALKEGWIAGAGFDVITAEPPPVGYIMLDPALLALPNFLLTPHVAWSSRPAMLTLADQLIDNIEAFVAGTPRNQVA

SEQ ID NO: 24075 - protein, 391 aa, Dechloromonas aromatica RCB
MAKASFNWEDPLLLDSQLAADERQVRNAARSFAQKALAPRIRDAFRNETTDPAIFREMGDMGLLGPTLPPQYGGAGLNYVSYGLIAREIERVDSAYRTLLSVQSSLVMLPIYAFGSEEQKQKYLPKLGKGEWIGCFGLTEPNSGSDPGSLATRARTVPGGWKLSGSKNWISSAPIADVFVVWAKDDDGVIRGFILDKGMPGLSAPVIHGKVGMRAAITGEIVMDEVFVPNENLLPGVSGLKGPFTCLNSARYGIAWGALGAAEACWHTARQYTLDRKQFDKPLAANQLIQKKLADMQTEITLGIQGALRLGRMMDDGSATPEIVSMMKRNSCGKALDIARTARDMLGGNGISDDFGVIRHLVNLEVVNTYEGTHDVHALILGRAQTGISAF

SEQ ID NO: 24076 - protein, 355 aa, Dechloromonas aromatica RCB
MSHLFDPLKLRDITLKNRIGIPPMCQYSAQDGMAADWHFVHYGSRAVGGAGLMIVEATAVVPEGRISPGDLGLWKDEQIEPLAKIARFAREQGCVAAIQLAHAGRKASVGLGWGEQRTLRADEGGWQSVAPSAISFGEGYAVPHELSIAGIAEVVAAFVAAARRAVVAGFQAIEIHAAHGYLMHQFLSPLSNQRTDAYGGSFENRTRLLREVVTAVRAVWPESLPLLIRLSATDWVEGGWSADETVALCRDLKTLGVDLADISTAGLVPTAKIPVGPGFQTEFAARVRHEAGLPTAAVGLITSAAQADHVLRTGQADMVLLGREILRNPYWPQQAAQELRQGGAWPNQYLRAALR

SEQ ID NO: 24077 - protein, 417 aa, Dechloromonas aromatica RCB
MRRRWLALGIVALAYILSFFQRFAPAGIAQDLAASFETSAASLGILAATYFYVYTLMQVPTGILVDTLGPRRILALGGLIGGAGSFLFGFAPSLELALVGRTLIGFGVSVTFIAMLKLVAVWFEENRFATMVGICMLIGNLGSVLAGAPLSALAQATGWRGVFIGVGFASLVLGALCWLIVRDTPESGVAVPKPHFDRTAVLSNLWAVVKNRDTWPAVAVNTGMSGAFFTFAGLWAMPYLMQVHGLARAVAATHLSLWFGGFAIGCLFIGGLSDRLGRRKPVLIVASHLYGAIWLIWLSCTTMPLALSYALFALMGLTTAGFSLTWACSKEVNPPMLSGMSTSVANMGGFLAGALLQPLVGWIMDLGWKGEMVSGARVYDVEIWRHGVLVLTVCAILGAASCWWIRETRCRNIWQAG

SEQ ID NO: 24078 - protein, 284 aa, Dechloromonas aromatica RCB
MKVGFIGLGVMGRPMALHLQRAGHELAVWARRPESIGDLPARVCATPAELGRCCEVVFTVITSSADVEAVALGREGLCEGMVAGSVLVDCSTIAPKSARYVGARLAEKGIHMLDAPVSGGAQGAIDATLAIMAGGEAEVLERVRPLLNCLGKRIVHVGPNGAGQVAKACNQMIMVAAIEAAAEAMRLATASGVDCAKVRQALAGGSAASRVLDVMGERMVRRDFSAGIEARLHHKDFGLVLEAARQSGVPVPLAAVVDQQLNALMAQGWGRDDTSSLLRVLEKL

SEQ ID NO: 24079 - protein, 217 aa, Dechloromonas aromatica RCB
MKLILLGAPGAGKGTQATFISKQFGIPQISTGDMLRAQVKAGTALGLEAKKHMDAGGLVPDAVIIGMVKDRLTQDDCKNGYLFDGFPRTIPQAQAMKDAGVPIEFVLEIDVPDSDIVERMAGRRAHLASGRTYHVKFNPPKVEGIDDVTGEPLVQRDDDKEETVKKRLEIYHSQTKPLVDFYGKWAAEGDAKAPKVRKVAGVGSVDNITKSVFEALK

SEQ ID NO: 24080 - protein, 360 aa, Dechloromonas aromatica RCB
MTTLFDPIQMGDIALANRIVMAPLTRNRAIEGNKPGPLTVEYYRQRATAGLIVAEASPISPTAQGYLDTPGIWSAEQVVAWQAVTKAVHAEGGKIVLQLWHVGRISHISLLPAGEVPVSSTDKVADASTFTSEGFIPVSKPRALHDDEIPALIEDYRKAARNAIAAGFDGVEIHAANTYLIEQFLRDSVNDRSGPYGGSIENRTRLLLEVTRAVAGEIGAGRTGIRLSPMTTFTAPLDSNPQALYGYVVEQLAPLGLAYLHVIEGETGGTRTPEGKPFDYAALHRAYPGVWMLNNGYDRDLALQTVADGKADLIAFGRPFISTPDLVRRLRDGAPLNELRADKLYGGGAEGYTDYPTLAG

SEQ ID NO: 24081 - protein, 160 aa, Dechloromonas aromatica RCB
MSQTLYDFSAQRLNGEPQDFEAYRGKVLLIVNTASECGFTPQYTGLEELYWMFKDRGFVVLGFPCNQFGGQEPGDAEAIGQFCQTRFDVTFPLFAKVDVNGDSAHPLYTWLKHEAAGVLGTEAIKWNFTKFLIDREGKVVHRYAPATRPDELVEAVEAQL

SEQ ID NO: 24082 - protein, 506 aa, Dechloromonas aromatica RCB
MLYASPGTAGAKIAYKAQYDNFIGGKWVAPVNGQYFDVVTPISGKPYTKAARSTAEDMELALDAAHAAFPTWGKTSAADRANVLLKIADRLEANLELLAYAETVDNGKAIRETLNADIPLAVDHFRYFAGCLRAQEGGISEIDENTMAYHIHEPLGVVGQIIPWNFPILMAAWKLAPAIGAGNCVVLKPAESTPISILILAELIADILPAGVLNIVNGYGREAGMPLATSKRIAKIAFTGSTSTGRVIAQAAANNLIPATLELGGKSPNVFFADIMDKDDSFLDKAVEGMVLFAFNQGEVCTCPSRALIQESIYEKFMERVLKRVAAIKQISPLDTDCMMGAQCSQEQMTKIQSYLELGKQEGAECLIGGERAHLGGDLEGGYYIQPTMFKGHNKMRIFQEEIFGPVLAVTTFKDEAEALAIANDTIYGLGAGVWSRNGNVAYRMGRAIQAGRVWTNCYHAYPAHAAFGGYKESGIGRETHKVMLDHYQQTKNLLVSYSETKLGFF

SEQ ID NO: 24083 - protein, 378 aa, Dechloromonas aromatica RCB
MSKRDFYEILGVNRDASDDEIKKAYRKLAMKHHPDRNPDNPGAEEKFKEAKEAYEILSDSQKRAAYDQFGHAGVEQGGMGGGGFGGGGGGFADAFGGIFDEIFGGRAGGSGGGRSNIYRGADLRYNLEITLEQAAHGTETKIRIPTMEVCEPCNGSGAKAGTQPKTCPTCGGSGQVRLQQGFFSIQQTCHKCHGTGRFIADPCKSCDGAGRIKQHKTLAVKIPAGVDEGDRIRLSGEGEHGVNGGPPGDLYVQIHLKPHAVFTRDHNDLHCEMPISFTAAALGGEIEIPTLDGAAAIKIPAETQSGRVFRLRGKGIKGVRSHTHGDLMCHVVVETPVNLTERQKELLRELEESSKDNSGKHNPRSKSWMDKVKDFFAE

SEQ ID NO: 24084 - protein, 453 aa, Dechloromonas aromatica RCB
MSLSSNQDWLARSQAAVWHPCTQMQHHAQTASAAHLPLVPIARGSGAWLYDFDGKRYLDGISSWWTNLFGHANPRINAALKDQLENLEHVMLAGFTHQPVVELSERLSALTGGSLGHAFYASDGASATEIALKMSFHYWRNTGRPEKAEFLCLAGSYHGETVGALAVTDVAIFKDAYAPLVRAATVIPSPDSRLAEAGESPADVARRAAAALEAHLEKHGENIAALIVEPLVQGAAGMVMYDPEYLRLARQLCDRYEVHLICDEIAVGCGRTGTFFAHEQAANDGNPIRPDLMCLSKGISGGYLPLSIVLCSDTIYEAFLDDSVARAFLHSHSYTGNPLACRAALATLNIFESDDILAANRLKSAKISTALAPLADHPQVRHLRQRGMITAFDVETDDPYFSRRFYRATLGREALIRPIGNTVYLMPPYIISDDEIAHLGQSIAGSLQEALAK

SEQ ID NO: 24085 - protein, 163 aa, Dechloromonas aromatica RCB
MTFKTPDLCDEFESELGKTVRVVTPMFQRYGGRTSFSGQIVTLKIFEDNSLVREVFGEDGKGKVLVIDGGGSLRCALVGDQLAILANKNGWEGVVVYGCIRDSGDINGIDIGVRALNTHPQKTLKKGVGDKNVAVTFGGVTFNPGEYLYADEDGVLVSGKALT

SEQ ID NO: 24086 - protein, 506 aa, Dechloromonas aromatica RCB
MNPSSLYLSTTLRRVETRHATEPLMQRAGAAAAEWVATLAGDQNHPVLVLAGPGNNGGDAFEVARLLQKRFFDVCVVFAAPPDKLPADAASARQRYVAAGGVTTHAIPEETRWSLIVDGLFGIGLTRAPEGDYAQWITAANRLAERDHCPLLALDCPSGLNADTGIAQAPSIHATHTITFIAAKPGLFTADGPDHCGEIRVASLDLDPVSEIPPDGQRLSLADVDSRLKPRRNNTHKGSFGSAGILGGAKSMVGAAFLAGRAALKMGAGRVYLGMLDPEAPSVDLLQPELMMRRADALLQADLQALACGPGLGRSAEALRLLEQSLKAPVQLVLDADALNLLAEDSRLEGKLYNRVGPAILTPHPAEAARLLGCSVRDIQSDRIKAARELAERYRSHIALKGCGTLIATVDGRWWINTTGNPGMATAGMGDVLSGLIVALLAQNWPPEMALLAAVHLHGAAADRLVAHGRGPIGLTAGEIIDTSRDIFNEWVAVPPACKMFASNAA

SEQ ID NO: 24087 - protein, 499 aa, Dechloromonas aromatica RCB
MRHALLFSVFVIASCGLAYELIAGALSSYLLGDSVTQFSTVIGTYLFAMGAGSWLSKYITRDLIGRFIQIELMVGLLGGFSAVGLFLVFTWLSAPFKLVLYLAVFGVGVLVGLEIPLVMRILKRELAFKDLVSQVLTFDYLGALAVSILFPLVLAPQLGMVRTGLLFGVLNVAVALWALHLFREQLPSRRWLAMQSWGVFGLLAIGFAGAGQLTTFAEAHLYADEIVHAETTPYQRIVVTRWRDDLRLFLNNNLQFSSHDEYRYHEALVHPGLASLPGAKRVLVLGGGDGLAVREILKYPNVESVTLVDLDPAMTDLFATAPALVALNQGALKSERVTVVNADALQWLEDSKEYFDFIVIDFPDPANFALGKLYTSAFYRLIEKRLSARGLLVVQSTSPLYARQSFWCVVATLESAGFKTAPYHALVPSFGEWGYIIAGRQAFSMPAFASDKTRFLTSETLAGMFNFPADMARVPAEVNQLNNQVLVRYFETEWRKVIR

SEQ ID NO: 24088 - protein, 355 aa, Dechloromonas aromatica RCB
MSIEIRNISKRFGNFVALDNINLDIPTGELVALLGPSGCGKTTLLRIIAGMETADQGEILFSGAEATHLHARDRNVGFVFQHYALFRHMTVFENVAFGLRVKPRSERPSDADIKRRVMELLGLVQLDWLADRYPSQLSGGQRQRIALARALAVEPKVLLLDEPFGALDTKVRKELRRWLRRLHDDMHISSVFVTHDQEEALEVADRVVVMNHGKIEQIGSPDEVYSSPASPFVYQFLGNVNVFHSRQQGAYAEVERGDAAEKATAFVRPHDIDISHQPSEDGLQATVQHVHPIGPVVRIELLHGSEIVEVELSRERHETLQLAAGQAVWFRPRQMKVFGADALPRATPEKQAFLF

SEQ ID NO: 24089 - protein, 233 aa, Dechloromonas aromatica RCB
MSAKDYVIAPSILSANFAKLGEEVANVIASGADWIHFDVMDNHYVPNLTIGPLVCEAIRPCTTAPIDVHLMVKPVDRIIPDFAKAGANIITFHPEASEHVDRSLSLIRDAGCKGGLVFNPATPLDYMDYVLDKIDVILLMSVNPGFGGQKFIPGTLAKAKQARAKLDAYERETGRRIRLEIDGGVNTANIAEIARAGVDAFVAGSAVYGAGKDSDPHRYDSIIGALRSELAKV

SEQ ID NO: 24090 - protein, 251 aa, Dechloromonas aromatica RCB
MSQPPVIELSGVTASFRGQMVHRDLALRVEEGQIVGLLGGSGSGKTTLLREILGLLRPDTGIVRLFGVDLNDPDVVLQRDVRRRLGMLFQHGALFSALSVFDNIAFPLRELRCLDEDWIRRLVHLKLAMVGLEEVHGKQMPAELSGGMVKRVALARALALEPELLLLDEPTAGLDPDRSQNFVELVGNLQRELGLTVVMVTHDLNTLAGLATHVAVLADQQIVAFGTRAEIMTVDHPFVTGFFGADRRKLL

SEQ ID NO: 24091 - protein, 363 aa, Dechloromonas aromatica RCB
MSDDLQKALAGVRTDIDRIDGELLKLLNERARCAQRVGEIKAEHGEAGHIYRPEREAQVLRRLQEANPGPLPGENITFFFREVMSACLSLEEPLGIAFLGPLGTFSESAATKHFGHAARLLPQSSIDDVFREVESGHAHYAVVPVENSTEGAVGRTMDLLLATPLKICGEVVLRIHQNLLTNETDLGKITKVYSHAQSLAQCHEWLNRVLPKAQRISVGSNAQAAQNAAAEPGTAAIAGEAAAARYNLPKLVENIEDEPNNTTRFLVLGKHDSGISGRDKTSLIMSAPNRTGALHELLLPLSTAGVSMCRLESRPARNALWEYVFYVDIEGHRDEPAIKAALEKLAGYAAYLKILGSYPVAVY

SEQ ID NO: 24092 - protein, 182 aa, Dechloromonas aromatica RCB
MDLQKAQAMLANAELIHDEAIVQAAVAEVAQAIRERLADKYPLVLCVMTGGVVFCGQLLTKLDFPLDFDYLHATRYGPETQGGKISWRSAPWTSVKGRSVLVVDDILDEGVTLAAVKESLRRMGAEEVLTAVFADKLNGKEKPVAADFIGLTVPDRFVFGYGMDAGGVWRNLPAIYAMKDDA

SEQ ID NO: 24093 - protein, 479 aa, Dechloromonas aromatica RCB
MSTADIGVIGLGVMGVNLALNLSDQGFRLSVYNRTLAVTTEFVATHGLDRVIAAAGSPEELVSHLAPPRIILLMVTAGRAVDAVIGQLLPRLEPGDILIDGGNSNYRDSQRRCRELATQGIHFVGMGISGGEEGARHGPSLMPGGAAAAWPTIRDMFQSIAARVDDIPCCQWLGDGGAGHYVKMVHNGIEYGDMQLIAEVCHLMQHALGMSHDEMADTFAEWNAGRLESYLIDITSRILRQRDKDGSPLVDNILDRAGQKGTGVWTAQDALDHAVPLTLIGEAVHARMLSARKAERVAAAALLGSKPVAVAKTARADCLSALHDALYAAKLVSYAQGFMLMQAAAEAEGWVLPYGEIALLWRAGCIIRSRFLADIKASFSRTPVPPSLLQDPFFIAEIKAAEAGWRQAVMLAVGSGVAAPALSSALAFYDGYRCANGSANIIQAQRDFFGAHSYQRTDRDGSENFHTRWLGDGVEEQLP

SEQ ID NO: 24094 - protein, 427 aa, Dechloromonas aromatica RCB
MTSRNQQLFERAQRHIPGGVNSPVRAFRSVGGTPCFFQKGVGAKVQDADGKWYTDYVGSWGPMILGHAHPDVIAAVQAAVVDGLSFGAPTEKEVDIADLLCELVPSMDMVRLVSSGTEATMSAIRLARGHTGRDVLIKFEGCYHGHSDGLLVKAGSGLLTFGNPSSSGVPAGTAETTMVLTYNDPQELADAFAKHGDKIAAVIVEPVVGNMNLIAPTQAFLNAMRDLCTKNGSVLIFDEVMTGFRVGLKSAQGLFGITPDLSTFGKVVGGGMPLGAFGGKREIMEKIAPLGPVYQAGTLSGNPIATAAGLATLKLIQAPGFYEALTAKTKALCDGLVAAAKKHGVAFSAQNIGGMFGLYFAEQCPGTYDEVLACDKEAFNRFFHAMLDAGHYFAPSAFEAGFVSAAHSDADIAGTIAAADAYFASLK

SEQ ID NO: 24095 - protein, 310 aa, Dechloromonas aromatica RCB
MKIANNVTELVGNTPLVKLNRVTAGAGATIAAKLEFFNPGHSVKDRIAVSMLDAAIAAGKVGPDTVILEPTSGNTGIGLAMVCAARGIKCAFVMPETMSRERKLLLKAYGAELILTPGPEGMGGAIAKAKALAESDPKYFVPQQFENPANPEVHRNTTAEEIWRDTDGQVDIFVSGVGTGGTITGVGEVLKAKKPGIKIVAVEPDASPVLSGGQKGPHPIQGIGAGFVPGVLNTAVYDEVIRVKNDDAFAIARQMATEEGLLVGISSGAATWAALELARRPENAGKLIVVIIPSFGERYLSTPLYQHLEV

SEQ ID NO: 24096 - protein, 488 aa, Dechloromonas aromatica RCB
MGKPTGFMEFERLNESYDPVEQRLKHYKEFVHTLNDEDAKIQGARCMDCGIPFCNNGCPVNNIIPDWNDLVYRGNWKQALDVLHSTNNFPDFTGRICPAPCEAACTLGINAAPVGIKSIEHFIIDKGWESGWVVPQPPKAKTGKKVAVVGSGPAGLAAAQQLARVGHDVTVFEKSDRIGGLLGYGIPDFKLEKTVIDRRVAQMEAEGVTFKTKVVVGDKAVPAGINNDAIEFVSADQLKKDFDAVILAAGSEVPRDLPVPGRELKGIYAALEFLIPQNKEVQQGKANPINVKGKHVIVIGGGDTGSDCVGTSNRHGAASVTQFELMPMPPEEENKALTWPYWPYKLRTSSSHDEGCSRDFAVATKGFIDDGKGNVKALKAVRLDWKDGKMSEVAGSEFELPCDNAFLAMGFTNPVGGLLDAFGVEKDARQNAKATTDGEGCYKTNVDKVYAAGDVRRGQSLVVWAIREGRQAAREVDAFLMGSTTLPR

SEQ ID NO: 24097 - protein, 465 aa, Laureliopsis philippiana
VGFKAGVKDYKLTYYTPEYETKDTDILAAFRVTPQPGVPPEEAGAAVAAESSTGTWTTVWTDGLTSLDRYKGRCYHIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCTEAIYKAQSETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHSGTVVGKLEGERDITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLASEGNEIIREASKWSPELAAACEVWKEIKFEFQAMDTL

SEQ ID NO: 24098 - protein, 465 aa, Glossocalyx longicuspis
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQRNHGIHFRVLAKALRMSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 24099 - protein, 465 aa, Illigera luzonensis
VGFKAGVKDYKLTYYTPDYEPKDTDILAAFRVTPQPGVPPEEAGAAVAAESSTGTWTAVWTDGLTSLDRYKGRCYDLEPVAGEENQYIAYVAYPLDLFEEGSVTNMFTSIVGNVFGFKALRALRLEDLRIPIAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGDRDITLGFVDLLRDDFIEKDRARGIYFTQDWVSMPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTV

SEQ ID NO: 24100 - protein, 465 aa, Daphnandra repandula
VGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCTEAIYKSQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHSGTVVGKLEGERDITLGFVDLLRDDYIEKDRSRGIYFTQDWVSMPGVLPVASGGIHVWHMPALTEIFGDDSVLQFGGGTLGHPWGNAPGAVANRVALEACVQARNEGRDLASEGNEIIREASKWSPELAAACEVWKEIKFEFQAMDTL

SEQ ID NO: 24101 - protein, 191 aa, Paracoccidioides brasiliensis
MAEIRRKLVIVGDGACGKTCLLIVFSKGTFPEVYVPTVFENYVADVEVDGKHVELALWDTAGQEDYDRLRPLSYPDSHVILICFAIDSPDSLDNVQEKWISEVLHFCQGHPIILVGCKKDLRDDPRTIEELRKTSQKPVTTEQGEEVRKKIGAYKYLECSARTNDGVREVFESATRAALLAKKEKKKCKIL

SEQ ID NO: 24102 - protein, 499 aa, Saccharomyces cerevisiae
MSRLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETSLPRVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 24103 - protein, 402 aa, Pectobacterium carotovorum
MEYQSGKRVLSLSLGLIGLFSASAFASDSRTVSEPKAPSSCTVLKADSSTATSTIQKALNNCGQGKAVKLSAGSSSVFLSGPLSLPSGVSLLIDKGVTLRAVNNAKSFENAPSSCGVVDTNGKGCDAFITATSTTNSGIYGPGTIDGQGGVKLQDKKVSWWDLAADAKVKKLKQNTPRLIQINKSKNFTLYNVSLINSPNFHVVFSDGDGFTAWKTTIKTPSTARNTDGIDPMSSKNITIAHSNISTGDDNVAIKAYKGRSETRNISILHNEFGTGHGMSIGSETMGVYNVTVDDLVMTGTTNGLRIKSDKSAAGVVNGVRYSNVVMKNVAKPIVIDTVYEKKEGSNVPDWSDITFKDITSQTKGVVVLNGENAKKPIEVTMKNVKLTSDSTWQIKNVNVKK

SEQ ID NO: 24104 - protein, 423 aa, Halomonas elongata
MQTQILERMESEVRTYSRSFPTVFTEAKGARLHAEDGNQYIDFLAGAGTLNYGHNHPKLKQALADYIASDGIVHGLDMWSAAKRDYLETLEEVILKPRGLDYKVHLPGPTGTNAVEAAIRLARNAKGRHNIVTFTNGFHGVTMGALATTGNRKFREATGGIPTQGASFMPFDGYMGEGVDTLSYFEKLLGDNSGGLDVPAAVIIETVQGEGGINPAGIPWLQRLEKICRDHDMLLIVDDIQAGCGRTGKFFSFEHAGITPDIVTNSKSLSGFGLPFAHVLMRPELDIWKPGQYNGTFRGFNLAFVTAAAAMRHFWSDDTFERDVQRKGRVVEDRFQKLASFMTEKGHPASERGRGLMRGLDVGDGDMADKITAQAFKNGLIIETSGHSGQVIKCLCPLTITDEDLVGGLDILEQSVKEVFGQA

SEQ ID NO: 24105 - protein, 117 aa, Helicobacter pylori
MKIKNILLSGGSGKRLWPLSRSLYPKQFLKLFNHKSLFELSFKRNASLVDETLIVCNEKHYFLALEEIESEIKNKSVGFLLESLSKNTANAIALSALMSEREDLLIVTPSDHLIKDL

SEQ ID NO: 24106 - protein, 335 aa, Lycopersicon esculentum
MVHQKQVKDVVSGWLTVFDDGSVDRTWTGPPEVKFMAEPVPPHDDFIDGVAVKDVVAGENSGSRFRIYLPERNDSSVDKLPVILHFHGGGFCISQADWFMYYAVYTRLARVANAIVVSVFLPLAPEHRLPAACDAGFAGLLWLRDVSREQGHEPWLNEYADFNRVFLIGDSSGGNVVHQVAARAGEEDLSPMKLAGAIPIHPGFMRSQRSKSELEQEQTPFLTLDMVDKFMELALPIGSTKDHPITCPMGDAAPAVEELKLPPYLYCVAEKDLIEDTEMEFYESLKTGEKDVELLINNGVGHSFYLNKIAVDMDPVTGSATEKLFEAIAEFINKH

SEQ ID NO: 24107 - protein, 394 aa, Rhizobium etli
MTKTWRPATQLVHGGTWRSEYGETSEAIYLTQGFVYDTSEPAEARFKGETDGFIYARYGSPTNDMFEKRMCALEGAEDARATASGMAAVAAAVLCQVKAGDHIVAARALFGSCRWVVETLAPKYGVECTLVDGRDLANWEKAIRPNTKVFFLESPTNPTLEVVDISGVAKLANQVGAKLIVDNVFATPLFQKPLELGAHIVVYSATKHIDGQGACLGGVVLADKAWIDENLHDYFRHTGPAMSPFNAWTLLKGIETLPLRVRQQTENAAKIADFLAEQGKVAKVIYPGRKDHPQAEIIAKQMTGGSTLVCFELKGGKEAAFALQNALEIIKISNNLGDTKSLITHPATTTHKNLTEEARAELGISPGTVRLSAGIEDTDDLIEDFARGLTKVSA

SEQ ID NO: 24108 - protein, 370 aa, Pneumocystis carinii
MDSKHSVFNVMGQEFVLQKGYEVIKGLGKGSYGVVCSAKNIEVEDNNKVAIKKITNIFSKKMLAKRALREIMLLQHFRNHKNITTLYDMDIVDPSKFNELYLYEELMQANLNSIIRSDQPLTDAHFQSFIYQILCGLKYIHSANVLHRDLKPSNLLINADCKLKICDFGLSRGISVNQGQGTEYMTEYVTTRWYRAPEVMLSFQSYSKAIDLWSVGCILAELLGRKPFFKGSNYVDQLNQIFCILGTPNENIISKIKSASAQSYIRSLPTLPKMPYSKIFPYANPDALDLLNCLLTFDPYDRISCEEALEHPYLIIWHDPNKEPVCSEQFDFGFEAIDSIEEIRQMIINEVSRFKGLTGNQKLYHSISNT

SEQ ID NO: 24109 - protein, 168 aa, Hevea brasiliensis
MLVYQDLLTGDELLSDSFPYKEIHNGILWEVEGKWVVQGAVDVDIGANPSAEGADEDEGVDDQAVKVVDIVDTFRLQEQPAFDKKQFVTYMKRFIKLLTPKLDEEKQESFKKNIEGATKFLLSKLSDLQFFVGESMHDDGSLVFAYYRGGATDPTFLYFAYALKEVKC

SEQ ID NO: 24110 - protein, 499 aa, Glycyrrhiza echinata
MDILSLLSYSVFYLALFFIFNIVIRARKFKNLPPGPPSLPIIGNLHHLKRPLHRTFKGLSEKYGHVISLWFGSRLVVVVSSASEFQQCFTKNDVVLANRPRFLSGKYIFYNYTTLGSTSYGEHWRNLRRITALDVLSNHRINSFSGIRRDETQRLITRLADDSSTNFAEIELSYRFYDMTFNNIMRMISGKRYYGEDCDMSDLQEASQFRDMVSELLQLSGANNKTDFMPLLRFLDFENLEKRLKDISGKTDAFLRGLIQEHRAKKERANTMIDHLLNLQDSQPEYYTDQIIKGLALAMLLAGTDSSAVTLEWSMSNLLNHPEVLKKVKDELDTHVGQDRLVDESDLPKLSYLKNVINETLRLYTPAPLLLPHSTSDECNIGGYKVPQDTIVLINAWAIHRDPELWTEATTFKPERFEKKGELEKLIAFGMGRRACPGEGLAIRAISMTLALLIQCFDWKLTNGDKIDMAERDGFTLTKLVPLKAMCKSRPVINKVFKQ

SEQ ID NO: 24111 - protein, 157 aa, Enterobacter aerogenes
LLDYIRSTKVASGEAGGITQHIGAYHVETDNGMITFLDTPGHAAFTSMRARGAQATDIVVLVVAADDGVMPQTVEAIQHAKAAQVPVVVAVNKIDKPEADMDRVKNELSQYGVMPEEWGGEAQFIPVSAKVGTGIDDLLNAILLQAEVLELKAVRNG

SEQ ID NO: 24112 - protein, 159 aa, Enterobacter aerogenes
LLDYIRSTKVASGEAGGITQHIGAYHVETDNGMITFLDTPGHAAFTSMRARGAQATDIVVLVVAADDGVMPQTVEAIQHAKAAQVPVVVAVNKIDKPEADMDRVKNELSQYGVMPEEWGGEAQFIPVSAKVGTGIDDLLNAILLQAEVLELKAVRNGMA

SEQ ID NO: 24113 - protein, 156 aa, Enterobacter aerogenes
LLDYIRSTKVASGEAGGITQHIGAYHVETDNGMITFLDTPGHAAFTSMRARGAQATDIVVLVVAADDGVMPQTVEAIQHAKAAQVPVVVAVNKIDKPEADMDRVKNELSQYGVMPEEWGGEAQFIPVSAKVGTGIDDLLNAILLQAEVLELKAVRN

SEQ ID NO: 24114 - protein, 366 aa, Mycobacterium leprae
MATLAESPEPKSGASRAGVLGEEAGYHKGLKPRQLQMIGIGGAIGTGLFLGAGGRLAKAGPGLFLVYAVCGVFVFLILRALGELVLHRPSSGSFVSYAREFFGEKAAYVVGWLYFLDWAMTAIVDTTAIATYLHRWTIFTALPQWTLALLALAVVLVMNLISVEWFGELEFWAALIKVCALMAFLVVGTIFLGGRYPVDGHNTGLSLWTSHGGLFPTGVAQLIVVSSGVMFAYAAVELVGTAAGETVEPKKIMPRAINSVIARIAIFYVGSVILLALLLPYSAFKASESPFVTFFSKVGFYGAGDLMNIVVLTAALSSLNAGLYATGRVMHSIAINGSGPKFTARMSKNGVPYGGILLAAVICLCG

SEQ ID NO: 24115 - protein, 247 aa, Leuconostoc lactis
MVDNDLVKISKLSKFYGKKQVLHNINFSIPKNKVTVLLGPSGSGKSTLIRTLNGLEPFQAGAIEVFNQVIDSHTKNGWRDIRGKIGMVFQSYDLFPNMSVIKNVTLGPVKVQKRKVSEVLTAARALLKEVGLAEYENAYPRNLSGGQKQRVAIVRALILRPSLILFDEITASLDPEMVRGVLEILKKLADGKLTMVVVTHEMNFAQQIADQVVFLEEGKIVEIGGGQDFFDQPKTLRAQQFLESMSF

SEQ ID NO: 24116 - protein, 472 aa, Arabidopsis thaliana
FASSGSDDNDVVIIGGGPGGYVAAIKAAQLGLKTTCIEKRGALGGTCLNVGCIPSKALLHSSHMYHEAKHVFANHGVKVSSVEVDLPAMLAQKDTAVKNLTRGVEGLFKKNKVNYVKGYGKFLSPSEVSVDTIDGENVVVKGKHIIVATGSDVKSLPGITIDEKKIVSSTGALSLTEIPKKLIVIGAGYIGLEMGSVWGRLGSEVTVVEFAADIVPAMDGEIRKQFQRSLEKQKMKFMLKTKVVGVDSSGDGVKLIVEPAEGGEQTTLEADVVLVSAGRTPFTSGLDLEKIGVETDKGGRILVNERFSTNVSGVYAIGDVIPGPMLAHKAEEDGVACVEFIAGKHGHVDYDKVPGVVYTYPEVASVGKTEEQLKKEGVSYNVGKFPFMANSRAKAIDTAEGMVKILADKETDKILGVHIMSPNAGELIHEAVLAINYDASSEDIARVCHAHPTMSEAIKEAAMATYDKPIHM

SEQ ID NO: 24117 - protein, 353 aa, Nicotiana sylvestris
MEVISTNTNGSTIFKSGAIPMNGHQNGTSKHQNGHKNGTSEEQNGTISHDNGNELLGNSNCIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFNDPRVTLVLGDGAAFVKAAQAEYYDAIIVDSSDPIGPAKDLFERPFFEAVAKALRPGGVVCTQAESIWLHMHIIKQIIANCRQVFKGSVNYAWTTVPTYPTGVIGYMLCSTEGPEIDFKNPVNPIDKETAQVKSKLAPLKFYNSDIHKAAFILPSFARSMIES

SEQ ID NO: 24118 - protein, 319 aa, Nicotiana sylvestris
MEVISTNTNGSTIFKNGAIPMNGYQNGTSKHQNGHQNGTSEHRNGHQNGISEHQNGHQNGTSEHQNGHQNGTISHDNGNELQLLGSSNSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFSDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPT

SEQ ID NO: 24119 - protein, 430 aa, Nicotiana sylvestris
MEVISTNTNGSTIFKNGAIPMNGHQSGTSKHLNGYQNGTSKHQNGHHNGTSEHRNGHQNGISEHQNGHQNGTSEHRNGHQNGTSEHRNGHQNGISEHQNGHQNGTSEHQNGHQNGTSEQQNGTISHDNGNELLGNSNSIKLGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPINPIDKETTQVKSKLAPLKFYNSDIHKAAFILPSFARSMIES

SEQ ID NO: 24120 - protein, 469 aa, Corynebacterium glutamicum
MTEHYDVVVLGAGPGGYVSAIRAAQLGKKVAVIEKQYWGGVCLNVGCIPSKSLIKNAEVAHTFTHEKKTFGINGEVTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASLPFSANGKAVGLAETDGFAKIVADAEFGELLGAHLVGANASELINELVLAQNWDLTTEEISRSVHIHPTLSEAVKEAAHGISGHMINF

SEQ ID NO: 24121 - protein, 400 aa, Arxula adeninivorans
  misc_feature (380)..(380): Xaa can be any naturally occurring amino acid
MADFIRTQIFGTCFEITSRYVDLNPVGMGAFGLVCSARDQLTNQNVAIKKIMKPFSTPVLAKRTYRELKLLKHLRHENLITLSDIFISPLEDIYFVTELLGTDLHRLLTSRPLEHQFIQYFLYQILRGLKYVHSAGVVHRDLKPSNILINENCDLKICDFGLARIQDPQMTGYVSTRYYRAPEIMLTWQKYDVEVDIWSAGCIFAEMLRGKPLFPGKDHVHQFSIITELLGNPPDDVIETIGSENTLNFVKSLPKRERIPLSQKFPNADPDAVDLLEKMLVFDPRKRINAADALAHPYLAPYHEPSDEPVASEKFDWSFNDADLPVDTWKVMMYSEILDFHNVDSSAVEQQQQQPQPPQPQLQQQQQPPQQPQQPQQPQXAQQPVQPVQGDYVPQVAPRS

SEQ ID NO: 24122 - protein, 415 aa, Hevea brasiliensis
MFGRAPKKSDNTKYYEILGVSKNASQDDLKKAYRKAAIKNHPDKGGDPEKFKELAQAYEVLSDPEKREIYDQYGEDALKEGMGSGGGAHDPFDIFQSFFGGNPFGGGGSSRGRRKEGEDVIHPLKVSLEDLYNGTSKKLSLSRNVICSKCKGKGSKSGASMKCSGCQGSGMKVSIRQLGPSMIQQMQHPCNECKGTGETINDKDRCPQCKGEKVVQEKKVLEVIVEKGMQNGQRITFPGEADEAPDTITGDIVFVLQQKEHPKFKRKGDDLIVDHTLSLTEALCASQFILTHLDGDLLIKSQPGEVVKPDQFKAINDEGMPMYQRPFMRGKLYIHFSVDFPDSLPPDQCKALEAVLPSRTSVQLSDMELDECEETTLHDVNFDEEMRRKQQQAQEAYDEDDDMHGGGQRVQCAQQ

SEQ ID NO: 24123 - protein, 292 aa, Salmonella typhimurium
MCTPRGLTPPWFFIVLIGQKLMESNNKLKRGLSTRHIRFMALGSAIGTGLFYGSADAIKMAGPSVLLAYIIGGVAAYIIMRALGEMSVHNPAASSFSRYAQENLGPLAGYITGWTYCFEILIVAIADVTAFGIYMGVWFPAVPHWIWVLSVVLIICAINLMSVKVFGELEFWFSFFKVATIIIMIVAGIGIIVWGIGNGGQPTGIHNLWSNGGFFSNGWLGMIMSLQMVMFAYGGIEIIGITAGEAKDPEKSIPRAINSVPMRIWYFMSARCSSLCLSIRGIRSAQTAVHLC

SEQ ID NO: 24124 - protein, 331 aa, Anabaena sp.
MQNLQNFRDYYEILGVTKDATNEDIKKNYRRLARQYHPDLNPGNKDAEEKFKIIGEAYEMLSDATKRAQYDQFSRYWKQKGFPKQTPKSKAWGDSRNGERNGNENVDPSQFTNFEDFLNQVIGVGSRRDSKNGASTNTTTDPFRSPKSRVEYTVPKNPSRPARRDIEARLTLPFEKAYSGGNERIRLEDGRSLEVTMPPGMVTGQTIRLRNQGISGGDLYLKITVEPHPLFKLEGTNIFCQVPVTPSEPFLGGQVEAPTLDGPVKMTIPPGVRSGQRFRLANKGYPSDNGKRGDQLVEIQILTPKTISQEEKELYEKLRQIETFKPRADLI

SEQ ID NO: 24125 - protein, 341 aa, Populus deltoides
MGSLETERKIVGWAATDSTGHLAPYTYSLRDTGPEDVFIKVISCGVCHTDIHQIKNDLGMSHYPMVPGHEVVGEVVEVGSDVTRFKVGDVVGVGVIVGSCKNCHPCKSEIEQYCNKKIWSYNDVYTDGKPTQGGFAESMVVHQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINAPLQFVTPMVMLGRKSITGSFIGSMKETEEMLEFCKEKGVASMIEVIKMDYINTHSRGLRKMM

SEQ ID NO: 24126 - protein, 333 aa, Anabaena variabilis ATCC 29413
MNMQNLQNFRDYYEILGVTKDATNEDIKKNYRRLARQYHPDLNPGNKDAEEKFKIIGEAYEMLSDATKRAQYDQFSRYWKQKGFPKQTPKSKAWGDSRNGERNGNENVDPSQFTNFEDFLNQVIGVGSRRDSKNGASTNTTTDPFRSPKSRVEYTVPKNPARPARRDIEARLTLPFEKAYSGGNERIRLEDGRSLEVTMPPGMVTGQTIRLRNQGISGGDLYLKITVEPHPLFKLEGTNIFCQVPVTPSEVSLGGQVEAPTLDGPVKMTIPPGVRSGQRFRLANKGYPSDNGKRGDQLVEIQILTPKTISQEERELYEKLRQIETFKPRADLI

SEQ ID NO: 24127 - protein, 464 aa, Arabidopsis thaliana
MAARIGIFSVFVAVLLSISAFSSAQDLQIVNAERRIDLSSHIVKAFLTLKVENIGKDPAAEMLLAFPPTQIKNLAMVQALATTGKKKKKTYLPLDVKPTEQPDAPNDTGYYRVTFISPLGPGETVSLEVLYILTHSLEPFPVEITQSESQLVYYHDSAVILSPYHVKQQTTFIKTPSTRVESFTSIEPANRAGKEIKYGPYENRASYSYTPVIIHFENNSPFAVVEELVREIEISHWGSLQITENYRLTHGGARHKGVFSRVDYQSKRSVSGASSFNALLAVLPPRVNSVYYRDEIGNISTSHLRTGFRKSELEFEPRYPLFGGWSATFIIGYRVPLEDYLFEASDGRRYLNFTFGCPLVETIVNKLTIKVVLPEGSKDPSAVLPFTVNQELQVKYSYLDIVGRTVVVLQKDNVVPTHNVPFQVYYTFKPIYMLAEPFMLVSAFFLVFVASLAYVHIDLNIVRK

SEQ ID NO: 24128 - protein, 404 aa, Erwinia chrysanthemi
MNNSRMSSVSTQKTTGRSALGTKSALAAIIATTMMVSVASAASLQTTKATEAASTGWATQSGGTTGGAKASSSKIYAVKSISEFKAALNGTDSSPKIIQVTGAIDISGGKAYTSFDDQKARSQISIPSNTTIIGIGNKGKFTNGSLVVKGVSNVILRNLYIETPVDVAPHYEEGDGWNAEWDAVVIDSTDHVWVDHVTISDGSFTDDKYTTKNGEKYVQHDGSLDIKRGSDYVTVSNSRFELHDKTILIGHSDNNGSQDAGKLRVTFHNNLFDRVGERTPRVRFGSVHAYNNVYVGDVNHKAYRYQYSFGIGTSGSLLSESNAFTIDNMKKISGRDKECSVVKAFNGKIFSDKGSIINGASYNLNGCGFGFSAYSAKIPYKYSAQTITTSLAGSISSNAGYGKL

SEQ ID NO: 24129 - protein, 391 aa, Erwinia chrysanthemi
MNNTRVSFRSTKSLLAAIIATSMMTWSVNRATLQTTKATEAASTGWATQGGTTGGAKAASAKIYAVKNISEFKAALNGTDTDPKIIQVTGAIDISGGKAYTSFDDQKARSQISVPSNTTIIGIGSNGKFTNGSLVIKGVSNVILRNLYIETPVDVAPHYEEGDGWNAEWDAAVIDNSTRVWVDHVTISDGSFTDDKYTTKNGEKYVQHDGALDIKKGSDYVTISSSRFELHDKTILIGHSDSNGSQDSGKLRVTFHNNVFDRVTERTPRVRFGSIHAYNNVYLGDVKNSVYPYLYSFGLGTSGTILSESNSFTLSNLKSIDGKNPECSIVKQFNSKVFSDNGSLVNGSSTTKLDTCAVTAYKPTLPYKYSAQTMTSSLASSINSNAGYGKL

SEQ ID NO: 24130 - protein, 396 aa, Glycine max
  misc_feature (39)..(39): Xaa can be any naturally occurring amino acid
MAIQHHNEQLEHNENVSSVLDALYCDEGKWEDEEEEEEXYEESEVTTNTGTSLFPLLMLEQDLFWEDEELNSLFSKEKVQHEEAYDYNNLNSDDNSNDHSNNNNNVLSDSCLSQPRREAVEWILKVNAHYGFSALTATLAVTYLDRFLLSFHFQREKPWMIQLVAVTCISLAAKVEETQVPLLLDLQVQDTKYVFEAKTIQRMELLVLSTLKWKMHPVTPLSFLDHIIRRLGLKTHLHWEFLRRCEHLLLSVLLDSRFVGCLPSVLATATMLHVIDQIKHNGGMEYKTQLLSVLKISKEKVDECYNAILQLSKANKYGHNNINNTSKRKYEQIPSSPSGVIDAAFCSDGSNDSWAVGSSLLYSPPEPLFKKSRTQGQQMNLSPLKRFIIGIVGTPP

SEQ ID NO: 24131 - protein, 166 aa, Glycine max
MEMAQVKARARTALAMAASASSPKRRKISFVQIKSLSNATSPTTEERISGESPASCCSSNGSFDNENRIIKSSDLEVESAQVETWTCNCGEQQQQKIRREMSLTREVDSTEEHITKTKSRCVPTESELEDFFAAAEKDIQKRFTDKYNYDFVKDMPLEGRYEWVQL

SEQ ID NO: 24132 - protein, 380 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLERMLVFDPKKRITAADALVHPYLAPYHDPTDEPTAEAQFDWDFNDADLPVDTWRVMMYSEILDFHKIGGGDGQIDTNAAFDDQVAAATAAPMAQHTNQTNQ

SEQ ID NO: 24133 - protein, 386 aa, Ipomoea purpurea
MVDGNHPLPAPKVCVTGAAGFIGSWLVKTLLQRGYHVHATVRDPGNTKKVKHLVELPKADTNLTVWKGVMEEEGSFDEAIAGCEGVFHVATPMDFDSKDPENEVIKPTINGVLNIINSCVKAKTVKRLVFTSSAGTLNVQPQQKPVYDETCWSDLDFIYAKKMTGWMYFASKILAEKEAWKATKEKKIDFISIIPPLVVGPFITPTFPPSLITALSLITGNQAHYSIIKQGQYVHLDDLCEAHIFLYEHPKAEGRFICSSHHTTIHGLAEMITQNWPEYYIPSQFKGIEKELAVVYFSSKKLQDMGFQFKYSLEDMYRGAIETLRKKGLLPYSTKEAAAIEEEQETVPLKVEEPTAIEQKQETVPLKLEEEPIAIEKKQEVVPLKA

SEQ ID NO: 24134 - protein, 425 aa, Clostridium perfringens
MDRNKEIFEESKKYMPGGVNSPVRSFGSVGINPPVIKSGKGAMIKDENGNEYIDFVLAWGPMILGHCDEDVVKAIKKTSEESIAFGASTKLELDLAKLLCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYGALLIFDEVMCGFRVAYKGAQTLFDVKPDLVTYAKIMGGGLPCGAYGGRREIMENLSPLGGVYQAGTMSGNPIVMSAGLATVKKLYENPSYYDHIEKIGSKLEKGVLEIAKKKGLGLVVNRQGGMMTLFFTDLKEVKCYDDVKTCDGERFKRYFLHMLNKGFNIPPSQFEAMFLSVKHTEEHIDKFLEAFESFEG

SEQ ID NO: 24135 - protein, 407 aa, Clostridium perfringens
MRYIVVGASAAGISGAKTLRELDKDAEIILVSKDENVYSRCILHHYISGHRDIEALDFTDRDFFEKYNIEWKKGLEVKAIDDREHVIVLSNGESLKYDKILLATGASAFIPPVENLREAKNVVGLRNLEDAIKIKEEAEKVKNVVVLGAGLVGIDAIAGLAFKDLNVTLVEMGDRVLPIQLDKYASSKYEKRFEDAGVKLKLGVRAEKVLIDENKNPKALLINTGEEIPCELIIVATGVRSNVAFLKDSSIETDRFGLIINEKGETNARDVYGAGDITGRNPIWPTAVKEGIIAANNMVGNEIFMEDFFGSKNTMNFLGLTTMSLGVVNAPDDSYTEEIDISGENYKKIIHKDGKIYGAIIQGDLSYAGVLTQLIKEKIHVSKVKKPLFEIDYADFFNIKENLEYTY

SEQ ID NO: 24136 - protein, 124 aa, Euglena gracilis
MKGDFGKGKGKGDGKGKGKGKGKGKGKGKGKGKGGKGSAVVVEPHKVHAGIFVSRGKSEDSLATLNLVPGVSVYGEKRVQTETTDANGAPEKKEYRVWNPYRSKLAAAVVGGIDNCKVAPGAKV

SEQ ID NO: 24137 - protein, 281 aa, Euglena gracilis
MKGDFGKGKGKGDGKGKGKGKGKGKGKGKGKGKGGKGSAVVVEPHKVHAGIFVSRGKSEDSLATLNLVPGVSVYGEKRVQTETTDANGAPEKKEYRVWNPYRSKLAAAVVGGIDNCKVAPGAKVLYLGAASGTTVSHVSDIVGPTGIVYAVEFSHRSGRDLVEMSKRRPNIVPIVADARNPKAYRMLVGMVDCIFMDVAQPDQARILAINAKQFLKADGWFMISIKAPCIDSTIEPAVVFAAEVEKMKAEQLRPKEQITLEPFERDHAVVVGVYRPTKAKK

SEQ ID NO: 24138 - protein, 483 aa, Arabidopsis thaliana
MEAMKETVEESLREMRETFASGRTRSLKWRKAQIGAIYEMVKDNEDKICNALFQDLGKLSTEAFRDELGVVLRTATVAINCLDKWAVPKHSKLPLLFYPAKGKVISEPYGTVLVLSSWNFPISLSLDPLIGAIAAGNTVLLKSSELSPNASAFLAKTIPAYLDTKAIKVIEGGPDVATILLQHQWDKIFFTGSPKIGRIIMAAAAQHLTPVTLELGGKCPTIVDHTISKNIKSVVKRIAGGKWGSCNGQACISVDYVLIEKSFAPTLIDMLKPTIKSFFGENPKESGCLSRIANKHHVQRLSRLLSDPRVQASIVYGGSIDEDKLYVEPTILLDPPLDSEIMNEEIFGPILPIITVRDIQESIGIINTKPKPLAIYAFTNDENLKTRILSETSSGSVTFNDVMIQYMCDALPFGGVGESGIGRYHGKYSFDCFSHEKAIMEGSLGMDLEARYPPWNNFKLTFIRLAFREAYFKLILLMLGLKR

SEQ ID NO: 24139 - protein, 508 aa, Arabidopsis thaliana
MGSANNEYEFLSEIGLTSHNLGSYVAGKWQANGPLVSTLNPANNQPIAQVVEASLEDYEQGLKACEEAAKIWMQVTAPKRGDIVRQIGDALRSKLDYLGRLLSLEMGKILAEGIGEVQEVIDMCDFAVGLSRQLNGSVIPSERPNHMMLEMWNPLGIVGVITAFNFPCAVLGWNACIALVCGNCVVWKGAPTTPLITIAMTKLVAEVLEKNNLPGAIFTAMCGGAEIGEAIAKDTRIPLVSFTGSSRVGSMVQQTVNARSGKTLLELSGNNAIIVMDDADIQLAARSVLFAAVGTAGQRCTTCRRLLLHESVYDKVLEQLLTSYKQVKIGNPLEKGTLLGPLHTPESKKNFEKGIEVIKSQGGKILTGGKAVEGEGNFVEPTIIEISADAAVVKEELFAPVLYVLKFKSFGEAVAINNSVPQGLSSSIFTRNPENIFRWIGPLGSDCGIVNVNIPTNGAEIGGAFGGEKATGGGREAGSDSWKQYMRRSTCTINYGNELPLAQGINFG

SEQ ID NO: 24140 - protein, 480 aa, Arabidopsis thaliana
KVFGSAEASNLVTELRRSFDDGVTRGYEWRVTQLKKLMIICDNHEPEIVAALRDDLGKPELESSVYEVSLLRNSIKLALKQLKNWMAPEKAKTSLTTFPASAEIVSEPLGVVLVISAWNYPFLLSIDPVIGAISAGNAVVLKPSELAPASSALLTKLLEQYLDPSAVRVVEGAVTETSALLEQKWDKIFYTGSSKVGRVIMAAAAKHLTPVVLELGGKSPVVVDSDTDLKVTVRRIIVGKWGCNNGQACVSPDYILTTKEYAPKLIDDMKLELEKFYGKNPIESKDMSRIVNSNHLDRLSKLLDEKEVSDKIVYGGEKDRENLKIAPTILLDVPLDSLIMSEEIFGPLLPILTLNNLEESFDVIRSRPKPLAAYLFTHNKKLKERFAATVSAGGIVVNDIAVHLALHTLPFGGVGESGMGAYHGKFSFDASSHKKAVLYRSLFGDSAVRYPPYSRGKLRLLKALVDSNIFDLFKVLLGLA

SEQ ID NO: 24141 - protein, 371 aa, Fusarium oxysporum f. sp. radicis-lycopersici
MVRNIAIAALLPAAFASTLPKRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLSDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNICKYGVDVQQDYLNGGPTGKPTNGVKISGIKFIKVTGTVASSAQDWYILCGDGSCSGFTFSGNAITGGGKTSSCNYPTNTCPS

SEQ ID NO: 24142 - protein, 316 aa, Tulipa gesneriana
MASFPVINLEKLEGGERSKVMEVLHDACANWGFFELLNHGISHELLDKVEKLTKGHYKKCMEERFREFASKTLQDVSKVDVDNLDWESTFYLRHIPTSNMSEIPDLSDEYRETMKEFVLSLEELAEQLLDLLCENLGLEKGYLKKAFSGSKGPTFGTKVSNYPPCPKPELIKGLRAHTDAGGLILLFQDDKVSGLQLLKDGEWVDVPPMHHSIVINLGDQIEVITNGKYKSVLHRVLAHPDGTRMSIASFYNPGSDAVIYPAAALLEEVENQSEVYPKFMFEDYMKLYAVQKFQAKEPRFETMKAMKIANVQPIAT

SEQ ID NO: 24143 - protein, 1033 aa, Rickettsia rickettsii
MKLGFNLDFNELDLTGLKKLDQIFLDYLFKADRSLHKDLMLFRSTPLSIIPKDYSEFLLKISPHLDDFLAELFCISKEITISRLKHKDFDIIYECKRKFVQRVAVKKYPLEKIKDIDFEDVYLKLTDLIGANFTSREFAKQIIIWQQAEESFAEELDIAARYAAYRVYLCESIKPQDNILFNLPQKLDKENLIDDKKILKYQKNERVDFDYTDSFLNLDEALNHSHYCIYCHKQDKDSCSKGLLQPQNRHCEEQSDVAISGDLTRLPRSLQLLAMTDLKQGCPLKQKISEMNYVKAQGFNLSALAIIVIDNPMVAATGHRICNDCSKACIYQKQDPVNIPLIESNILEETLKLPYGLEIYLLLTRWNPLNIYAPLPKEPTNYNILVTGLGPAGFSLSYYLLRSGHNVVAIDGLRITLLPFDVHKPIKFWHEYKNLLSERMPRGFGGVAEYGITVRWDKNNLDILRLILERNNNFKYYDGVALDFNITKEQAFDLGFDYIAFCIGAGQPKVLDIENFEAKGVKTASDFLMTLQNGGAFLKNSSTNMVIRMPIAVIGGGLTSLDAATESLYYYKKQVEEFAEDYIEKDLAEEDKEMAEEFIAHAKLFKEAKNNEELRKVFNKLGGATVYYRGRLQDSPAYKLNHEELIYALALGVDFKENMQPLRINVDKYGHVESVEFENRNRHCEQSKTAWQSHEFGLTRLPRQCYAFPRNDIKTKTVIMAIGIENNTQFDEDKYSYFGDCNPKYSGSVVKALASTKEGYDAINKKLINNNPSFKGSYKDFCTQLDYLLTSRVNKINILDDKTFELIIHSPLAAKNFKFGQFFRLQNYSEDAAKLIEPVALSPIDIDVEKGLISFIVFEVGKSTSLCKTLSENEKVVLMGPTGSPLEIPQNKKIVIVDFEVGNIGLLKVLKENNNEVIFVTYPDIKIRKLVSVDIVIINASPEIIEELQSLKNEIFSENTKIIVSVNSSMQCMMKGICGQCIQKVKGEQKYIFACSQQNQNAEIVDFKSLKTRLRQNSLQEKMRKLVANSSII

SEQ ID NO: 24144 - protein, 431 aa, Rickettsia rickettsii
MTNTKSKIKTPRSPYVKKYNSWRVRILYSIIIGYATFYFCRQNFNIATPAIREYFGVTKTQIGWILTASSIMYGVSKACNGFISDKVNARIFMVLGLLFVGIITMLIGFSDSLWLIGILWIASNWFQSMGWPPATKMLTHWFASKELGTKWAMGATSNQIGGALAMISCGYLIDKFDWRAAFFVPGVVACVVSLFLYNRLRNSPKEVGLSTVEEYKEYPLEAIGDYEKLLTPQLFKMVFCNKLIWYVCLANMFVYIIRSGVIYWAPTFLKDLRNISLANAGLQIGLYEMIGIPGALIAGVLSDKLFQGRRGPVASICMVLLSLLLVLFWKLPIHSELLSIVILSLIGFFVSGPQLLVGIAAADFSTRQAVGTANGLSGLFGYLGAAIAGVGVGWISDNYGWNGVFIFFSISALLGGGLFALIWNRSAKKYI

SEQ ID NO: 24145 - protein, 251 aa, Rickettsia rickettsii
MSVEEFKIKIRSLYKSFANHKVLDGIDLDVKKGSSLVILGGSGSGKSVLIKNIVGLIKPDKGKIFIDNVEIQDISSKQKFEMMDGIGFLFQGGALFDSLNIRDNITFETKNLSKKEKNDLAGAKLNAVGLSPRILELYPAELSGGMQKRVALARAICSTPSILFLDEPTTGLDPIMANVINELIIKIQEELEATTITITHDMISAAKIAKEVAMIYQGKIKWYGSKDDMRNSDNPYLKQFINGLTTGPIEV

SEQ ID NO: 24146 - protein, 475 aa, Rickettsia rickettsii
MNLLKNITGKNYINGEFIEFGKQISVINPATLKEIATVPNLGLSEINSAINNTVTSFALWSQSSFEARIAILRRWYNLVIENIEELSHILTLEQGKVLAESKKEILYGASFIDWYTYAIHNIHSTIKPGNSNTHKIVTQYEPVGPSAAITPWNFPNAMIARKVVPAIAAGCSVILKPSSLTPLSALVLAKFASDAGLPSGVFNVITGSSDIIGKAFCEDFRLRKLSFTGATNVGKILYQNAANTLKRLSLELGGNAPFIITADNNLEKVVSDLVIAKTRNSGQSCTSPNRIFIEESIYEKFIEILKAKFTKLKAGDGFDKESDVGPLINSAAIEKIQKLLADAQSKGAKLICGGKTVDNFIEPTIIIDCLDNMDIFRIEIFGPVVACYKFKDLDEVIEHANNTEYGLQGYVYSNNISVAQMIASKLDFGMVSINDPLPANAKAPFAGRKASGFGVEGSFEGIFEYLNTKYINLQN

SEQ ID NO: 24147 - protein, 212 aa, Rickettsia rickettsii
MIVIFLGPPGAGKGTQGKKIAKKIDLPHIAIGDIFRTIIKTSTSEAELINNYVRQGELIPNEIVNQVIKNFLLSFEYKNGYILDGYPRNLEQAQFFESFIKEKIKIIYFDVSGELLIKRILGRYSCKNCGKIYNRYFLQPKTDNVCDVCGSSTFDYRKDDNEEVIKKRIEVYKTETYPLIDYYKNSGNFYIVNGSKNEQEIAMDIQKILKIN

SEQ ID NO: 24148 - protein, 458 aa, Rhodococcus rhodochrous
LQIVHQATADDVDEAVAAGRVAAADPAWRRMLPHERARYLHRIADAIEHEASRLALLQSYNTGKTLTETTALVGSAAGTFRYFAAVLETSDDDLTTQRGNYLTMSIHEPIGVIGAIAPWNSPIASDAQKIAPALAAGNAVVLKPAEWTPLVSMALARAIHDSGLPPGLLSVLPGKGSIVGDAIVQHPHVGKVTFTGGTRTGRAVAHAGAEKLMPVSLELGGKSPTIVLDDADIEAAVAGVMYGIFSSTGQSCIAGSRLFVDRSLYEAFMERLVERTRALRIGNGRDPRTQVGPLVHHTHRASVARYVDLARCEGGRVLCGGTAPDDPELADGAYYLPTVIDGLSNDAAVCQDEIFGPVLIALPFDGESDLLAQANDSVFGLASGIWTRDYRRAWRLARQLEAGTVWVNTYKRFSISTPFGGIKESGLGTEKGRAGIAAYSRQKSIYLGLDDEPDRWVD

SEQ ID NO: 24149 - protein, 172 aa, Pyrus pyrifolia
MKKASEPPVVGRVIGDVLDSFTATTKMSVTYNTKLVCNGLELFPSVVTAKPRVEIQGGDMRSFFTLVMTDPDFPGPSDPYLREHLHWIVTDIPGTTDATFGREVVSYEMPKPNIGIHRFVFVLFKQNRRQSINTPSSRDHFSTRSFAAENDLGLPVAAVYFNAQRETAARRR

SEQ ID NO: 24150 - protein, 172 aa, Pyrus communis
MKRASEPLVVGRVIGDVLDSFTATTKMSVTYNTKLVCNGLELFPSVVTAKPRVEIQGGDMRSFFTLVMTDPDFPGPSDPYLREHLHWIVTDIPGTTDATFGREVVSYEMPKPNIGIHRFVFVLFKQNRRQSINTPSSRDHFSTRSFAAENDLGLPVAAVYFNAQRETAARRR

SEQ ID NO: 24151 - protein, 172 aa, Cydonia oblonga
MKKASEPLVVGRVIGDVLDSFTATTKMSVTYNTKLVCNGLELFPSVVTAKPRVEIQGGDMRSFFTLVMTDPDFPGPSDPYLREHLHWIVTDIPGTTDATFGREVLSYEMPRPNIGIHRFVFVLFKQNRRQSINTPSSRDHFSTRSFAAENDLGLPVAAVYFNAQRETAARRR

SEQ ID NO: 24152 - protein, 172 aa, Pseudocydonia sinensis
MKRASEPLVVGRVIGDVLDSFTATTKMSVTYNTKLVCNGLELFPSVVTAKPKVEIQGGDMRSFFTLVMTDPDFPGPSDPYLREHLHWIVADIPGTTDATFGREVVSYEMPRPNIGIHRFVFVLFKQNRRQSINTPSSRDHFSTRSFAAENDLGLPVAAVYFNAQRETAARRR

SEQ ID NO: 24153 - protein, 172 aa, Eriobotrya japonica
MTRALEPLVVGRVIGDVLDSFTATTKMSVTYNTKLVCNGLELFPSVVTAKPRVEIQGGDMRSFFTLVMTDPDFPGPSDPYLREHLHWIVTDIPGTTDATFGREVVSYEMPRPNIGIHRFVFVLFKQNRRQSINTPSSRDHFSTRSFAAENDLGLPVAAVYFNAQRETAARRR

SEQ ID NO: 24154 - protein, 172 aa, Pyrus communis
MARVPEPLVVGRVIGDVLDSFTPTTHMSVTYNTKLVCNGLELFPSVVTAKPRVEIQGGELRSFFTLVMTDPDCPGPSDPYLREHLHWIVTDIPGTTDAAFGREALSYEMPRPNIGIHRFVFVLFKQKRRQSINPPSSRDCFSTRSFAAENDLGLPVAAVYFNAQREGAARRR

SEQ ID NO: 24155 - protein, 172 aa, Cydonia oblonga
MARFPEPLVVGRVIGDVLDSFTPTTHMSVTYNTKLVCNGLELFPSVVTAKPRVEIQGGELRSFFTLVMTDPDCPGPSDPYLREHLHWIVTDIPGTTDAAFGREVLSYEMPRPNIGIHRFVFVLFKQKRRQSINPPSSRDCFSTRSFAAENDLGLPVAAVYFNAQRENAARRR

SEQ ID NO: 24156 - protein, 172 aa, Pseudocydonia sinensis
MARVPEPLVVGRVIGDVLDSFTPTTHMSVTYNTKLVCNGLELFPSVVTAKPRVEIQGGELRSFFTLVMTDPDCPGPSDPYLREHLHWIVTDIPGTTDAAFGREVLSYEMPRPNIGIHRFVFVLFKQKRRQSINPPSSRDCFSTRSFAAENDLGLPVAALYFNAQRENAARRR

SEQ ID NO: 24157 - protein, 172 aa, Eriobotrya japonica
MARIPEPLVVGRVIGDVLDSFTPTTHMSVTYNAKLVCNGLELFPSVVTAKPRVEIQGGELRSFFTLVMIDPDCPGPSDPYLREHLHWIVTDIPGTADAAFGREALSYEMPRPNIGIHRFVFVLFKQKRRQSINPPSSRDCFSTRSFAAENDLGLPVAAVYFNAQRETAARRR

SEQ ID NO: 24158 - protein, 476 aa, Humicola grisea var. thermoidea
MSLPPDFKWGFATAAYQIEGSVNEDGRGPSIWDTFCAIPGKIADGSSGAVACDSYKRTKEDIALLKELGANSYRFSISWSRIIPLGGRNDPINQKGIDHYVKFVDDLIEAGITPFITLFHWDLPDALDKRYGGFLNKEEFAADFENYARIMFKAIPKCKHWITFNEPWCSAILGYNTGYFAPGHTSDRSKSPVGDSAREPWIVGHNILIAHARAVKAYREDFKPTQGGEIGITLNGDATLPWDPEDPADIEACDRKIEFAISWFADPIYFGKYPDSMRKQLGDRLPEFTPEEVALVKGSNDFYGMNHYTANYIKHKTGVPPEDDFLGNLETLFYNKYGDCIGPETQSFWLRPHAQGFRDLLNWLSKRYGYPKIYVTENGTSLKGENDMPLEQVLEDDFRVKYFNDYVRAMAAAVAEDGCNVRGYLAWSLLDNFEWAEGYETRFGVTYVDYANDQKRYPKKSAKSLKPLFDSLIRKE

SEQ ID NO: 24159 - protein, 466 aa, Hypocrea jecorina
MLPKDFQWGFATAAYQIEGAVDQDGRGPSIWDTFCAQPGKIADGSSGVTACDSYNRTAEDIALLKSLGAKSYRFSISWSRIIPEGGRGDAVNQAGIDHYVKFVDDLLDAGITPFITLFHWDLPEGLHQRYGGLLNRTEFPLDFENYARVMFRALPKVRNWITFNEPLCSAIPGYGSGTFAPGRQSTSEPWTVGHNILVAHGRAVKAYRDDFKPASGDGQIGIVLNGDFTYPWDAADPADKEAAERRLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWISKRYGYPPIYVTENGTSIKGESDLPKEKILEDDFRVKYYNEYIRAMVTAVELDGVNVKGYFAWSLMDNFEWADGYVTRFGVTYVDYENGQKRFPKKSAKSLKPLFDELIAAA

SEQ ID NO: 24160 - protein, 485 aa, Helianthus annuus
MSPQTETKASVGFKAGVKDYKLTYYTPEYETKDTDILAAFRVTPQPGVPPEEAGAAVAAESSTGTWTTVWTDGLTSLDRYKGRCYGLEPVPGEDNQFIAYVAYPLDLFEEGSVTNMFTSIVGNVFGFKALRALRLEDLRIPTAYVKTFDGPPHGIQVERDKLNKYGRPLLGCTIKPKLGLSAKNYGRACYECLRGGLDFTKDDENVNSQPFMRWRDRFLFCAEAIYKAQAETGEIKGHYLNATAGNCEDMMKRAVFARELGVPIVMHDYLTGGFTANTSLSQYCRDNGLLLHIHRAMHAVIDRQKNHGMHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLDTDKDKDKKR

SEQ ID NO: 24161 - protein, 475 aa, Brothera leana
MSPQTETKAGVGFKAGVKDYRLNYYTPDYETSETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEALYKSQAETGEIKGHYLNATAGTCEEMLKRAEFARELGVPIIMHDYLTGGFTANTTLAHYCRDNGLLLHIHRAMHAVIDRQKNHGMHFRVLAKALRLSGGDHVHSGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREAAKWSPELAAACEVWKEIKFEFETIDTV

SEQ ID NO: 24162 - protein, 475 aa, Dicranodontium denudatum
MSPQTETKAGVGFKAGVKDYRLNYYTPDYETSETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEAIYKSQAETGEIKGHYLNATAGTCEEMLKRAEFARELGVPIIMHDYLTGGFTANTSLAHYCRDNGLLLHIHRAMHAVIDRQKIHGMHFRVLAKALRLSGGDHVHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNDIIREAAKWSPELSAACEVWKEIKFEFETIDTV

SEQ ID NO: 24163 - protein, 475 aa, Leucobryum aduncum
MSPQTETKAGVGFKAGVKDYRLNYYTPDYQTLETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPSYTKTFQGPPHGIQVERDKLNKYGRPLLGCTIKPKLGLSARNYGRAVYECLRGGLDFTKDDENVNSQPFMRWRDRFVFVAEALYKSQAETGEIKGHYLNATAGTCEEMLKRAEFARELGVPIIMHDYLTGGFTANTSLAHYCRDNGLLLHIHRAMHAVLDRQKNHGMHFRVLAKALRLSGGDHVHSGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVSLEACVQARNEGRDLAREGNDIIREAAKWSPELSAACEVWKEIKFEFETIDTV

SEQ ID NO: 24164 - protein, 475 aa, Leucobryum albidum
MSPQTETKAGVGFKAGVKDYRLNYYTPDYQTLETDILAAFRMTPQPGVPPEEAGAAVAAESSTGTWTTVWTDGLTSLDRYKGRCYDIEAVPGEENQYIAYVAYPLDSFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEAIYKSQAETGEIKGHYLNATAGTCEEMLKRAHFARELGVPIVMHDYLTGGFTANTTLAHYCRDNGLLLHIHRAMHAVIDRQKIHGMHFRVLAKALRLSGGDHVHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELSAACEVWKEIKFEFETIDTV

SEQ ID NO: 24165 - protein, 475 aa, Leucobryum juniperoideum
MSPQTETKAGVGFKAGVKDYRLNYYTPDYQTLETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEAIYKSQAETGEIKGHYLNATAGTCEEMLKRAHFARELGVPIVMHDYLTGGFTANTTLAHYCRDNGLLLHIHRAMHAVIDRQKNHGMHFRVLAKALRLSGGDHVHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELSAACEVWKEIKFEFETIDTV

SEQ ID NO: 24166 - protein, 475 aa, Leucobryum glaucum
MSPQTETKAGVGFKAGVKDYRLNYYTPDYQTLETDILAAFRMTPQPGVPPEEAGAAVAAESSTGTWTTVWTDGLTSLDRYKGRCYDIEAVPGEENQYIAYVAYPLDSFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEAIYKSQAETGEIKGHYLNATAGTCEEMLKRAHFARELGVPIVMHDYLTGGFTANTTLAHYCRDNGLLLHIHRAMHAVIDRQKNHGMHFRVLAKALRLSGGDHVHSGTVVGKLEGERQVTLGFVDLLRDDYIEKDRSRGIYFTQDWVSLPGVLPVASGGIHVWHMPALTEIFGDDSVLQSGGGTLGHPWGNAPGAVANRVALEACVQARNEGRDLAREGNEIIREAAKWSPELSAACEVWKEIKFEFETIDTV

SEQ ID NO: 24167 - protein, 475 aa, Leucobryum humillimum
MSPQTETKAGVGFKAGVKDYRLNYYTPDYQTLETDILAAFRMTPQPGVPPEEAGAAVAAESSTGTWTTVWTDGLTSLDRYKGRCYDIEAVPGEENQYIAYVAYPLDSFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEAIYKSQAETGEIKGHYLNATAGTCEEMLKRAHFARELGVPIVMHDYLTGGFTANTTLAHYCRDNGLLLHIHRAMHAVIDRQKNHGMHFRVLAKALRLSGGDHVHSGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELSAACEVWKEIKFEFETIDTV

SEQ ID NO: 24168 - protein, 475 aa, Leucobryum chlorophyllosum
MSPQTETKAGVGFKAGVKDYRLNYYTPDYQTLETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEALYKSQAETGEIKGHYLNATAGTCEEMLKRAEFARELGVPIVMHDYLTGGFTANTTLAHYCRDNGLLLHIHRAMHAVIDRQKNHGMHFRVLAKALRLSGGDHVHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELSAACEVWKEIKFEFETIDTV

SEQ ID NO: 24169 - protein, 475 aa, Leucobryum scabrum
MSPQTETKAGVGFKAGVKDYRLNYYTPDYQTLETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEALYKSQAETGEIKGHYLNATAGTCEEMLKRAEFARELGVPIVMHDYLTGGFTANTTLAHYCRDNGLLLHIHRAMHAVIDRQKNHGMHFRVLAKALRLSGGDHVHSGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELSAACEVWKEIKFEFETIDTV

SEQ ID NO: 24170 - protein, 444 aa, Lactobacillus johnsonii NCC 533
MKKYDYIILGTGPAAYKLVKLLDTQHKSILTIESGLFGGTCPNVGCEPKIYLDGAVQAVLSNQQFEKEGIISQGGKLNWAQLMKDKKARFASWPNETRKNISKISDVISGSAHFVDRQTIEVNRQYFQGNRIIIATGRRPHELSIPGAKFLHDSSDVLSLGTLPEHTTFIGGGYVAMELATFLAAAGSQVTILVRGDRVLRHFYQKYSRELVVRMKQRGIQFEFETEPTRITQLSDKYVVELNQDGPIVTDYVVNASGRMPNIEKLDLSAAQIDYSTRGIDVDRHLQTNVKNIYAIGDVTSQDVPNLTPVAEFQAQYLFNSLEKGLTQPINYPAIGTGVFAFPQLAQAGINPDSVLEDGDNFEIREYELSQSSLYAGQKEKGLLTVVYDKANYIVGVSEISMSAVNDINYFVPIIGLRINKNEWHRNVLPIYPALADKIEGILR

SEQ ID NO: 24171 - protein, 384 aa, Lactobacillus johnsonii NCC 533
MSLWETKFAKKGLTFDDVLLIPAESHVLPNEVKLDTKLAPNLQLHIPLISAGMDTVTEGNMAIAMAENGGLGVIHKNLSIEVQVEEVKKAKGKTVDPNLPHPAVDDQGRLLAAAAVGVTSDTFERAESLLEAGADAIVIDTAHGHSAGVLRKIKEIREHFPNATLIAGNVATGEGTAALFDAGVDVVKVGIGPGSICTTRIVAGVGVPQITAIYDAASVAQKYGKKIIADGGIKYSGDVVKALAAGGNAVMLGSMFSGTTEAPGTIFTNEGKQFKSYRGMGAVGAMSQQHGSSDRYFQGGVNEANKLVPEGVEALVPYKGDVSNIIYQIDGGLRAGMGYVGAGTIKELIENSQFVQITNAGLRESHPHDVQMAKEAPNYGGSDL

SEQ ID NO: 24172 - protein, 337 aa, Lactobacillus johnsonii NCC 533
MTKIFAYAIRKDEEPFLNEWKDAHKDIEVEYTDKLLAPETAKLAKGADGVVVYQQLDYTPETLQALADAGVTKMSLRNVGVDNIDMDKAKELGFEITNVPVYSPDAIAEHAAIQAARVLRQDKRMDEKMAKRDLRWAPTIGREVRDQVVGVVGTGHIGQVFMKIMEGFGAKVIAYDIFKNPELEKKGYYVDSLDDLYKQADVISLHVPDVPANVHMINDESIAKMKDGVVIVNCSRGPLVDTDAVIRGLDSGKIFGFVMDTYEGEVGVFNEDWEGKEFPDARLADLIDRPNVLVTPHTAFYTTHAVRNMVTKAFDNNLKMINGEKPDSPVALDKNKF

SEQ ID NO: 24173 - protein, 252 aa, Lactobacillus johnsonii NCC 533
MNNNNEENILQVQHLQKKYGDHTVLKDISFNINKGEVMTIIGPSGGGKSTMLRCINLLEEPSNGKILFHGENILDPHFNRNTFRSKVGMVFQQFNLFNNKNVLQNCMIGQEMVLGRSKEEAKKVAIENLQKVGMDPFLTAKPQQLSGGQQQRVAIARAISMDPEVLLFDEPTSALDPEMVGEVLNTMQLLAKTGLTMVIVTHEMGFARDVSDQVVFMSDGVITEQGTPQQIFNDPQEEKTKKFLRNFRNNEL

SEQ ID NO: 24174 - protein, 451 aa, Lactobacillus johnsonii NCC 533
MDEKEKLKLKRSLKSRHVTMIAIGGAIGTGLFLGSGTAIQSAGPSIILSYLIVGIISFFMMRALGELILADPEQHSFIESVKKYLGNRMEFVAGWTYWLCWLSLAMADLTATGIYLKYWFKNLPQWVGPLVIVILLMLVNMVNVGLFGELESWFSMIKVLAILALIITGLILLIMHTKIDSRTVSLSNLVNYGGFFPTGSWGFLKSFQMVVFAFVGIEIVGLTAGETANPDKDIPKAINTLPVRIGLFYVGSMIAIMAVYPWNKIVTTTSPFVQVFGAIGIPAAAGILNFVVLTAAMSATNSAIFSTSRSLYALSRGNNAPKRFGKLSKKAVPNNALTFSSLILFIVVILNYIMPAQVFDIISSVSTINFIMVWIIIMWTHLKYRAENKEQLGKFRMPGFPITSWITIIFYLVILVILALIPATRLPLIISIIFILALALSYTLLERRKSK

SEQ ID NO: 24175 - protein, 230 aa, Lactobacillus johnsonii NCC 533
MSKLVLIRHGQSEWNLSNQFTGWVDVNLSEKGVEEAKKAGRLIKEHGLEFDQAYTSLLTRAIKTLHYALEESDQLWIPETKTWRLNERHYGALQGLNKKDTAEKYGDEQVHIWRRSYDVLPPAIDDDNEYSQAHDRRYANLDPHIVPKAENLHVTLDRVMPFWEDHIAPDLLDGKNVIIAAHGNSLRALTKYIENISDDDIMDLEMKTGEPVVYTFDDKLDVVNKEKLDD

SEQ ID NO: 24176 - protein, 482 aa, Lactobacillus johnsonii NCC 533
MTGYTMPKGFLWGGAVAAHQLEGAWDEDGKGMSVADVMTVGSATKPREITDGVIPGKNYPNHEAIDFYHHYKGDIKLMAEMGFKAFRTSIAWTRIFPKGDEEEPNEAGLKFYDDLFDECHKYGIEPVITLSHFEIPYHLVKEYGGFTNRKLIDYFVRFARVCFKRYKNKVKYWMTFNEIDNQSSFNNDFLMATNSGILFKNGMGDKEKEAAMYQAAHYELVASALAVKEGHKINPDFQIGCMINYSPVRPLTPSSDDVLLADKFEQRRDFFSDVHVNGEYPNAVEDYIERNGYRPDITEEDKIALKEGTVDYVGFSYYQSTTVSSKKVKPDELTDLQEAIVENPTLERSDWGWEIDPEGLRISLNHLTDRYHKPLFIVENGLGAYDKREADGSVHDPYRIDYLRKHIEQMEKAVVLDGVDLMGYLPWGCIDLVSAGTGQMDKRYGFIYVDKNDKGDGTLERSKKDSFNWYKKVIESNGKDLD

SEQ ID NO: 24177 - protein, 497 aa, Lactobacillus johnsonii NCC 533
MTKNYSMPKDFYWGGASAANQYEGGYKDGGKGLNAVDVLTNGSANEPRKVTWKTADGKTGSTPMVWGKEFKLPEGAKPAPLADYYYPSHEGTDFYHHYKEDIKYMADMGFNMFRLSLNWSRILPNGDDKEPNKEGLAFYDKVFDECAKYGIEPLVTLSHYETPLSLVNRFGGWKDRKMIDIFVHYADIVMNHYKGKVKYWLTFNEINAMDMAPYMGGGLIDGSEQNRAQGAHNQFVASSKVVKLAHEIDQNNQVGQMLAYSAYYPYTADPADQILVMKAKQEMLFYSDVQTGGRYPEYRLKQYERDGIKLDDKPEDYELIENYPADFLSFSCYTSNVLTTHEADAKANGNVSAGGVKNPYLDYNAWGWATDPDVLRIALNDLWDRYHKPLFIVENGLGWGDELTEDHKVHDDYRIDYLRAQIKSMEEAVNEDGIPLMGYTMWSAIDLVSNGTGEMKKRYGFVYVDRDDKGNGSLKRYPKDSFNWYKKVIVSHGKDLD

SEQ ID NO: 24178 - protein, 459 aa, Lactobacillus johnsonii NCC 533
MNKHKMPKDFFWGNSVSSMQTEGAWDEDGKGLSVYDVRPATENTTDWHTAIDEYHRYDEDLDLMKEMNMNMYRIQISWSRVCPEGDGDFNPKGIEFYDKLVDAMLDRGIEPMICLYHFDMPLHLAKEYNGFMSRHVVDAFVRFGKKMIDHFSDRVKYWIVFNEHNLYFQDEVFNISGYEKGDKTLDDMYTIFHHTMISHIRLANYIHEKYDDVKIGGMLAFQQIYPETSKSTDVWAAKQIQEFLNFNIYDADTGRGYSPEVLQYAKNHNINLDITKEDKEEMKKAKADFLAFSYYSSWTVSADKIPADVAPNRYMNYGGVENKYLKTNAWGWTIDPLGFRNAITTMYNHYKIPVFPIENGIGLKETWDSEHMIEDDERIAYHEEHIKAMKDAMFLDGAKVLGYLGWGLIDIPSSHADMEKRYGAVYVNRSNHDLKDLKRVPKKSFYWFQKVLKDNGDEI

SEQ ID NO: 24179 - protein, 332 aa, Lactobacillus johnsonii NCC 533
MKAAQLIKYDKKDPLIEIRDINSQPLGAHDLLIRTKTAAVNPLDNLISHGDLKLVVPYKLPQTMGNEFVGIIEKIDPKVTNFKIGDRIFARNPVDNIGAFAQKIVINEKAVAKVPEYLSDQEAAAVPLTALTAMQAFQLLNLKAGQTLFISGGSGSFGAMAIPLAIAQGYKVITTGNETSRAGLEKLGVEKFLNYKTEDYTKAVANVDAIIDTIGGEETVKQLSILKDGGEIVSLKGMPNREFAKKMNMGLAKELLFNVAARKIEKEAKKRNQNYHFIFVQANGQQLKEAAKILEKNQIHPLIGNQYSLTEVNAALADVAQRKSLGKVIINF

SEQ ID NO: 24180 - protein, 217 aa, Lactobacillus johnsonii NCC 533
MINLILLGLPGAGKGTASESIVDKYHLAHISTGDMFREAMANETPVGLEAKSYIDKGNLVPDEVTAKLVEERLKQPDTKNGFILDGFPRTTVQAELLEDITKRLEKPLTNVIAIDVDEDVLIKRLSARYICKKCGATYNKISNPTKVEGTCDRCGGHEFFQREDDKPEVVKNRLEVNKKMNTPLRDFYEEKGILSTVNGEQTPEKVFEDIDKILSKD

SEQ ID NO: 24181 - protein, 229 aa, Lactobacillus johnsonii NCC 533
MKRKLAKLVLVRHGESVANRDNVYTGWNDVPLSKKGIAQAKNAGLKVEKIAEFAPTHIHTSVLSRAIMTANIIADVCSFLYLPITKTWRLNERHYGALRGINKDVSKKIFGTNQVLEWRRGFDSVPPLLTQPVQDRRYQKYDMRLMPQGESLHQTQERLMPYFWDHIAPELMAGHDQLVVAHGSSLRALIKKIEDISNEDIVKVEVPNAEPIVYTFDTDLHIVKKEILH

SEQ ID NO: 24182 - protein, 459 aa, Lactobacillus johnsonii NCC 533
MAKVKTRYKCRNCGYISASYLGRCPNCGAWNQFEEETQEIKKVSTKATASRLMTKIGNNDPVKLTEVKAEKEKRIVTPFEELNRVLGGGIVPGSLVLIGGDPGIGKSTLMLQITGALAKEHSVLYVSGEESASQIKMRADRLGVSNSGILLYPETNMQNIRDQIDEIKPDFLVIDSIQTMNEPSLDSMVGSASQVREVTSELMKIAKNEQITTFVIGHVTKEGAIAGPKIMEHMVDTVLYFEGDGHHSYRILRSVKNRFGAANEIGMFEMKNEGLAEVSNPSAIFLDERLPNSTGSSVVVSLEGTRPLLADIQALVTPTAFGYAKRTTSGLDFNRVALLLAVLEKRGNLMLQNQDAFLTATGGIKLNEPAIDLAICMAVASSYKNKEISSTDCFVGEVGLTGEIRRVNQIEARVKEAAKVGFKRIFIPKNNLNQELKNNSEIEVIGVASLPQALKLVFN

SEQ ID NO: 24183 - protein, 215 aa, Lactobacillus johnsonii NCC 533
MSGNKVLELKNISKSFGTRKIIDKLNLSLDQGDILSIIGPSGAGKTTLLRLIAGLESADSGKFLHNGKEFDPTDRNNHLVGMVFQDYNLFPNLSVMDNITLAPIMVNKMSKAEAEKAAAPVLDQLDLDKFKTLYPYQLSGGQKQRVAIARALQMKPEILCYDEPTSALDPELVGKVKDIFLKLKQTGMTQVIITHDHQFGKAVADKILKVEPIEK

SEQ ID NO: 24184 - protein, 330 aa, Lactobacillus johnsonii NCC 533
MSNYFSMEAFDYDDIQLVPNKCIIKSRSEADTGVKFGSRTFKIPVVPANMESVIDEDLAIWLAEHGYYYVMHRFYPEKRADFIKMMHDKGLFASISVGIKDSEYDFIDYLAKENIIPEYTTIDVAHGHSDYVIKMIKYIKEKLPDTFLTAGNIATPEAVRELENAGADATKVGVGPGRACITKLKTGFGTGGWQLAALRMCSKAARKPLIADGGIRHNGDIAKSVRFGASMVMIGSLFAGHEESPGNLITIDGKRYKQYWGSASEVQKGAYRNVEGKQMLVPYRGSIKDTLREMQEDLQSSISYAGGKDLSAIRVVDYVIVKSSIFDGDK

SEQ ID NO: 24185 - protein, 281 aa, Lactobacillus johnsonii NCC 533
MKSISKELISTVIKKRKSATHKGNYGRLLLIGGSKKYGGALIMAAEGALNSGAGLVTVATDRVNIAALHTRDPEIMTLNWDESIELKNLIKNSDVVVCGMGLGLDDKAQQILRLVRDNITLKQTLILDASALDLIGQQTDLLPLNSKILIFTPHQMEWERLSGIKISDQSDELNQVALDKLVKNKNAILVLKSNHTKVYDQAGHIYLNPFGNPGMAIGGMGDTLAGIIGGFCGQFIPNLETVAAAVGIHSLTADKIAERQYIVRPTQLSAHLPEIMKQYEK

SEQ ID NO: 24186 - protein, 178 aa, Lactobacillus johnsonii NCC 533
MNNDIESVLYTQNDLNNRMDEMAAELNKKYKNEEPIIVPVLNGAMIFASDMIKRLSFKLTIDPIKASSYEGSHSTGKVKITQDIKSDVKNRPVIFMEDIIDTGRTLQALSEIMKERGAKSVEVVSMLDKPETRVVDFHVDYYGFKAPDEFLVGYGLDYNGLYRNLPYVGILKHEVYAS

SEQ ID NO: 24187 - protein, 250 aa, Lactobacillus johnsonii NCC 533
MEHSWMLKYFAEFFGTLIMVMFGNGAVANSFLKGTTGNAHDGKANGGWILIAFSFGFGVMLPAMLFGSISGNHLNPAVTLAQATAGVFPWAQVTPYIISQVLGAICGQLLIITIYWPYIKKSTDSNIVFACFATSDCVNSKWNGFISELVGTGVLMFVAIGLYKGMFFKQAVDIANIGVGFLITALVMALGGPTGPALNPARDFGPRLVYSILPIPNKKDAHWSYGWVPVVAPILGAIIGIFLYKIPFGL

SEQ ID NO: 24188 - protein, 146 aa, Lactobacillus johnsonii NCC 533
MKGVGEEIHSKDLPATDWDWIIYSQGMYDQLKRVYDDYPLVHSIYITENGMGYKDKFESEDKIIDDTPRIDYLRQHMEEVAKAIEAVILVNGYFVWSPQDMFSWTKGYSKRYGLFYVDFKTQECYAKKSAYWYKKLAEIREIPPVD

SEQ ID NO: 24189 - protein, 306 aa, Lactobacillus johnsonii NCC 533
MIQLEKLVKKNLPKEKEGKVASYIPALAEVNPKQLGIALYDLEDGEVGEAGQSEVRFAIESISKVITLMLAIKKMGIQEVFKHVGSRQTGFAFNSILNMEIERAKYPLNPFINAGAIATTSMVVSKTGDDAFEEILDFARDICNDPDLYLDQIIYHSERRTGNLDRSLAYYMESKNMMLGDVVTSLDTYFKQCSMMVTARSLANLGAVLANGGVKPWDNKRIIPDEEARCIKSLMMTTGLYNQSGTYSRLIGVPTKSGVGGGLMSAAPHKYGIGIFSPALDKDGNSIAGLDLLRDIVDGLELDIFD

SEQ ID NO: 24190 - protein, 497 aa, Lactobacillus johnsonii NCC 533
MYHKQLDEFPTDFLWGASSAAYQIEGGAKEDGKGLSIWDKYAHQAGNTFKGTNGDVAVDHYHRYKEDVELMAKQGLKAYRFSVSWSRILPAGEGKVNQAGINFYRDLINELRKNKIEPILTIYHWDLPLALQEKYGGWESRKTIEAFVNYAKILFSEFGEKVKYWITINEQNVFTSMGYRWGTHPPKKQNIKTMFQANHYINLANALAITEFHKMVPAGKIGPSFGYGPVYPKTNSPEDVLAALNADDFNNNWWLDVYCRGKYPFFIRKQLENLNLMLEITKKDKAILENDAAHPDFLGINYYHGGTVQENRLQKPATNDKEKQFNKVDPYLMQPKGDQAKNPEVPMFNGVENDYVNKTNWGWEIDPTGLRIALRQVYEKYQLPIMITENGLGAKDIVENGKINDQYRIDYLADHVLAMKEAISDGVDLIGYCAWSFTDLLSWLNGYSKRYGFVYIDQNDEQKGTLKRIPKKSYTWYKSIIATNGNDLSLLKHGEQK

SEQ ID NO: 24191 - protein, 412 aa, Lactobacillus johnsonii NCC 533
MDTLVKHRHTLSKNQKWVIASTSSGFALENMDVLFLSFAMSSMIADLHLSGGEAGFISTITNLGMLVGGIAFGILGDKIGRVKTFSHTVIIFAIATALMAFTNNIYLIYALRFLAGIGAGGEYGVGIALIAENFHKEQIGKMTSVAAIGGQIGAILAALIAAWIIPAAGWHMLFLIGILPVILTIFIRKHVHESEQFIKAQASESNSLLSDVAKKMFSTPHLAWQTVGLMIMMTVQIAGYFGLMNWLPTIVQKQLNLNVSNSSLWMISTIIGMSIGMMTFGSIFDYFGPRRAFAIFLIGSALMVYTLSLAQNMAMLLIIGAVVGFFSNGMFGGYGAVISRLYPTEIRSSANNIIVNVGRAIGGFSSVVIGILMDKYNLGVVMGFLSALYLLSFVVMITLPGLKTLTKEAKRN

SEQ ID NO: 24192 - protein, 249 aa, Lactobacillus johnsonii NCC 533
MAAIIDFKHVNKYYGKFHALKDINLSIEEGQVVSIIGPSGSGKSTLIRTMNGLERINSGTLMVTGYDLADKHTDLNKIRKNVGMVFQHFNLYDNHTVLENITLAPKIVLHRPDKENNDIAMDLLKKVGLEEKANMYPRQLSGGQKQRVAIARSLAMRPKAILFDEPTSALDPEMIQDVLDVMKYVADQGITMVVVTHEMGFAREVGDRLIFFDQGRILEDEKPEEFFAHPKTERARQFLSKVITEKLGG

SEQ ID NO: 24193 - protein, 243 aa, Lactobacillus johnsonii NCC 533
MTMIKVEHLKKSFGKKEVLKDISANVEKGKVISIIGPSGSGKSTFLRCLNVLETPTSGKIIFDGQDLTHISEKELDILREKMGMVFQSFNLFPNMNVVENVKLAPMKVKGVSEEEAEKQALELLDKVGLKDRAKQYPSSLSGGQQQRVAIARALAMDPEVMLFDEPTSALDPEMVGEVLKTMQDLADSGMTMVIVTHEMGFAREVSDEVWFMADGYLQEQGSPEQIFENPQTPRAKDFLSKVL

SEQ ID NO: 24194 - protein, 189 aa, Lactobacillus johnsonii NCC 533
MQNSDNIDNIIDRVLFSQDDIEEICQRLGKQLTEDYAGKFPLVIGVLKGAVYFMTDLTRHMNVKMQNDFMDVSSYGDGFESTGKVRLDIDVQADVKGRDVLLVEDIVDTGHTLKFMKDLLIERGAKSVKCCALLNKTERREDDVVVDYYGSKVENEFVVGYGLDYLNAYRNLPYVGVLKPEVIQANLNR

SEQ ID NO: 24195 - protein, 403 aa, Lactobacillus johnsonii NCC 533
MAKLIVSDLDLKGKKVLVRVDFNVPIKNGVIGDDNRIVAALPTIKYIIDHGGKAILLSHLGRVKSDADKKELSLRPVAERLSELLEKPVTFVPENEGKEVEEAIDNMKDGDVVVLENTRFQDIDNDFGKRESKNDPKLGEYWASLGDVFVNDAFGTAHRSHASNVGIATAMKKAGKPAAAGYLLEKEIKFLGDAVENPVHPFVTILGGAKVSDKIGVIENLIPKSDHILIGGGMAYTFLAAQGHKIGKSLFEADKVELAKSLLEKAGDKIVLPVDNVAATEFSNDAPHEIVGDDIPDNEMGLDIGPKTVEKFRDILKDAKTVVWNGPMGAFEMPNYAEGTLEVGRALADLKDAVTIIGGGDSTAAAKQLGIAPKISHISTGGGASLNYLEGKELPGIACVSDK

SEQ ID NO: 24196 - protein, 251 aa, Lactobacillus johnsonii NCC 533
MRTPIIAGNWKLHMNPEQTIEFVNAVKGKLPDPSKVESVIAAPAVDLYVLKKTAEGSNLHTGAENAYFEVEGAFTGETSPKVLNEMGIDYCIIGHSERRGYFHETDEDINKKAKALFANGVTPIICCGESLETREANKQDEWVVAQIKAALDGLTAEQVSKLVIAYEPIWAIGTGKTASADQAEEMCKTIRETVKDLYNEETAENVRIQYGGSVKPANVKELMSKPDIDGGLVGGASLDPESFLALVNYQD

SEQ ID NO: 24197 - protein, 432 aa, Lactobacillus johnsonii NCC 533
MSVITDIHAREVLDSRGNPTVEAEVYTELGGFGRAIVPSGASTGEHEAVELRDGDKSRFLGQGVLTAVENVNGEIAKAVIGLDVTDQRLIDQTMIDLDGTPNKGRLGANAMLAVSLASARAAADELGLPLYEYLGGPNAHVLPTPMMNVINGGKHADNNVDIQEFMIMPVGAKSLHEAVRMGAETFHTLKSLLQERGESTAVGDEGGFAPNLKNNEEPFEILVEAIQRAGYKPGQDISIAFDCAASEFYNKDTKKYVTVADGREYTAEEWTSLMEDIVDKYPVISIEDPLDENDWEGWKVFTERLGDKVQIVGDDLFVTNTNYLEKGIKMGVANSILIKLNQIGTLTETFEAIEMAKEAGYTAVVSHRSGETEDTTIADLVVATNAGQIKTGSMSRTDRIAKYNQLMRIEEALGSTAQYKGIHSFYNLHKQF

SEQ ID NO: 24198 - protein, 447 aa, Lactobacillus johnsonii NCC 533
MSKVVHFDASKLTPFVHENELKEMQAMVTAADQELREGTGAGSDFRGWIDLPINYDKDEFDRIKKAAKKIQNDSEVLVGIGIGGSYLGAQASIEFLNSSFYGREKEKYPTVVFCGNSLSGSYLYDLLEWLGDKDFSINIISKSGTTTEPSIAFRVLKDKLIKKYGKEEAAKRIYATTDRAKGALKTEADAEGYEEFVVPDDIGGRFSVLSAVGLLPIAVAGGDIDAMMKGAADARAAYTDPDVLKDSPYQYAAMRNILYRKGYTTELLENYEPSLRMFGEWWKQLMGESEGKDQKGIYPSSANFTTDLHSLGQYIQEGRRNLMETVIRVEHPTHDVTIPDDKENLDQLNFLSGKTMNYVNDRAYEGVVLAHTDGGVPVMTVDIENQTAHTLGYLIYWFELAVGISGYLNGINPFNQPGVESYKRNMFGLLNKPGYEDLHDDLTKRLK

SEQ ID NO: 24199 - protein, 428 aa, Lactobacillus johnsonii NCC 533
MTVYVEKVRALEIFDSRGNPTVEVHAYLSDGTVAKAEVPSGASTGEKEAVELRDGGNRLQGKGVTQAVTNVNGPINDALKGLSPYNQAEIDRTMIKLDGTLNKAKLGANAILGTSMAIARAAARSKDEPLYRYLGGCELEMPQTFHNVINGGKHADNGIDIQEFMITPVAKNSFRDGFEKIVNTYHALKAVIEEAGFETGLGDEGGFAPNLNSSEEALKMLRKAIIKAGYKPRKDIAIAFDAAASSFYNTEDGKYHFEGHIWNGEEMLQYYDKLLKEFPEIISCEDPFDENDWENFEKFTAKFGSTHQVVADDNVCTNPKLVRKAIKDKLCNSILIKLNQIGTITETLETIRLARKNNMTTMVSHRSGETGDTFIADFTVATNAGQLKSGAPARSERVEKYNRLLEIENQIGVENERLNHFPNNVDFD

SEQ ID NO: 24200 - protein, 307 aa, Lactobacillus johnsonii NCC 533
MISFYHKFLPGLTKMAKTMKSGGNKALLQIAHTGREANYRAHLGLPVYAPDSANYPFLPYGVQAFTTEQVEQVVKDFGRATKRAIEAGFDGVEIHGANHYLIQQFFSRFSNHRQDKWGDYEAFPLTVAKEVFKVVRKYAPQDFIIGYRISPEEINPGNVGYTWHESTKLINDLTNNFDFDYIHLSLPDYKAKPKDSDKTFAALFKPVIGKETKLIIVGDVMSQETAEDALKYTDLVAAGRAQIIDANFAAKVVAGKGDKVITELSDEEEKEQALTPGLREVMDKQTKRPNFAKMLQGLDYSKAIKVK

SEQ ID NO: 24201 - protein, 246 aa, Lactobacillus johnsonii NCC 533
MTEKILEVEDLNKFYGNKQVLHDISFSLNKGEVLTLLGPSGSGKSTLLRCLNGLEEFKSGTIIFEGKKVIPTAKNWQQLRQKIGMVFQSYDLFPNMTVLENILLGPVKVQKRPKAEVEKEAKALLKRVHLEQYANSYPRQLSGGQKQRIAIVRALALHPDLMLFDEVTASLDPEMVRGVLELIKQLSDEDHMTMIIVTHEMNFAKQIADQVLFLENGTIVEDTPGKEFFEHPKTKRAEEFLESMEF

SEQ ID NO: 24202 - protein, 349 aa, Lactobacillus johnsonii NCC 533
MAAQIDLKNITVQFGQNKAVNDVSLEINKGDIYGVIGFSGAGKSTLVRTINLLQYPSAGSVEVNGTVLFKDNKLQISKKQLQEKRRKIGMIFQNFNLLNEETVIENVAFALQHSRLSDQELEKKSLHLLELVGLKDKADFYPAQLSGGQQQRVAIARALANDPDILISDEATSALDPKTTNQILDLLYDLNKKLGLTVVLITHEMDAVKRVANKIVVMEKGKVIEKGELREVFLHPQKQLTRQFVGGALQAQHILNTYNFDKLAENAELYQLVYSINDVTKSVVADLDVSLNTKASILYGNVEVLSGEPIGTLAILLNLNELKQKEAIKFLESKNVVVTKLDKGVLTND

SEQ ID NO: 24203 - protein, 428 aa, Lactobacillus johnsonii NCC 533
MLKSVIENVHALEIFDSRGNPTVEVFVTLSNGVVGKAEVPSGASTGENEAVELRDGGSRLGGKGVMNAVNNVNTEINDALKGLDPHDQPNIDATMIALDGTPNKGRLGANAILGVSMATAAAAAKDNHQPLYRYLGGTDLEMPQTFHNVINGGEHADNGIDIQEFMITPVAKTSFRDGFEKIVNVYHTLKKVLEDMGYETGLGDEGGFAPNMKNSEEALKALHESIIKAGYKPGEDIAIACDCAASYFYNKEDGKYHLEGKVLTDEELADYYDKLLDEFPELISMEDPYDENDVEGMVKFTQSHKDRIQIVLDDFICTNPKLLNKAIHEGAGNASLIKLNQIGTVTETLETIRLSRKNGYNTMISHRSGETGDTFIADFAVAVNGGQLKTGAPARSERVEKYNRLLEIEEELGKGERLAFFPDNVDLD

SEQ ID NO: 24204 - protein, 388 aa, Lactobacillus johnsonii NCC 533
MAQRDYYDVLGVDKNASESEISKAYRKLAKKYHPDLNHEPGAEEKYKEVNEAYEVLHDKQKRAQYDQFGQAGVNGQGGFGGQGFGGFGGQGGYSSQGFGDFGDIFGDIFGSAFGGGRSRVDPTAPQKGQDLDYTMTIDFMDAIKGKKTDITYTRSEVCPTCDGSGAEKGTHPITCDKCHGSGVMTVTRQTPLGVIQQQTTCDKCGGRGTIIEHPCQTCHGQGTVDKKQTLQVTVPAGIDNGQQIRLSGQGEAGKNGGPYGDLYIVFRVKPSKEFRRNGTTIYTEAPISFAQAALGDKIRVNTVHGPVDLTIPAGTQPNTNFKLRGQGVPKINGTGNGDQEVTVKVVIPKKINDKQKEALVDYVKAGGGNISPQEKNFFERLKDKLNGE

SEQ ID NO: 24205 - protein, 216 aa, Lactobacillus johnsonii NCC 533
MIAPSILNADNMHLSRDIKAAIESGIDRFHIDIMDGHFVPNLSYGPELVKDFKRSFPLTDAEIHLMSNDLETTLPLFVEAGCDLLEFHYEATDNPEYWLKYLKDHNVRCGMAINPSTPVQKLQPFLKELDQVLLMTVKPGFGGQKFEEESVERLVELKNMIEAENLSVPIEVDGGIEPKTLKLTRDAGATIFVAGSYIFKNGSIEDQVMKLKKEDK

SEQ ID NO: 24206 - protein, 445 aa, Lactobacillus johnsonii NCC 533
MSKTITAEDIKKSVKDNDVRFLRLAFTDINGTSKAVEVPTSQLDKVLTNDIRFDGSSIDGFVRLEESDMVLYPDFSTWAVLPWGDEKGGKIGRLVCSVHKTNGEPFEGDPRNNLKRVLKEMKEKGFTDFDIGFEAEFHLFKLGEDGNWTTEVPDHASYFDMTSDDAGARCRRDIVETLESIGFEVEAAHHEVGDGQQEIDFRFDDALTTADRVQTFKMVVREVARKHGLYATFMAKPVEGQAGNGMHTNMSLFKDGKNVFYDKDGEFHLSDTALYFLNGILEHARAITAIGNPTVNSYKRLIPGFEAPVYISWASKNRSPLVRIPDAEEINTRLEMRSADPTANPYLLLAACLTAGLNGIKEAKKPMAPITSNVFEMSEEERAKRGIKPLPSTLHNAVKAFKADPLIQEALGEHLTQSFIDSKNLEWSKYTQSVSDWERDRYMGY

SEQ ID NO: 24207 - protein, 490 aa, Lactobacillus johnsonii NCC 533
MFYPQVDQDDSLILHTDLYEINMMYTYFKKGISERNSVFEVFFRKEPFGNGYAVNAGLSHVIQYLNNLRFNESDLEYLKETCDYDDDFIDYLRNLELRLTIRSAREGELVFANEPIMQVEGPLAQAQLVETAILNIINFQTLIATKAARIKVAVGNDGLMEFGSRRAQETDAAIWGTRAAYIGGFDATSNVRAGKLFDIPVAGTHAHSLVEAFNNEYDAFKAYAETHKDCVFLVDTYDTLRSGVPTAIKVAKEMGDKINFQGVRIDSGDMAYISKKVRKQLDDAGFPDAKIYASNDLDEKTIQNLKMQGAKIDVWGIGTKLITAFDQPALGGVYKLVAIEDKEGKMRDTLKISSNAEKVSTPGKKQVWRIQANSEKKNEGDWVSRYDEDPRKFDALFMFHPQYTYINKVVTDYTARPLLQEIFHEGKLVYKEPTLKETKEFAANNLDGLWDEYKRSLNPQDYPVDLSQKLYDNKMSLINDIRSRIVKRGY

SEQ ID NO: 24208 - protein, 443 aa, Lactobacillus johnsonii NCC 533
METIKNIIIGFGKGGKTLAKFLAQKGEEVLVIEKSNKMYGGTCINIACLPSKRLIIEAANGVSYVDAVNGKNEMTAQLREKNYHMLADEKTVTVLDGEAHFIADHEIEVKLPNGKKVQYKGDRIFINTGAVPVMLPIPGLKESKYILDSTQAMDEKKMPKNLTIIGAGYIGLEFASMFAKYGSKVTVLDHNKEFLAREDEDISNAVRKDMEDAGIKFELGADIEKITDETSDAKITYQINEERKTINADRILVATGRKPNTENLGLENTAIETTDRGAIKVDDFLRTTVDNVWAIGDVKGGLQFTYISLDDFRIIKDQLFGTGARMVSDRKVVPYSVFISPALSQVGLNEKQANKLGKEYKLFKLPVTAIPKAKVAKDNRGLFKALVDPETEKILGATLYGIESYELINMISLAMKAHLSYTVLRDQIYTHPTMSEAFNDLFK

SEQ ID NO: 24209 - protein, 457 aa, Lactobacillus johnsonii NCC 533
MSKNSSESSEVKTMKRSLTNAHIQLIALGGTIGTGLFLGVGNSIELAGPAVIFIYCLVGFFLFLLMRALGELILSDIKKNTYIDFISEYLGKSIGTTTGYLYWFSWLTLAMAEITALGIYFQYWWPNLQSWIPGLITLLVLLGINLISARVFGNLEFSFAIIKIVTIIAFVILVFYLLITNSSTKYGHVSWNNMMIDGGIFAKGPKGFLLGFQMVIFSFIGVELIGLTAAEAKEPKKTITRAIDQLPVRIILFYVLAILSILLAIPWTKVSTSSSPFVQALGATGIKNAGSIINFVVISAAISSTNSFIYSAGRLLFSINYNGKNKISKHLGKLDHRQLPKNALVFSTVLIALAPLLNLFLKDAFTFISATATSMFLLIWSIMIVTHMTYRKKTPKNELPTFRMPLYPISDIAVLIFFIAMIIVLLIFPNYRIPMISAGIIFTVLVCLTHFIQKKSN

SEQ ID NO: 24210 - protein, 248 aa, Lactobacillus johnsonii NCC 533
MSKVVQVQNITKTYGKKGEKQYQALKGVSFDVERGEFVGIMGASGSGKTTLLNILSTLDQPTTGNVYINGRDITGLNKNQMADFRGQEIGFIFQDFNLLENLTNRENIALPLSLQNVKSSQINPKVDKIAKRLGIDHILNKYPAEISGGQKQRVAAARALVHEPAILYGDEPTGALDSKSATELLETMKGLNENDRVSILMVTHDPYSASYASRILFIKDGKIGKEIKKDGKSREEFYQEIIAELGRR

SEQ ID NO: 24211 - protein, 492 aa, Lactobacillus johnsonii NCC 533
MKYYHVPEGFKWGVATAANQIEGAWNEDGKGISIADCERYDPEKARAGYKSANSMTSSEIKRAMADKDSKRWGKRHGVDFYHQYPEDIKKLAATGINTFRTSIAWSRIFPNGDDIKPNEKGLEFYDKLFDELHRYNIEPIVTLSHYEMPLNLVLNYDAWYDLRVREFFIKFAKIVIDRFHGKVKYWIPINEIDSILRHPFSSAGLIRDRFLNENFEKVIYQAMHNQFVAAAAITKYIHETYSDIQVGSMITSTMIYPYNSDPRNSLKSVQLMRESYNFSDIQIRGKYPLNLVPKLKNLHIKISKEDLDLISENTADFIAFSYYSSVCTAFDTKGLKVTKANRMEGVYNKYLPTSDWGWQIDPIGLRIILINLYDRYQKPLFIVENGLGAKDSLTTSGKIHDDYRIDYLRQHIKQMLVSIQNDGIELMGYCMWGMTDMVSASTTQISKRYGLIYVDLDDFGDGTYKRYLKDSYFWYQKLLSFKNKIPKDFLDK

SEQ ID NO: 24212 - protein, 466 aa, Lactobacillus johnsonii NCC 533
MNENETSKLGFWSIVLLAINSIIGSGIFLTPGSVVQQAGSKALIVYFIAAIFASILAISFAAAAKYVTKSGAAYAYSKAAFGNNVGFYMGILRYFSASVAWGIMAVGVIKSTISIFGGNPNETMSVTIGFLILMAVITVINLFGQKVVKYVMNLATIGKLAALVLIIVAGVVLLIVSGASSNLSQVDQITQNGQKIVPTLTTTGFVMAIVSAFYAFTGFESVASGSDDMKNPAKNLPRAIPLAIIVIAVIYIGVVAVAMMLDPKALMTTKQVVAIAAIFKNEILRDVILVGALVSMFGINVASSFNAPRILEAMARENQFSKALTKRTKNNFPIRTFFISVLFAILIPMAFEYNMVNLITLSAMVRFLGFIVVPLAVIQFYRGKTAEPVLDAQRNVWTDIVVPILSIVLVIFLLVEYNWKAQFGVVNAQGQVTGINWYAIAMMIFGFILLPLIMFIISRKDRKASK

SEQ ID NO: 24213 - protein, 460 aa, Lactobacillus johnsonii NCC 533
MENKQNHPPKLKRSMTAGQMEMISLGGAIGVGLFMGSTSTIKWTGPSVLLAYMFVGLILYIVMRALGEMLYVSPGTGSFADYATEYISPLAGYLAEWANVFQYIVVGISEVVAATEYLKFWWPEVSVFWSGIIIIAFLLLANLASAKAYGTLEFWFAMIKVVTIVIMIILGLLVILLGVGNHGKPIGFSNLWSHGGFFTGGVKGFFFSMAIIAGSYEGIELIGISAGEVANPQEAIVKSVKSVLWRILIFYVGAIFVIVTIYPWNQLSNIGSPFVETFTKVGITAAAGIINFVVLTAALSGANSGIYSSSRMLFKLAHEGEAPKAFGKLSKRIVPDRAIVGITSGILIGFILNLIMSTMNKSMGELFVVVYSSSVLPGMVAWFVILIAELKFRKNNSHLMAEHPFKLPLYPYSNYFAFAMLLVIVVFMFINPETRISVGVGAGVLVLASLVYMLKHRNKK

SEQ ID NO: 24214 - protein, 464 aa, Lactobacillus johnsonii NCC 533
MENKKSMPKLKRSMTAGQMEMISLGGAIGVGLFMGSTSTIKWTGPSVLLAYMFVGLILYIVMRALGEMLYVNPGTGSFADYATEYVHPLAGYLAEWANVFEYIVVGMSEVVAATEYLKFWWPKVNVFWSGIIIILFLVLANLASAKAYASLEFWFAMIKVVTIILMIILGFIVIFFGVGNGGKPTGFSNLWSHGGFFTGGVKGFFFSMSIIVGSYEGIELLGISAGEVANPKKAIVKSVKSVLWRILIFYVGAIFVIVTIYPWNELSNIGSPFVTTFAKVGITAAASIINFVVLTAALSGANSGIYSSSRMLFKLAHDGDAPKTFGHISKRIVPNHAILGISGGILIGFIINMIAATINKSTQDLFVVVFSSSVLPGMIPWFVILLAELKFRRNNQDLLVDHPFKLPLYPISNYFAFLMLIVIVIFMLINPETRVSVLVGAAVLLIATIVYLFRHKKDGVNNGE

SEQ ID NO: 24215 - protein, 465 aa, Lactobacillus johnsonii NCC 533
MKNFFKKVPVNTFLKADSRLTRHLNARDLVALGIGAVIGTGIFILPGHEAAQHAGPAVAISFLLAAIVSGMVGMAYAEFSSAMPVAGSAYSFGSVIYGEVVGWIIGWGLLLEYFLAVSAEATGFASYFNNNILAPIGIHLPKALEAGPMEGGVINISAVLIVLIVALILYQGANLSKRVENIAVIIKVAIIILFIVIGMFYIKADNYVPFYPKKFQTPPLGIGGISTAAATVFFAFIGFDALAANSAETKDPEKNVVKGIMGTVIIAVLLYVSFSLVLTGMVNYKQLNVDDPAAYALKVVGLTAWNKLITVGALVGIFTAMITMLLGGSRLLYALGRDGLLPDSMGSVHAKKMIPDHAVIVSTIVAAVFAGLVPLMELASLINAGTLIAFALISFGIIPLRHRKDIVNDGFKMPLYPVLPVIAGLLSVYFIWMLPNTTKIMVGIWLIVGIIVYATYGIKHSKLQN

SEQ ID NO: 24216 - protein, 279 aa, Lactobacillus johnsonii NCC 533
MEKSFQESNLSGLGMGTWGIGEDASKKKDELAALRYGLDHGIKVIDTAEMYGEGKSEKLIGEAIRGYDRSKIFLISKFYPYHASPELERQSLEKSLKRLGTDYLDLYLLHWRGDKRLSETVRGLKELQKEGLIRHWGVSNFDVADLEELFSVPGGKDCFANEDLYNLSERGVEYAVLPWQEKHGVGFIGYSPFNSGKGDSIRITNNLKIVARAHHVTPHQVMLAWTLRKGNILSIPKAGNVKHMKENIAAKDIKLTPDEIKLIDNDFPQPTEKMPLAMI

SEQ ID NO: 24217 - protein, 436 aa, Lactobacillus johnsonii NCC 533
MNFIKNYFHLEKLGTNVRTEFIAGLTTFISMSYILFVNPSVLGASGMNTGAVFTATALAAALGTAIMGIVANYPIGEAPALGINAFFAYTVCIGMKVSWETALASVFVASIIFILITLFKLREKIIDSIPSDLKFAISSGIGLFIAFLGLQNGGLIVANKSTLVGLGSLHNPLVWITIFGLIVTVILMILGVPGAIFIGMIAASIFGICTGQIAVPHKFISLAPSLAPTFGQAIFHVKDINSLQMWVVVLTFLLVTFFDTAGTLIGLAQQAGFMKNNKMPRVGKALAADSTAMMFGSIFGTSPVGAFVESSAGIAVGGRSGLTAVFVAIFFLISMIFSPLLGVFTTQVTAPALIIVGVLMAQNTAHIHWNKLEIAVPAFLILLGMPLTYSISDGLALGMITYPICMVSAKRGKEVSPMMWVLFVVFIIFLWVLNFK

SEQ ID NO: 24218 - protein, 436 aa, Lactobacillus johnsonii NCC 533
MNSIGKFFHLNENHTSFKTEFLAGLTTFVSMSYILFVNPAVLGASGMNKGALFTATALSAAFTCIVMGVIANYPIASAPTLGLNAFFTYTVCLGMHVKWQTALAAVFVASILFILLTVFKVREMIIDAIPSDIKYAISAGIGLFIAFIGLQGGKLISKSDSTLVTVGSLNNPLVWITIFGLVVTIFLMIAKVPGAIFIGMIVAAIFGIIIGQIPMPKAFISGVPSLSPIFGQAVFHISDINTVQMWIVVFTFLLVTFFDTTGTLIGLVQQAGLMKDNKMPRAGEALAADSSGMLVGSVLGTSPVGAFVESSAGIAVGGRTGLTAVWVGIFFLISTIFNPILSVFTTQVTAPALIIVGVLMAENLAHVHWTDLEIAIPCFLIALGMPLTYSISDGLGWGLIIYPVSMLAAKRFKEITPMMWILFFIFVIYFVVLNVK

SEQ ID NO: 24219 - protein, 437 aa, Lactobacillus johnsonii NCC 533
MQFLDKIFHLEDAHTNVKRELIAALTTFVSLSYILFVNPNILSAAGINKGAAFTVTAIATAIGCFLMGFIANYPIALAPTLGSAAFFSYNVVIGMHINWQTALASVLVASILFILITVLKLREKVVDAIPQDLKYAISAGIGLFIAFIGLQNGKLIVDNKSSLVGLGSFNNPAVWITLFGLILTVILMAAKVPGSIFIGMIVTAIFGMIIGQIPMPHGIVSGAPSIAPTFGQAVFHLKDINTPQLFMVVLTFLLVTFFDTAGTLIGMTQQAGMVDKNGKIPRIGKAFLSDSLAMVEGSVLGTAPLGTSVESSAGIAMGGRTGLTAIFVGILFLISMIFSPLLAVIPTTVTAPALIIVGVLMAGNLKYIHWDNFEIAFPSFLVVVGMPLTYSISDGLALGMIAYPITMIASKRYKEVSPMMYILFVIFVIFFLITNMG

SEQ ID NO: 24220 - protein, 462 aa, Lactobacillus johnsonii NCC 533
MQQFGVIGLSVMGKNLALNVKNHGYSVSGFSIDKPEVDALAKYEDKNLKPTYTWEEFVNSLEKPRKILIQIMAGKPVDETLQKLLPLLDKGDILIDGGNSNFHDTNRRYKEMEKHGIHFIGMGVSGGEEGALNGPALMPGGDEKAYEEVAPILEAMAAKTPTGQPCVGYIGPAGSGHYVKMVHNGIEYGIMQIISEVYDVLRTVGHYSNNEMSEIFKNWDKGGLQAYLIEITSKVLKQKDNLTDDHIIDHILNEASYKGTGNWMLEDAIRLGAPITVIAEAVLARFMSKATLRNDPEPKIDPEKAPKDLVDQLAKALYLAMAVSYGQGFEQLTMAAKAYNWRLHYSTIAQNWEAGCIIRSQMLHDIKFAYNADKDLPNLFKAPFFDKVKKENIGALRDVVKIAADAGVPTPTLSAALNYLESIFNPRLPQNIIQGQRDYFGAHTYQRNDRPGTFHTEWYEEK

SEQ ID NO: 24221 - protein, 372 aa, Wolbachia endosymbiont of Drosophila melanogaster
MSKKDYYDLLEVGRNASIDEIKKAYKKLALRYHPDRNPGNQEAEEKFKEVTAAYEVLSDSEKRAGYDRYGHEGASGGFQGFSSAGDFSDIFNDFFGGGFGGGASRSRAKRSTTGVSGADLRYDLEITLEDAFKGIQAPIHYVTNVKCDTCQGTGGEGAIKPVQCHTCQGSGRIRTQQGFFTIERTCTTCYGEGEIIQNKCKKCGGSGRRRDEVNISVSIPKGIEEGAKVRISGKGEAGTKGGKSGDLYVYVKIIFHKIFARNKADLHCKVPIRMTLAVLGGEIDIQSIDGAKIKVKVPEGTQTGTKLRCREKGMPYMNSHARGDLYVQVIVETLNPKNLTKKQIELLKALEEEENASVQQQSEGFFSKVKKK

SEQ ID NO: 24222 - protein, 494 aa, Wolbachia endosymbiont of Drosophila melanogaster
MEACYSFDDILLLPAYSNILPCDADTKTYLTNSIELNIPLISSAMDTVTESGFAIAIAQHGGIGCIHKNLSIDEQVLEVRRVKKYESWIVYNPITISQDKTVAEAISLMREHNYSGIPVVDQRKLVGILTNRDMRFIEDQNMNVKVSEVMTKDKLVTVREQGVNSASAMKLLHENRIEKLLVVDENSCCIGLITVKDIEKYNRYPNSCKDSKGRLRVAAAIGTGKKDGIDRCEALIGEEVDVVVVDTAHGHSENVINTIREIKKMYPNTQLIGGNIATKEAAEALIDAGVDAVKVGIGPGSICTTRIVTGVGVPQFSAIKNVAEACRARNVRLIADGGVKYSGDVAKAIAAGADSVMIGSIFAGTDESPGEIIMYKGRAYKGYRGMGSISAMKRGSASRYFQDKDSKLKLVPQGVEGRVPFKGPASGVIHQLIGGLQAAMGYTGNRNIEEMKKNCKFVTITASGLRESHAHDIVITQEAPNYAYQTSNLSTDSE

SEQ ID NO: 24223 - protein, 242 aa, Wolbachia endosymbiont of Drosophila melanogaster
MSFLIVANWKMNGMRSSFVDFIGKLNNKSNEITSKLVICPPFTSFPSSIELNNNIDIGAQNCHHKKFGSYTGEISAEMLKELGCTYVMLGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLSISNLSGVLIGSASLDFDHFYKIIQQVEKKFSLINSKISN

SEQ ID NO: 24224 - protein, 1046 aa, Wolbachia endosymbiont of Drosophila melanogaster
MISSIQEPNELRKRLQGFYRTDEKSYIRYLVEKAELSADSKNRIYNIAKQVIEKIKHNKLSIVDSFMQQYSLSNDEGIALMCLAESLLRIPDDYTIDEIIKDKIANQEWNKYLGHSSSLFVNASTWSLMIGSSILRDNEGDSKFYYAISKLLKNLGEPIIRKAVKQAMSMLGNHFVVGETIEEALRYAKLDDNSKFLYSFDMLGETAHTAEDAEEYFNSYMHSIKAIGESTEINDCFKSHGVSIKLSALHPRYEFGQFDNIAEELRAKLLELCHEAKKYNISLCIDAEETERLEMSLILFEQLRLDESLSEWEGLGLAVQAYQKRALSVLDFVEDVAIRSKHKIMVRLVKGAYWDSEIKRTQELGLNDYSVFTRKSYTDVSYFVCAQKLLSKPNSFYPCFGTHNVYTFASIMELADKNHPGFEFQRLHGMAKDLYDYAMSELATNVSCRVYAPVGEHSDLLPYLIRRLLENGANSSFVNQISDPNVKIDELISDPLEKAINFNYEPHPGIPLPQDILGPERKNSLGMDISDSVIVSQFADDIKGFSEKKWQIGPIIDGKALFDNAEFIEVVNPAHLENVIGEVSSATSDQALNALEIAHSAFAKWQNVSAEERAKCLEKAADLLEERMKELIYILIVEAGKILSDAIAEVREAIDFLRYYAMIAKNELSDWKKLPGPTGEDNFIFFEGRGVFLCISPWNFPLAIFIGQVSAALAAGNAVLAKPAEQTPIIAYEAVKILHEAGIPKNVLHLIPGDGGYLGKILVPDNRIAGVAFTGSTQTAQIINKMLANRDGPIVPLIAETGGLNAMIVDSSALLEQVAMDALLSAFRSSGQRCSALRVLFIQEDIAEKQIKMICGAAQELKIGDPIQLSTDIGPIIDKASIDMLTQHTQKMSEDEDSNLLFKVPMDTNSHNGYFFPPYIYEIQKISQLKQEVFGPILHIIRFNKSQLNEVISDINSTGYGLTFSLQSRIQSQIETISKKISVGNVYINRNQIGAAVGIQPFGGRGLSGTGPKAGGPHYLQRFSTEKVVSVNTTAFGGNTTLMCLD

SEQ ID NO: 24225 - protein, 457 aa, Wolbachia endosymbiont of Drosophila melanogaster
MNEYDITVIGSGPGGYIAAIRAAQLGFKTAIVEKEKNLGGICLNWGCIPTKSLLRASEVYRLIKRSKEFGIEVKGANFDIQSIVKYSRNVVDKLSSGVAYLMKKNNIKVHQGFGKLAGNGTIKVVSDKEEQEIVSKHIILATGVRARNLPGIEADGDLIWNAQHAMTPERLPKSLLIIGSGAIGIEFASFYSTLGVDVTIIEIKSTILPLEDKDISDLAQEIFTKQGIKIYTNSSVKALTKSKDSAQVLLSSGESKEFERVIVAVGIQANIENIGLENTKIKLSPSGFIETNEWYETSESNVYAIGDVAGPPCLAHKASHEAVICIEKIAGKNAHALKKECIPNCTYSHPQIASIGLTEEQAIKGGYDIKIGKFHSNFNGKSVALSETEGLVKTIIDKKTGEILGSHMIGAEVTELISNFALAKQLEGTDFDIKSTIFPHPTISEMIHESVLAADVK

SEQ ID NO: 24226 - protein, 424 aa, Wolbachia endosymbiont of Drosophila melanogaster
MNKVINNVFAREILDSRGYPTIEVEIELCDGAIGRASVPSGASTGKLEVLELRDQDEKRYCGKGVLKAVQAVNGIIADEIIGMNAADQNAIDKALIELDGTKNKSKLGANATLGVSLAVAKAAANSFKMPLYRYLGGKQTSVMPVPLINIINGGVHADNKLDFQEFMILPVGAETFSEAIRISAEVFHNLRSILKKKGYSTNVGDEGGFAPNIESTEEALDLIIYVIESAGYSAQSDFALGLDVASSTFYEDGIYKFEHRDLTSEELTEYYCNLVERYPIISIEDAMSEDDYEGWKLLTAKLGSKIQLVGDDLFVTNCELICKGIEEKMANAVLIKPNQIGTLTETFAAIEMAKSNGYKAVVSHRSGETEDTTISHIAVASNCGQIKTGSLSRSDRLAKYNELIRIESALGKDAKYYRGLAWVL

SEQ ID NO: 24227 - protein, 392 aa, Wolbachia endosymbiont of Drosophila melanogaster
MDHVVNAYNRLDTPIVRGEGAYLFDKDGKKYLDFAAGISTTSLGHCHPYITDKLKEQSSSLWHCSNIFTIPEQERLAEHLTTLTFADKVFFCSSGLEATEAAIKFIRRYFYSKGQAKRNRIITIEGGFHGRSIAAISAGGNEKSREGFAPLLSGFDKVPRNNIKALEEKINNEIAAVFLEPIQSEGGVYPLDVEYLQKVREITKAQGIILCFDEVQCGYGRIGSLFHYQNVGIEPDMLTCAKAMGNGFPVAACLVKDYIAEAITPGTHGSTYGGNPLAMTVGNAVLDIMLKEGFFDHVKRISKYLKEKLLLLAKEFPEMILEVRGEGLLMGIELATLVADKIISRSLDKGLIITRVLNNKVVRVTPPLIIEDEHVNAACNMLYDLFLKIKGI

SEQ ID NO: 24228 - protein, 213 aa, Wolbachia endosymbiont of Drosophila melanogaster
MIITIFGPPGSGKGTQSSLLIAKYNLKLISVGDLLRNIISSSSELGKKIKGTVESGNLIQDEIICGLLRDQLALVDDNCLLDGFPRNLNQAHFLTQVLQEKYNRDVDIVVELQLDDNIAIDRLKNRLACLDCKNIYSVSSFKSTTCAKCKSTRLEKRIDDADMSAINKRISEYHLQMKGLREYYKGKLLTIDANLSVDEVTQEIESKISCNLV

SEQ ID NO: 24229 - protein, 225 aa, Wolbachia endosymbiont of Drosophila melanogaster
MSIKIAPSILSADFAKLGEEVRKISDLGVDYIHIDVMDGNFVPNITIGPSVVSAIRKYSNLPFDVHLMVKSPGKHIESFINAGADIITVHAEVETHLERLIRKIKSYKNVNDEKKPIQVGVSIVPSTSPSVLEYIIHELDIVLIMTVNPGFGGQEFIHSQLNKISTIKKMIQERNLKTQISVDGGINFFNAADIIKAGADILVAGSAIFKAEDIKKAINYLKNPS

SEQ ID NO: 24230 - protein, 459 aa, Wolbachia endosymbiont of Drosophila melanogaster
MTDYDLIVIGGGPGGYKCAIAAAKLGLKVACIDKNSIFGGTCLRVGCIPSKALLHSSYQYAHTKNDLSKLGIKIKDASFDLKEMLGYKDARVQELGKGIEYLFNLHKITKINGLASFDQGNLEVSVEGKVLKTKNIVIATGSDVISLPGINIDEKSIISSTGALSLTEVPKKLVVIGAGAIGLEMSSVWRRLGSEVTVVEFFDRIAAAMDGELSKSLLSSLQKQGIKFLLSTKVEEIKQSSNSLSVKVCSVKDNQTNTIEADKVLVAAGRKPCTENLGIDEKIEKDNRGFVQVNNRYETNVKGIFAIGDVIGGAMLAHKAEEEGVAVAEIIAGQSPHVDYGIIPSVIYTHPAVSSIGKTEEELKNAGRKYKVGKCQFAANGRAKITDDAEGFVKVLTCSRADTILGVHIIGAYADTLINEAAVAMAYSAAAEDIYRICHSHPDINEAFRDACIDAFFKK
